United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 21

SEQ ID NO: 106232 - protein, 305 aa, Glycine max
  Coding DNA Sequence Number=SeqID_14547
  Gene Ontology: Mol. function=hydrolase activity
  Homolog annotation: Hit_ID=A7NUU9; Match level="QueryCoverage=61%, HitCoverage=80%, E-value=1e-66, Identity=64%"; Hit description =Chromosome chr18 scaffold_1, whole genome shotgun sequence
  Pfam annotation: Domain name=DUF1637; Domain location=1-183; Score =180.2; E_value=5.1e-51; Accession=PF07847.3; Description=Protein of unknown function (DUF1637)
KIEAMDVGIDEFGLCDSPTSDATVDSSNSKGLLGGQGFSEITYIHIHESGKVFPLHDHPGMTVLSKLLYGSAYVKAYDWIALDCAGSQTIGLAGRVVDEVFKAPHEPSILFPRSGGNIHSFTALTPCAILDVLSPPYSEEFGRPSTYFSDIPIPSLNGYAILEEKPMPSDLVVQGAPYLGPSIVTVDDYVGRGTLFTKVAKEKMNEDRARNTARPVQSIRDAPQEEGLRWVQGSSFWVFALSRPIAFSTKESFVEDNIDFNGEDALNVNCNNSNNDNRKMIMVHHCGKSSSITCGRVTGEKKRGS

SEQ ID NO: 106233 - protein, 429 aa, Glycine max
  Coding DNA Sequence Number=SeqID_14548
  Homolog annotation: Hit_ID=A7R005; Match level="QueryCoverage=93%, HitCoverage=94%, E-value=1e-30, Identity=31%"; Hit description =Chromosome chr7 scaffold_294, whole genome shotgun sequence
  Pfam annotation: Domain name=VQ; Domain location=160-190; Score=52.8; E_value=1.2e-12; Accession=PF05678.5; Description=VQ motif
MDSGNSGSISSSGDEEYDSRADHTVLPSTFINNHHHHPPSQFGSISQHPLVASSHYQQHQPHPSLFDLSPSYLHALSQPNSFLNLDTTTSSSQPRRSEPDCTLNVTSSPPPPTTTNIDQCLLGSQGGLNVDNARRDTILFESGKTSNLGRNSKKRTRASRRAPTTVLTTDTSNFRAMVQEFTGIPAPPFSASSSYSRRLDLLTGSSSLRSFSHLDTTTGPFYPLRPSPQKVHHHHHHHQNPLLLSSSSSPYNNMVDAIASTTTTNNSSSNNNNNNNNPINFQQQQLPPDLGLPYHHNPQNIMLSMQDHPTLAFHPPPPPLHPFGFSAKLPSIEDLGMSHGQVNNNNPNFVASGHVTSEGVPLRSVNNDGGGARDVSLRSLDGGSCKLNFSVASASTSLNHEKSTLQNNNNASTGTRGEGTVDSWICSSE

SEQ ID NO: 106234 - protein, 68 aa, Glycine max
  Coding DNA Sequence Number=SeqID_14549
MSATDGGDDVDKSGLRIGRKLSDEEDDPCTWDGRKKRSSNCQMQAQGSSKVKGEGTENGRAEGMKMRE

SEQ ID NO: 106235 - protein, 34 aa, Glycine max
  Coding DNA Sequence Number=SeqID_14550
MAFTLEWRDAKEEENDGEGEEEEELEEENSHSSS

SEQ ID NO: 106236 - protein, 106 aa, Glycine max
  Coding DNA Sequence Number=SeqID_14551
  Subcellular localization annotation: CTP_CleavageSite=47; ConfidenceScore=5.11e-01
MILAKFQVEKKNQITLTSKHSTCHSISTFQNYNLSLNSSIGNTKLVSTSKLGRVDPDRDKIDIEYFFNILELEKKGLRLNKNLELYGIRAYFDDPQKVYLELIRTL

SEQ ID NO: 106237 - protein, 163 aa, Glycine max
  Coding DNA Sequence Number=SeqID_14552
MTLKLTYYPELVRVFYNNLEIHDGVIFFEVNKRPIVVDYSLFYSLTKLSSQGLPFEGTLVDDWKPIYSSHDASEMVCVANVDMTGRLLTGSFTFECRIMHYIHCRVLLPRSTNLAQASEEDLIKMWALQTGCQIDWAHLVRYRMHKALWANAPYHIPIWSLYF

SEQ ID NO: 106238 - protein, 271 aa, Glycine max
  Coding DNA Sequence Number=SeqID_14553
MRSWVRGQWIPFDADAIGQLLGYPLVLEEGQEYEYGQRRNRSDGFDEEAIAQLLCIPGQDFARTAAGRRVRIMRTNMTTLTQIWMTLLLSNILPSDHNSDLPLPKCQLVWRLPGTLWTRISPTGPWDFPVAPSKVIRPPITRAFIEKYCTQRQVQGDAPQAADAPPPHQAGPARSFDTEQYLRHLVRQQAANHRAHVQTHDCLYQMSLSLQSQGPTSFPCPTPDQFRAEVAWPGDWPEAQAGEAPAEAPDEADEAREDEEMTDLLDFLGGS

SEQ ID NO: 106239 - protein, 146 aa, Glycine max
  Coding DNA Sequence Number=SeqID_14554
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=2e-25, Identity=55%"; Hit description =Putative uncharacterized protein
  Subcellular localization annotation: CTP_CleavageSite=40; ConfidenceScore=5.34e-01
MTMITPSSKLTLTKGNKSCLHKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106240 - protein, 70 aa, Glycine max
  Coding DNA Sequence Number=SeqID_14555
EVEDEEGSMSGGLVEEERGSREEASGTRDPICLILVGSVTEGGEITSGQGEEIGRTSWRDEEWSTEDEKK

SEQ ID NO: 106241 - protein, 36 aa, Glycine max
  Coding DNA Sequence Number=SeqID_14556
MVVIYMLFSLTSAMKTITSSFEGMSNQGAPRWVEPK

SEQ ID NO: 106242 - protein, 78 aa, Glycine max
  Coding DNA Sequence Number=SeqID_14557
  Subcellular localization annotation: CTP_CleavageSite=33; ConfidenceScore=5.05e-01
MATCPHLQRTARPCLQRTARPRLQWTTRPRLQRAARIAPTRHPVDPEEPNRALGFPALVTGLCQSYRVSVPPSKVMPS

SEQ ID NO: 106243 - protein, 107 aa, Glycine max
  Coding DNA Sequence Number=SeqID_14558
MMVDTLPVFYYEKLVGYMPSSFTDLVFAGQRIEVGLKRGKFDYVSSTSANARRIGATGAKRKEGDTHAITSAPAWVKPPQTSHGTHQYAQHHLSFSAHAGNSSNSAP

SEQ ID NO: 106244 - protein, 144 aa, Glycine max
  Coding DNA Sequence Number=SeqID_14559
MKREKHVSYSSHNSCKSLSEELRDYYEGRHRSHLRPQSHRREKERKPQEANINLLYFHGKDNVEANLDWEIRVEQQLKKKSTLKSYGSHSYPKKDQGQGILGVKPSKPKDDKGKTIENKPLRLRTRYFLMPYHENHDYEGPRNL

SEQ ID NO: 106245 - protein, 62 aa, Glycine max
  Coding DNA Sequence Number=SeqID_14560
MEKSEKKNINEKKLKKTYITWDENDMESSEDSENEEINLCFMAKSYESDEEENKDISLIRLD

SEQ ID NO: 106246 - protein, 133 aa, Glycine max
  Coding DNA Sequence Number=SeqID_14561
  Gene Ontology: Mol. function=motor activity; Cellular component=cell outer membrane; Biological process=ciliary or flagellar motility
  Homolog annotation: Hit_ID=A7MQ10; Match level="QueryCoverage=78%, HitCoverage=25%, E-value=4e-39, Identity=67%"; Hit description =Putative uncharacterized protein
MTQDSLARDGIVAGNDNLLLNAAAPILNAVVRIRQAATHDDPAGLRQLLIEEIRQFEQRCKQAGLPFEMIIGARYCLCSVLDEAAAQTPWGTRGVWSGNGMLVTFHNESWGGEKVFQLLSRVSQSPQQHLGIL

SEQ ID NO: 106247 - protein, 217 aa, Glycine max
  Coding DNA Sequence Number=SeqID_14562
  Gene Ontology: Mol. function=sodium:dicarboxylate symporter activity; Cellular component=flagellin-based flagellum; Biological process =protein transport
  Homolog annotation: Hit_ID=P40729; Match level="QueryCoverage=100%, HitCoverage=31%, E-value=8e-85, Identity=77%"; Hit description =Flagellar biosynthesis protein flhA
  Pfam annotation: Domain name=FHIPEP; Domain location=1-217; Score= -44.4; E_value=4.9e-17; Accession=PF00771.11; Description=FHIPEP family
MVLPLPAFILDLLFTFNIALSIMVLLVAMFTQRTLEFAAFPTILLFSTLLRLALNVASTRIILLEGHTGADAAGRVVEAFGHFLVGGNFAIGIVVFIILVIINFMVITKGAGRIAEVGARFVLDGMPGKQMAIDADLNAGLIGEDEAKRRRTEVTQEADFYGSMDGASKFVRGDAIAGILIMVINVIGGLLVGVVQHGMDLGHAGETYTLLTIGDGL

SEQ ID NO: 106248 - protein, 276 aa, Glycine max
  Coding DNA Sequence Number=SeqID_14563
  Gene Ontology: Mol. function=motor activity; Cellular component=cell projection
  Homolog annotation: Hit_ID=UPI00016621D1; Match level="QueryCoverage =97%, HitCoverage=42%, E-value=1e-20, Identity=34%"; Hit description =UPI00016621D1 related cluster
GLHALAFRGLHVLAIRGVHALTFIGLHVLSFRGLHVLSFRGLDALTFKRLHVLAFRGLHALTIRGLHVLAYRGLHVLTFRGLHALAFRGLHVLAFRGHHTLTFRGLHVFAFRGLHVLAFKGLHALPIRGLHALTFRELHVLAFRGLHLLAFRGLHVLTFRGLHVLTIRGLHVLAFRGLHVLTFRGLHALAFRRGLHALTLRGLHVLAIRGLHALTFRGLDVPTFRGLNFLAFKGLHSLSFRGLHVLAFRELHALTFRGVHVLAFRGVHALTFRGLH

SEQ ID NO: 106249 - protein, 148 aa, Glycine max
  Coding DNA Sequence Number=SeqID_14564
KRGHNSGMTPVNRKAGTGERTREPPGGNACMIEFRPVGDKPLVLERRRITTERTRSTGTPWHQLPNIVIASMQHIPLSPAGVIAKRLAPIALPIQLRSLTWFEWKARPVAAQLSAAGGELRVSCAPQALHLPLMSGWCFCRYAPPRQY

SEQ ID NO: 106250 - protein, 79 aa, Glycine max
  Coding DNA Sequence Number=SeqID_14565
MLSSKGDLVGNEVPHIHIDLHNNAIDESGPVKCDIGSVGGGNQGLPINIKLESPPWDTELSSQLLRIRPLECKSGISTE

SEQ ID NO: 106251 - protein, 289 aa, Glycine max
  Coding DNA Sequence Number=SeqID_14566
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRCTTLATQPTNRVRIDSAIGDSNDQKAQCSSDLLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106252 - protein, 115 aa, Glycine max
  Coding DNA Sequence Number=SeqID_14567
MDTLEPYTGAMKGTMHKPQTNLGVMTKNNDWYLKALPWGNERHHAKTSSEPKGQIQEVLTLSMFLNKKKGDKPWNFNGLIKHQTAPLPSLQNGQVTKSNRTNTLREFPERFAKIG

SEQ ID NO: 106253 - protein, 141 aa, Glycine max
  Coding DNA Sequence Number=SeqID_14568
  Homolog annotation: Hit_ID=A5AK77; Match level="QueryCoverage=44%, HitCoverage=7%, E-value=2e-07, Identity=42%"; Hit description =Putative uncharacterized protein
MTRGNPCDLQPFDPEIDRTFHRLVRHSVHPDQPGHFEHFEHSEYSVVGDSEYSDFEHLTTNFHTENMAQSPPYERTLREMATPYFTYESLCIQYPDEGVPYVLKTGLIHLLPKFHGLAGEDPHKHLKEFHIVCSTMKPPDA

SEQ ID NO: 106254 - protein, 359 aa, Glycine max
  Coding DNA Sequence Number=SeqID_14569
  Gene Ontology: Mol. function=aspartic-type endopeptidase activity; Biological process=RNA-dependent DNA replication
  Homolog annotation: Hit_ID=Q6WAY3; Match level="QueryCoverage=37%, HitCoverage=6%, E-value=1e-08, Identity=29%"; Hit description =Gag/pol polyprotein
RNIIPERKVELYHTELDDFKTELERRNFHKRFTNLVDGSTNLALVKEFYANLYNSDDPSPKQARVRDHLVKIDADSLNTFLETPVVLVEEYREIEAALCIPGRGFILNAEGYPGRILRKDLTTLAQSHGHERRSSYFWLDNLYFPVNTSSLGFPALITALCRARGVVSDSLTFERLSPVINLAYIRKNWAKRARARPTELPSTSAAPTAASTLVSVRGNHGKFGLGYKPTQADVRKNISERRNKGQGPRSGQQAKEVPPCHISRSFMSAGLRREGQVTTICDEDSPRRSNLVQPSPPIFQLGNWWVAECLEQEASQTEDEEDEDVGLPPELERIIAQEDREMRPHQEETKLIDLGVDSE

SEQ ID NO: 106255 - protein, 265 aa, Glycine max
  Coding DNA Sequence Number=SeqID_14570
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDSKKEHKIPNRYLMILLTALKCDCLGVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106256 - protein, 136 aa, Glycine max
  Coding DNA Sequence Number=SeqID_14571
  Homolog annotation: Hit_ID=Q0RSL4; Match level="QueryCoverage=60%, HitCoverage=17%, E-value=1e-07, Identity=29%"; Hit description =Putative uncharacterized protein
  Subcellular localization annotation: CTP_CleavageSite=38; ConfidenceScore=5.00e-01
TYQGNPCGVYPDLSSFTGSGVYPDLSSFTGSGIYPDLSSFTGSGVYRDLSSFIGSGVYPDLSSLTGSGVYPDLSSFTGSGVYPDLSSFTGSGIIQTFVACVKRSAPKDSHQKVSALILLAEKTLPNLGEKICLMRD

SEQ ID NO: 106257 - protein, 152 aa, Glycine max
  Coding DNA Sequence Number=SeqID_14572
MKLLDSAYSHSHWQERPRWFHSFKGNSLKTWGEVVEKFLKKYFIESKTMEGKATICSFHQFPDESLSEALERLQVVPFVVRLMKQASVFPLKKTLKKFIIWEIKSDKGQWRSHPSNQFNKDQGGPSNRPIQQGPNIFQRTTKLEETLNQFLQ

SEQ ID NO: 106258 - protein, 109 aa, Glycine max
  Coding DNA Sequence Number=SeqID_14573
MSVCNFGLYGPDHIYSPHGKGPRCGQYIQRQGRSVDIVYKRLAFVTLPYMEATIALHGEPIIARPQDLPSHGVPVSVRTEKALMDLPQHALSFLSVHASEQNHVMVSLV

SEQ ID NO: 106259 - protein, 64 aa, Glycine max
  Coding DNA Sequence Number=SeqID_14574
MSSNFLNSCHDCLKSLSHKYIKLMVMQSYPARALGRRLQVDWARDPREGPKVLMSLRVDFEPMG

SEQ ID NO: 106260 - protein, 238 aa, Glycine max
  Coding DNA Sequence Number=SeqID_14575
  Gene Ontology: Biological process=transposition, DNA-mediated
  Homolog annotation: Hit_ID=Q1J7G7; Match level="QueryCoverage=17%, HitCoverage=71%, E-value=7e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSISCDPPALASQSAEITGVSHRAHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 106261 - protein, 144 aa, Glycine max
  Coding DNA Sequence Number=SeqID_14576
KFSIDKCTVSLELDRVGLDNCSARQSVQGSLSSILGSFPFHYLLDDPVHLPVDFAPTQTRSIPRGGNKKRNAERNIKFLQDIKAAAIQEEPLSSEASSSFPKQRESHTVLIEANIMADEPRRVTLEDYSSTFVPQFFTSIVWLE

SEQ ID NO: 106262 - protein, 150 aa, Glycine max
  Coding DNA Sequence Number=SeqID_14577
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=56%, HitCoverage=72%, E-value=3e-24, Identity=69%"; Hit description=LacZ protein
  Subcellular localization annotation: CTP_CleavageSite=44; ConfidenceScore=5.43e-01
MTMITPSSKLTLTKGNKSWYRAPPRVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106263 - protein, 123 aa, Glycine max
  Coding DNA Sequence Number=SeqID_14578
MKREKQASYSNHNSCKSLSEELHDYYEERHRSHLRPHSHRREKERKPHEANINLSYFHGKDNVEANLYWEIRIEQQLKRNSISKSYGSNSYPKKDQGQGILGVTPSKPKDYKGKTIEKQPLKA

SEQ ID NO: 106264 - protein, 160 aa, Glycine max
  Coding DNA Sequence Number=SeqID_14579
  Homolog annotation: Hit_ID=Q6UUU1; Match level="QueryCoverage=59%, HitCoverage=69%, E-value=3e-23, Identity=62%"; Hit description =Putative uncharacterized protein
  Subcellular localization annotation: CTP_CleavageSite=67; ConfidenceScore=5.01e-01
MVKVGTSYVPINVSFSPKVGPGLPVRWVEAARKRDQAYRYRRPRGGARIYSASSLTDSLRSVVRLRRAEMAYERGGDFLEDARKILNREVRGPRQSRFSIGSAPLTSITKSDAQISGGETRQDYKDTRRFPLALPRALSVLPFGLPVSSAVWPRLSHSTA

SEQ ID NO: 106265 - protein, 174 aa, Glycine max
  Coding DNA Sequence Number=SeqID_14580
MASMMEAMLGMRQLMEKNVATAAAVSSTTEVDPTLLATAHHPPSNTVGRERSTLGHNSNPHLGYNRVAYPYGLPPNYMPPVMHDDAGHVSSPILEGEPPQQPDEVHEDHQEYAQGDVDFYPPIPIEGPAPNTLPQPNLTVHPIFLSTEGPPPAAEERRKLDLFEERLRVVEDTI

SEQ ID NO: 106266 - protein, 131 aa, Glycine max
  Coding DNA Sequence Number=SeqID_14581
MGSKSTLRLIRTLGPSLGSLAQSTWSLLPNALVGLDNYVKGIINSALKGLDDTPQPKSKVGARWIVVKCNRQKGSTECGYYVIYWMSTIILGSFRNNWETYFNDVRPLEAERLKALRIQWAQHYLKVRNQT

SEQ ID NO: 106267 - protein, 75 aa, Glycine max
  Coding DNA Sequence Number=SeqID_14582
MKQKGKRKKDREGRHVIVKKYKSFVKSKPMTNFARCFQIVIVTRALWSDMGVRPETDTLTPKFVLPQNIKIGFPR

SEQ ID NO: 106268 - protein, 198 aa, Glycine max
  Coding DNA Sequence Number=SeqID_14583
  Gene Ontology: Mol. function=aspartic-type endopeptidase activity; Cellular component=intracellular; Biological process=RNA-dependent DNA replication
  Homolog annotation: Hit_ID=Q6WAY3; Match level="QueryCoverage=88%, HitCoverage=10%, E-value=1e-19, Identity=34%"; Hit description =Gag/pol polyprotein
QSEFKVIEQLNKTPARVSLLELLMSSEPHRALLVKVLNEAHVAQVHLGRRFREGWLYTYQSSVWTHIVAKVLIDNGSSLNVMPKSTLEKFTIQCFPLKAEFNGGSSLRRHSPRVGVVPSTLHQKLKFVVEGHLVIVSGEEDILVSCPSSMPYVEAAEESLETAFQSFEVVSISSVDSFSGQPCLSDAAVMMARVMLGN

SEQ ID NO: 106269 - protein, 158 aa, Glycine max
  Coding DNA Sequence Number=SeqID_14584
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=4e-25, Identity=55%"; Hit description =Putative uncharacterized protein
MTMITPSSKLTLTKGNKSWKRPFIEKPCYLEACRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106270 - protein, 49 aa, Glycine max
  Coding DNA Sequence Number=SeqID_14585
VSVPFDERVDAILPKKGPVTRAMSKRLQEDWARAAEEGPRVLMNLRVDF

SEQ ID NO: 106271 - protein, 293 aa, Glycine max
  Coding DNA Sequence Number=SeqID_14586
MASMMDAMLGMRQLMENNVATAAAVSSAAEANLTLPATVHHPLPNVVGRERSTLGHLSNPHLGYNRVAYPYKLPPNYTPPVMRDDADHVPSPILEGEPPRQSDEVHEDRREYAQGDIDFYPGVPVEGLVPNTLPQPNLTGEPRSLPAQPVLLPAEGPPPAAEENRKLDLIKERLRTVKGFGDYPFADLCLVPDVVIPPKFKTSHGTHQYAQHHPSFSAHAGDSSNSTPVQARASAPIQRETPQATAPTPTRSAGNAHFGAGSNAIRNFPPRPIQDFTPIPMTYEDLLPSLVAN

SEQ ID NO: 106272 - protein, 182 aa, Glycine max
  Coding DNA Sequence Number=SeqID_14587
  Subcellular localization annotation: CTP_CleavageSite=26; ConfidenceScore=5.30e-01
DHGFSTYLPSSSSSCSFRRISFAVCREATRKALCLRSLSTRPPGAERPMVHVDPATGKADGPHKKKLRTFLGIVAEFEIPEASDSRTKRKLLQTALAADQDGVEDTVCEKYDINKEKWLQFCQTRKDPSWEDVCKKAQAIQKQNTTPHVLSREGYEYLEQRLLIEKTKKKLEEAAQSRSVDG

SEQ ID NO: 106273 - protein, 171 aa, Glycine max
  Coding DNA Sequence Number=SeqID_14588
KRGHNSGMTPVNRKAGTGERTREPPGGNAWGAEPMEKRLCRGPLTSRVKYLRKSSSGNLTHQFRPELSNSPYSESYYNSAGRQLFCHEAFDWNTLASVTPTLMPPDRSNGKARPVAATQLSAAGGGGTADETRYAIAQINPHYKGTKASGPPPRSTVSNKLDVIGKGLQIP

SEQ ID NO: 106274 - protein, 258 aa, Glycine max
  Coding DNA Sequence Number=SeqID_14589
  Gene Ontology: Mol. function=glutathione-disulfide reductase activity; Cellular component=membrane fraction; Biological process =glutathione metabolic process
  Homolog annotation: Hit_ID=A8GL16; Match level="QueryCoverage=42%, HitCoverage=38%, E-value=2e-55, Identity=93%"; Hit description =Putative uncharacterized protein
  Pfam annotation: Domain name=DUF519; Domain location=1-111; Score =26.3; E_value=3.7e-12; Accession=PF04378.4; Description=Protein of unknown function (DUF519)
MKTDYQDVVKGIQEGYKRFATGTYALWYPVVMRQQIKRMLRDLEATGIRRILQIELAVKPDSDQRGMTASGMIVINPPWKLEQQMKNVLPWLHKVLVPSGIGHHLVNWVGAVRRALRPPIAAIDAIFATNPGQALNSYPLQIHNSWKSQMTKHYDYLAIGGGSGGIASINRAAMYGQKCALIEAKELGGTCVNVGCVPKKVMWHAAQIAEAIHQYGPDYGFDTTVNAFDWKKLVANRTAYIDRIHNSYDNVLGKNKVD

SEQ ID NO: 106275 - protein, 185 aa, Glycine max
  Coding DNA Sequence Number=SeqID_14590
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=46%, HitCoverage=73%, E-value=2e-24, Identity=70%"; Hit description=LacZ protein
MKHFTDTLISANIGTKAGTGPPLEVDGIDKLDLRLLGSSNSPALASRIAGTTGTCHHARLISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106276 - protein, 78 aa, Glycine max
  Coding DNA Sequence Number=SeqID_14591
  Subcellular localization annotation: CTP_CleavageSite=39; ConfidenceScore=5.13e-01
MPCTTVSFLCKIPLRSRQHRDPSSTMDVRMFSPLLLDVQSTLDVSVLLQPVSPSSNTSNQLHGRPAALPHWLLKNCSS

SEQ ID NO: 106277 - protein, 100 aa, Glycine max
  Coding DNA Sequence Number=SeqID_14592
MPLRGRIVSLGHIIGRGVGRGDCDDSDDAPKRRRPTASARRQRVPMIVAQDEPMVPAPDVEADVFPVDPMALADVEDTRADIPADTGTQVAEDEHEGFPG

SEQ ID NO: 106278 - protein, 140 aa, Glycine max
  Coding DNA Sequence Number=SeqID_14593
MRLPEQRTIFLIKLDRYRHSRFWAKASGSSGVSCVYQLFPVQLLTGIGYPLTIRTQAYRAGSISAASVKPGVPNDADANSPHPPLIACRYRAARFPCQGTCRANCINGIGHAIGGGRSSRITPAGVKADVLHTGDYMLGN

SEQ ID NO: 106279 - protein, 117 aa, Glycine max
  Coding DNA Sequence Number=SeqID_14594
  Subcellular localization annotation: CTP_CleavageSite=31; ConfidenceScore=5.13e-01
MVKVGTSYVPINVSLSIRQKLAQGFPLSSCSATEIRGGIRVTIRHTSTTAGSISAGKCSLGCQDAAANSPHPPRLIACRYRARPHFAMSGKPAATALNESANAIGARRLLRYYASWR

SEQ ID NO: 106280 - protein, 43 aa, Glycine max
  Coding DNA Sequence Number=SeqID_14595
MPQNVLYDAIGIYQRCCPSCSATDGVVSVNGTKHTSRNISGQV

SEQ ID NO: 106281 - protein, 82 aa, Glycine max
  Coding DNA Sequence Number=SeqID_14596
MASSSSCNLLQKESFQQAHTPVYEGLQSDSKKPLYAGCNNSLTLLSVVLSLYFNDPKPLELERLKALQIQGAQYYLRVRAQS

SEQ ID NO: 106282 - protein, 250 aa, Glycine max
  Coding DNA Sequence Number=SeqID_14597
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPAGGLLALGRAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106283 - protein, 35 aa, Glycine max
  Coding DNA Sequence Number=SeqID_14598
MSCLATTTLTSLCVWRLPGTLWTRRSPTGPWGFRL

SEQ ID NO: 106284 - protein, 105 aa, Glycine max
  Coding DNA Sequence Number=SeqID_14599
  Homolog annotation: Hit_ID=A0ST23; Match level="QueryCoverage=23%, HitCoverage=51%, E-value=3e-07, Identity=100%"; Hit description =Putative reverse transcriptase
  Subcellular localization annotation: CTP_CleavageSite=24; ConfidenceScore=5.22e-01
MSYRNLHTSSLTTSNQAYRYRRPRGGARYQLLFPLVRVNFELGVIMVIAVSFGKPVVPAALMNRPTRGERRFAYWALAECILAYYVGTDEGVSEVLHVAGEKGCT

SEQ ID NO: 106285 - protein, 66 aa, Glycine max
  Coding DNA Sequence Number=SeqID_14600
  Subcellular localization annotation: CTP_CleavageSite=46; ConfidenceScore=5.61e-01
MTPGGGAYGKTALPRPSHFPVKYLPRSSRNLRNPNSTPFRPQIEFRARARIQVLSEPPTAGLQFAL

SEQ ID NO: 106286 - protein, 258 aa, Glycine max
  Coding DNA Sequence Number=SeqID_14601
ERSGYRYIEQLTEMPQNVLYDAIGIYQRWSPITGTYCAIPCARGDAPKLTDLVYDGVFRGAPVAYHGFYQLFPPVQLLKVGTLSPFAAFNDRCATLREGRSVRAFAYYASWRKGRMCAYWRLLCWVTVPGCSSQNAFVEKKSCTVRQHEYVMTHYRANMELPRLAARSRTGLATLGLQEFDDRGAEIPACTAPNAGGDFLEDARKILNREAFPPGGSLVRSPVPAFRFTGVIPLLWPRLSHSTPDTQFPGRQFAPSWT

SEQ ID NO: 106287 - protein, 159 aa, Glycine max
  Coding DNA Sequence Number=SeqID_14602
MGVKFLEAVKRRLHAIKQWSPGEIRVDSGGDGGASATCGWPSLGCCGASPYAYMVVQYFSDVAEQQRHPYLGQGGHASAHDPHPSPCSNLGEILPWNAQKLSNGLLIKTRDLTPPLAEFILLTLFQNQRVAQELAKGVCIQGDPLAPCSFAGKYTGSRN

SEQ ID NO: 106288 - protein, 72 aa, Glycine max
  Coding DNA Sequence Number=SeqID_14603
MSGEILTAIRRHCGTGDKASLVRDEKQDATRDLLRFPKPSDGDLWHDPLGQNLLRDRSHHFRADIAGADGVD

SEQ ID NO: 106289 - protein, 130 aa, Glycine max
  Coding DNA Sequence Number=SeqID_14604
MHKALRLNAPLPYPHLVTLFLQHFNIPLDSEPYVPIKRSFLVGAVVVASFGYRKERDGSWVKKGTQPNDDEGQLTVEGDSSLLQSILDRFDALEQQVDMQFDAMDSRITKVEEDVTIIRDCLNLPPPPSV

SEQ ID NO: 106290 - protein, 134 aa, Glycine max
  Coding DNA Sequence Number=SeqID_14605
MERSMIDAASGGALGDMTPAEAMNLIEKMASNSQQFSAMLYLLVGLLWRLDLRASMRSFNGDFPPWRCNGRQRRRGEKRRHPQGNKPWKKELHHQDEPWIRSLEMMLQWRKRKRERKREGSMKLKEEKGREVEL

SEQ ID NO: 106291 - protein, 123 aa, Glycine max
  Coding DNA Sequence Number=SeqID_14606
RATASPDDESERSAIPPIGEVGGSAVSSAGESGGAAASSDDASEMIIRGGDGGTSSNTGEGGGFTTGDHGSAGIGSTRAVELQAMLPAQENAPKGLMFVSVGDLVLWQLTEELGWMMKGCHRF

SEQ ID NO: 106292 - protein, 92 aa, Glycine max
  Coding DNA Sequence Number=SeqID_14607
  Homolog annotation: Hit_ID=Q6UUU1; Match level="QueryCoverage=93%, HitCoverage=58%, E-value=1e-28, Identity=75%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVYSAVMAAFVSFHA

SEQ ID NO: 106293 - protein, 77 aa, Glycine max
  Coding DNA Sequence Number=SeqID_14608
AVDALDFLEGDEDPPLEVDSPEDVMSAFEADSTEESGPGEMATKFDDCIHVAEATTVDTLAQDDTMYFAKLPYFGQL

SEQ ID NO: 106294 - protein, 342 aa, Glycine max
  Coding DNA Sequence Number=SeqID_14609
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=ATP synthesis coupled proton transport
  Homolog annotation: Hit_ID=P12862; Match level="QueryCoverage=73%, HitCoverage=49%, E-value=1e-119, Identity=91%"; Hit description=ATP synthase subunit alpha, mitochondrial
  Pfam annotation: Domain name=ATP-synt_ab; Domain location=208-342; Score=12.0; E_value=7.6e-09; Accession=PF00006.16; Description=ATP synthase alphabeta family, nucleotide-binding domain
  Pfam annotation: Domain name=ATP-synt_ab_N; Domain location=84-152; Score=90.2; E_value=6.3e-24; Accession=PF02874.14; Description=ATP synthase alphabeta family, beta-barrel domain
  Pfam annotation: Domain name=Complex1_49kDa; Domain location=1-87; Score=-137.0; E_value=0.0023; Accession=PF00346.10; Description =Respiratory-chain NADH dehydrogenase,
  Pfam annotation: Domain name=HAS-barrel; Domain location=84-150; Score=46.4; E_value=9.7e-11; Accession=PF09378.1; Description=HAS barrel domain
  Pfam module annotation: Pfam domain module=ATP-synt_ab::ATP-synt_ab _N::Complex1_49kDa::HAS-barrel; Domain location=208-342::84-152::1 -87::84-150
MTTGSSVYSTSIHHFELYTEGFSVPAPSTYTAVEAPKGEFGVFLVSNGSNRPYRRKIRAPGSAHSQGLDSLSKHHMPADVVTIIVDEIGRVVSVGDGIARVYGLNEIQAGEMVEFASGVKGIALNLENENVGIVVFGSDTAIKEGDLVKRTGSIVDVPAGKAMLGRVVDALGVPIDGRGALSDHERRRVEVKAPGIIERKSVHEPMQTGLKAVDSLVPIGRGQRELIIGDRQTGKTAIAIDTILNQKQMNSRATSESETLYCVYVAIGQKRSTVAQLVQILSEANALEYSILVAATASDPAPLQFLAPYSGPWHIDKCHYCYAEHQAVRLSQAMFSIYIPVS

SEQ ID NO: 106295 - protein, 124 aa, Glycine max
  Coding DNA Sequence Number=SeqID_14610
GVVLAEVLLADSRFTRPDMGFHPTKLNFVPSDADEAPLDVSICLHAFGIVGCGSFSGVKSCEREDPFHPGLFVGDAGGFQVSHVNHVSLNVGGLVPPHCSLKSVVSDDACPGACFVQRDATTLS

SEQ ID NO: 106296 - protein, 107 aa, Glycine max
  Coding DNA Sequence Number=SeqID_14611
MAANDYVILRDQEPSPQEESTRLEELLVQFMQETRSHQKSTDAAIRNLEVQLAKLVPERPTETFAVNTKMKPKKECKVFPVYMSFMASLAKRRKCKEDVFYVTFMPP

SEQ ID NO: 106297 - protein, 68 aa, Glycine max
  Coding DNA Sequence Number=SeqID_14612
  Subcellular localization annotation: CTP_CleavageSite=48; ConfidenceScore=5.47e-01
MGQLATQLNQQQSQNSDRLPSQSVQNPKNVSVIALRSGKQCQGPQPVSANEPAQLHSTPEKDDDKNLK

SEQ ID NO: 106298 - protein, 152 aa, Glycine max
  Coding DNA Sequence Number=SeqID_14613
MAYERGGDFLEDARKILNREAFPPGGSLVRSPVPAFRFTGVIPLLWPRLSHSTPDTQFRVGSSLQAGLYARTPRSVRPLRLIRHALVKAKLKGQVLVTALLQAQLPRFKELVAQRTFEKPPCKAVFSFSEQEITRRPKRSQEDHLINQIKYF

SEQ ID NO: 106299 - protein, 200 aa, Glycine max
  Coding DNA Sequence Number=SeqID_14614
  Homolog annotation: Hit_ID=Q6WAY6; Match level="QueryCoverage=22%, HitCoverage=7%, E-value=2e-08, Identity=59%"; Hit description =Putative uncharacterized protein
  Subcellular localization annotation: CTP_CleavageSite=29; ConfidenceScore=5.02e-01
MEGLVDLTSIDAFLAFHHARKARSSRFFPCMTRSTGDVKRAAQELFVVHWLSMCGWFHTFFSKKEGRIRILSSCEGCPNVPLMGTRGCINYNPVLSIRQLDYPMRGVPSDESITPFIARGFSDHNARDRELRGSSNGIIGGYHKWLRIRTQGLDWLPNLKTVRDNEVKASEESDEVQALKAKLERARVVKEKFKSIAIKV

SEQ ID NO: 106300 - protein, 102 aa, Glycine max
  Coding DNA Sequence Number=SeqID_14615
  Gene Ontology: Mol. function=nucleic acid binding
  Homolog annotation: Hit_ID=A5C3F7; Match level="QueryCoverage=61%, HitCoverage=6%, E-value=5e-13, Identity=55%"; Hit description =Putative uncharacterized protein
MEKSEKKNHSEKKLKKAYITWDENDLESSEDSENEEINLCLMAKSYESDEEVSLRKKWYIDSGCSKHMTGDASNFTHISPKKSGHVTYGDNNKGRILGVGKI

SEQ ID NO: 106301 - protein, 70 aa, Glycine max
  Coding DNA Sequence Number=SeqID_14616
MALIRSKTKRISSVHNEDDILTSVSDIEHEVMQSYPARALDRRLQVDWAKDAKESLRVLMNLRVDFGPMG

SEQ ID NO: 106302 - protein, 121 aa, Glycine max
  Coding DNA Sequence Number=SeqID_14617
MWMLVVMKREMLVVVKRKMMVVESKVLMWTLVVVKRNILVVVATYPSAGGRRETRGMRVPQKEYARSRHQRLFEENVGKTGKDAIYELLSERFGSCIYARGRVFPFAPTYSSIWDEKIRPT

SEQ ID NO: 106303 - protein, 106 aa, Glycine max
  Coding DNA Sequence Number=SeqID_14618
MYKDDWTQLWPMGSEIYPEVHDNPRAFFSRSSPILLEPLAHGSSDCPFAKLKPRAKRIIVHVLSRYSKALRDKPWHLRLIWSAKLAKVELRQFQLDLNSAKQRSNR

SEQ ID NO: 106304 - protein, 314 aa, Glycine max
  Coding DNA Sequence Number=SeqID_14619
  Homolog annotation: Hit_ID=UPI00006A2D9E; Match level="QueryCoverage =55%, HitCoverage=100%, E-value=5e-10, Identity=16%"; Hit description= UPI00006A2D9E related cluster
DYTSSPSEGLHASPSKGYTPWPALAFRGLHALAFKGLHALTFRGLHVLHFRGLHVLAFKGLYILAFRGLHALAFGGLHVLAFRGLHALAFRGLHVLTFRGLHALAIRGLHALAFRGLHVLAFRGLHALAFRGLHALASEGYTSSPSEGYTSSSLEDYTSSPLEGYTPSPLEDYTSSNSEGYTSTSRHPVFAGIAPTRHPVDSEEPNRSLGFLALVMGLCQSYKMPVPPARSCHRDIVSVAPSKVIKPPTNRAFIKKYCAPRQAQGETPQQLGDGRQRAIDASPPPPEPLSSSTKAGALPTTRGRPSGDQVQSQR

SEQ ID NO: 106305 - protein, 149 aa, Glycine max
  Coding DNA Sequence Number=SeqID_14620
RARARARTRPTELPSTSAAPTPAFTSAAPSVLVQIDSQCFEAMLQSIHQGHIILLQSLQVVAPPGSIPSFEQFLERVSWLGAQPSLHREDEGPTAQHAADPSTPILEIPKDLTTPVLTLNTSPPATPVLHLTNEEGDQTQDTQDQSQEF

SEQ ID NO: 106306 - protein, 91 aa, Glycine max
  Coding DNA Sequence Number=SeqID_14621
MTHYAHSVGILRRMKHINRGSTFPSMRSVCLVEFVLTDGEVGGWPSHGQCGSTGIKSSSQMKLLMNFEKDFAFTYSYWSSNIASGFVFSGG

SEQ ID NO: 106307 - protein, 136 aa, Glycine max
  Coding DNA Sequence Number=SeqID_14622
MSLPNAVHVSSIIKRGASGDWEICSSVVFRIGSFAKHKKKEGVETRVVITERAGRTKSVTYLCFPLISDERYLVPYVAQYVKSRDVPKIKRKQAYAIRENSVMGVQIAIRPAWPSRFFLQKAVASRGSNIARLGEL

SEQ ID NO: 106308 - protein, 466 aa, Glycine max
  Coding DNA Sequence Number=SeqID_14623
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=47%, E-value=0.0, Identity=91%"; Hit description=DNA -directed RNA polymerase subunit beta
  Pfam annotation: Domain name=RNA_pol_Rpb2_6; Domain location=48-456; Score=579.5; E_value=3.4e-171; Accession=PF00562.19; Description=RNA polymerase Rpb2, domain 6
MVATGNSLALNRDIQEEQTVPARYRQEFLTIAWEQVHLRSIFPFQYFSIGASLIPEHNDANRALMSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGLAGGMLERHYRITPFDERYEQEASRKLVFSELYEASKQTSNPWIFEPEYPGKSKIFDGRTGNSFKQPAIMGKPYILKLIHQVDDKIHGRSSGHYALVTQQPLRGRAKQGGQRVGEME

SEQ ID NO: 106309 - protein, 114 aa, Glycine max
  Coding DNA Sequence Number=SeqID_14624
MTRCATVVREGRSVRYQLTSLIRLSSWQNQGDERKAIKNVRQKASKRPVRPRLRPRHIQGQKSTLKSEVAKPDRTIKIPGVSPWKLPRALSCSDPAAYRIPVRLSPFGKRGAFS

SEQ ID NO: 106310 - protein, 106 aa, Glycine max
  Coding DNA Sequence Number=SeqID_14625
MFDTVKTTSSQARPVFTHAIRKADSVVTHSDLRGVHIYQQGPSVRTMTLGLIMELSIGSDLACWSIADYKTAGPHTVLYHVSYSLLDNPVAHEITIELNAKEEGAL

SEQ ID NO: 106311 - protein, 609 aa, Glycine max
  Coding DNA Sequence Number=SeqID_14626
  Gene Ontology: Mol. function=metalloendopeptidase activity; Cellular component=outer membrane-bounded periplasmic space; Biological process=cell wall catabolic process
  Homolog annotation: Hit_ID=P0AFT0; Match level="QueryCoverage=62%, HitCoverage=86%, E-value=1e-159, Identity=73%"; Hit description =Uncharacterized metalloprotease yebA precursor
  Pfam annotation: Domain name=LysM; Domain location=324-368; Score =21.0; E_value=0.0038; Accession=PF01476.11; Description=LysM domain
  Pfam annotation: Domain name=OapA; Domain location=320-402; Score =17.5; E_value=1.1e-05; Accession=PF04225.3; Description=Opacity -associated protein A
  Pfam annotation: Domain name=OapA_N; Domain location=234-264; Score =34.9; E_value=3e-07; Accession=PF08525.2; Description=Opacity -associated protein A N-terminal
  Pfam annotation: Domain name=Peptidase_M23; Domain location=538-609; Score=75.1; E_value=2.3e-19; Accession=PF01551.13; Description =Peptidase family M23
  Pfam annotation: Domain name=SBP_bac_9; Domain location=10-233; Score= -39.0; E_value=7.7e-08; Accession=PF01297.8; Description=Periplasmic solute binding protein family
  Pfam module annotation: Pfam domain module=LysM::OapA::OapA _N::Peptidase_M23::SBP_bac_9; Domain location=324-368::320-402::234 -264::538-609::10-233
VWTGPEKEAFLSRSAGELPASKNLEIAALPGVKPLLISGGEDEDEHEHGHDHDHDSDNSENQDPSHTHHHHGEFNMHLWMSPEIAKQSAVAIHGKLLELMPQSKAKLDANLQQFEAQLADTDKRIGAQLAPVRNKGYFVFHDAYSYFEKHYGLSPLGHFTVNPEIQPGAQRLHQIRTQLVEQKAVCVFAEPQFRPAVIDAVSRGTSVRKGTLDPLGMGISLTKDSYQIARSVALAFNNLPRPHRVMLGSLTVVTLAVAVWRPYVYHPRDVAPIVKDITLDKNELRTLLPEASEPIDQTTAEPEDEIPSDDIDKDVPVNPDQHDYTVSSGDTLSSALNQYGIDLGDINALVSSDKSLRNLRVGQQLSWTLDADGALQDFTWEIDRRETRTYARQPNGSFKMQQEMQKGEWQNSVLKGEVRGSFAASAQRAGLTSAETSSVIKAMQWQMDFRKLRAGDDFSVLMSREMLDGKSAQSQLLGVRLRTGGKDYYAFRAEDGKFYDRNGSGLARGFMRFPTVKQYRVSSNFNPRRLNPVTGRIAPHKGVDFALPIGTPVLAVGDGEVVIAKNGGAAGNYVAIRHGRQYMTRYMHLSKALVKPGQKVKRGDRIALS

SEQ ID NO: 106312 - protein, 84 aa, Glycine max
  Coding DNA Sequence Number=SeqID_14627
MTTYSPPLLYVPMDSDIGPFFNSPKPTKEEVIILHEIRRPNSLKTVPNGVANYHNLPFGGRATRGLTGASSMKGKCAESPPSFI

SEQ ID NO: 106313 - protein, 37 aa, Glycine max
  Coding DNA Sequence Number=SeqID_14628
MGRPVKVITLFCENAPTIWDRHGLKGAPKPGVFTPMA

SEQ ID NO: 106314 - protein, 119 aa, Glycine max
  Coding DNA Sequence Number=SeqID_14629
MAQLVSDAIYYLQGSCPQDTQWTRRSPTRPWGSSSDYGPLSVLRSDHHFDLSLPKDRAYKTLSEPGEVQQGLGVSNSDYEPPSVLRSARHPQQGHQAPINRAFIEKYCDPRQAQGEASQ

SEQ ID NO: 106315 - protein, 130 aa, Glycine max
  Coding DNA Sequence Number=SeqID_14630
  Subcellular localization annotation: CTP_CleavageSite=81; ConfidenceScore=5.70e-01
MNFYRKFSMPPKVSGSSGRGGRTSSNRKDVLLALPEPVTKKTTASSSGSPTQTGSSTQKGKFEGSLTQIESPKPTTKKQTVADYAWSIQTLLALEDIGLTKLPKLAKKTWTEMASESDDDSEIDLQKQIQ

SEQ ID NO: 106316 - protein, 120 aa, Glycine max
  Coding DNA Sequence Number=SeqID_14631
MRDGKKTSYVIGIEVNSGVGLGGKFLIALESAPKWALLAGRVGVGAGAWGASLWMGAGALGCTGAELEESSARAEKLGYFDPPSVGTCGGDVSTIMVIISLLTMGGATWAASPSNAEHTP

SEQ ID NO: 106317 - protein, 101 aa, Glycine max
  Coding DNA Sequence Number=SeqID_14632
RGRDQKRMGMEKGERSENEDGMAMGKEEMGKPGQDTWREGQNNGKRKRNKSKHGHNTWIEAGKIIKPKKRQKPKLFDEYEILIMNQKIKPGLVEFPDKNCT

SEQ ID NO: 106318 - protein, 172 aa, Glycine max
  Coding DNA Sequence Number=SeqID_14633
MAMGDFISRLSFPENTETFPSLTSYPELRRSEFLIGGYVGAKALLLSTTLLSVTMTQELVARGDTLQLSAPLCHPEAAGLMTRGDTLRLSAPFCHPEAVGLMTRRDKIWSFCTLVSSRGGGPDDMRRYLTVIRTLLSSRGGGPDDTQRQNLVIMHPCVIQRRRARWHTEIPY

SEQ ID NO: 106319 - protein, 76 aa, Glycine max
  Coding DNA Sequence Number=SeqID_14634
MELRKKVEKWRIGEQRDAITSRGSRLCRMPAGRLEDPNIHGAPKKSGEWRIGEQRDAITSRGSGLVGGGCMNNTRQ

SEQ ID NO: 106320 - protein, 194 aa, Glycine max
  Coding DNA Sequence Number=SeqID_14635
MVTPPDSIPLVEQFNEWVAWPETQSSLHKEDKGPQPRSHSLGTTADGGKKANQTQEAAATSEKSLEATSEPSKPVADTASLLQATDPSTPEDQTTPVLSPNTSPTATPELHLTDEEDIITKDDDKGDDKKLKGQSKNEFKIESRTLQDSRGKLISRINNQDSRDQDFKNQDSRDQDSRLKIQELREGLVKISMK

SEQ ID NO: 106321 - protein, 199 aa, Glycine max
  Coding DNA Sequence Number=SeqID_14636
MKLYFYKIVLEFYANAWPTKEGVRDMHSWVRGQWIPFDADALSQFLGDSLVLEEGHQCEFGKRRNRADEFNEEAIAQLLCTPDERPRGPSMPPTRHPLDSDKSNRALGFPPLITGLCQSFGVPVTPSKVIRPPITRAFIEKYYTPRQVQGDAHHAADAPPPPHQADPAGSLGMERYLQHLVCQEAANHRGQVQIHECLY

SEQ ID NO: 106322 - protein, 128 aa, Glycine max
  Coding DNA Sequence Number=SeqID_14637
  Homolog annotation: Hit_ID=B0HC01; Match level="QueryCoverage=25%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTLTQLQQRLTRKRLGRRGIL

SEQ ID NO: 106323 - protein, 153 aa, Glycine max
  Coding DNA Sequence Number=SeqID_14638
MLVATPRIFLSWKTHMRAPRRPPAEGQLSPMVEEFEEILGCRLGGRKPYLFSGFYPSLARISKIVQISAQELDHRKQVKNGVVGVPRKCLEAKARILAGRGEWAPFIDILALLIFGGFLFPNVDGLVDLAAIDAFLAFHDRMESSVVAILADL

SEQ ID NO: 106324 - protein, 324 aa, Glycine max
  Coding DNA Sequence Number=SeqID_14639
  Homolog annotation: Hit_ID=A7UQU7; Match level="QueryCoverage=50%, HitCoverage=28%, E-value=1e-19, Identity=35%"; Hit description=IMP dehydrogenase/GMP reductase, putative
MYQSRCRARQWVAAARMYLLHLAFRDLGQVGAFSWGVAALVHLYDQLNEALHAPTRQMAGYISLLQCWIYEHFPSVHRSVVDDGYAEASPRPCRWLTGKAQMIGIKGAPYRARIDALTVTDVCWMPYAEHRGVRGYDLISSYTGQVRWGPIIVYLRPERVVRQMGYIQIIPPPPVRDSLTDHVAPTGELCVVPGQVAPDYMEWFFQISYPFVTSTEDTTEPRPAPPPPTDDDFVEPPVAEVLVASDPPTHSVVDCTTCVRMGRIAEHLERVINLRMVTAGTDLYDIMDLCLRIARDDDPDDSLRPRQRPHIYYDLSFLFICLCM

SEQ ID NO: 106325 - protein, 239 aa, Glycine max
  Coding DNA Sequence Number=SeqID_14640
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=66%, E-value=1e-33, Identity=100%"; Hit description=LacZ protein
MARERGGGGTATKGGAHQQDETNQIANPKTNNEKEEEREGGVKERRREKGREEREGMRGYLGDPSSFSSYSAKWRDATGIADLDDEASADLRTNPLQEEGDDAILPRKGPITRAMARRLQEDWARDAREGPRVLISLRKFKSPGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 106326 - protein, 150 aa, Glycine max
  Coding DNA Sequence Number=SeqID_14641
KKSRANGENEKEEGNHVRAAIPTWPNFPPAQQCHYSADVSPSHYPPPNHPQRPSLSQPQSLPTTQPMPNTTFSTNQNTNQGRNFTAKKPVEFTPILVSYADLLPYLLDNSMVAITLAKVPQPPFFRSYDLKQHVLIMEEFWGIPLSIVGP

SEQ ID NO: 106327 - protein, 111 aa, Glycine max
  Coding DNA Sequence Number=SeqID_14642
PSSLEKPLNRSSNNQNDVNPFAQGLRLDLQRAEWKGFGSKSECVWMENDEDNDGVQVGLKAGYIYLGLTENKRGYISCGLVLMEGTSTRFKENKGGYIPCGSLLVKGFLQG

SEQ ID NO: 106328 - protein, 128 aa, Glycine max
  Coding DNA Sequence Number=SeqID_14643
  Gene Ontology: Mol. function=nucleoside-triphosphatase activity; Cellular component=plasma membrane; Biological process=carbohydrate transport
  Homolog annotation: Hit_ID=A6WYT8; Match level="QueryCoverage=100%, HitCoverage=24%, E-value=3e-58, Identity=89%"; Hit description=ABC transporter related
  Pfam annotation: Domain name=ABC_tran; Domain location=3-100; Score= -2.3; E_value=1.2e-06; Accession=PF00005.18; Description=ABC transporter
MKIANSYREQMSIRCHNVYQETGTLSGGNQQKVVLSKWLFTGPDVLILDEPTRGIDVGAKYDIYTIINSLADSGKGVVVISSEMPELIGICDRIVVMHEGAFVGEVAGEEATQENIMRAIMQNKGKRP

SEQ ID NO: 106329 - protein, 53 aa, Glycine max
  Coding DNA Sequence Number=SeqID_14644
MVHARCLATMSASVQLLYVHFREGLPLVKGVCFRAPSFNQCNDQCKINSTLFD

SEQ ID NO: 106330 - protein, 94 aa, Glycine max
  Coding DNA Sequence Number=SeqID_14645
MDKHSKVRGQWIPYDIDAINQFLGNSLILEEWQQCEYIARRSRTTGFDEEAIASQAPNGPRKIQQGTGISCLNYRSLPVLWSTGHTNKTHPASD

SEQ ID NO: 106331 - protein, 157 aa, Glycine max
  Coding DNA Sequence Number=SeqID_14646
  Homolog annotation: Hit_ID=A6FJQ2; Match level="QueryCoverage=24%, HitCoverage=84%, E-value=3e-11, Identity=92%"; Hit description=50S ribosomal protein L5
AAPGDGHSLSVSGCREQTSPSGRVSGCWRMRKEKIPHQAPFAIQAAQLLGRAIGAGLFAITPAGERGMCCKAIKLGNARVFPLPEIATEKGDQCVATHRKSFWHCQCCLARLGNARESASDVKWGCCRQGWADQGEMAAAGTVAVAGRKMKQSLPEK

SEQ ID NO: 106332 - protein, 116 aa, Glycine max
  Coding DNA Sequence Number=SeqID_14647
  Homolog annotation: Hit_ID=A6FJQ2; Match level="QueryCoverage=32%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLAPSTMAGHDQQSTYINSAGVDVAENGGAEDGNQQSV

SEQ ID NO: 106333 - protein, 172 aa, Glycine max
  Coding DNA Sequence Number=SeqID_14648
  Homolog annotation: Hit_ID=Q0KIL1; Match level="QueryCoverage=49%, HitCoverage=9%, E-value=5e-07, Identity=37%"; Hit description =Gag/pol polyprotein, 3'-partial, putative
  Pfam annotation: Domain name=G-patch; Domain location=46-90; Score =22.1; E_value=0.00041; Accession=PF01585.14; Description=G-patch domain
MLVSCPSSAPYVEAAEESLETTFQSFEVVSCASVETSPLLPCLSNATLMVARVMLRHGYEPGMGLCKDSHGNADVVDIRGNPHKYGLGYEPGKPGRRNAPSRLRADRAWPGHVSQCFTSVRIMFEEEVADPNNEGLIIDFDREVSPTINEEEEEDVLSPEFERLIATGRSAK

SEQ ID NO: 106334 - protein, 129 aa, Glycine max
  Coding DNA Sequence Number=SeqID_14649
MFSKKEGMMRIMKLAKYRLKAQVEKDEGPSGEGQSPQVEKDEGPEAETLSRLLILNQSQTYQGNPCGVCPDLSSFTGSGVYPDLSSFTGSGVYPDLSSFTGSGVYPDLSSFTGSGVIQTFVACIKRSAP

SEQ ID NO: 106335 - protein, 124 aa, Glycine max
  Coding DNA Sequence Number=SeqID_14650
  Homolog annotation: Hit_ID=A6FJQ2; Match level="QueryCoverage=30%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVSQFGVGRSLQAGLCARTPRSARPLRLIGNYRLEVNP

SEQ ID NO: 106336 - protein, 184 aa, Glycine max
  Coding DNA Sequence Number=SeqID_14651
MAEKLLQQMMDLGRFEISDENKGEQHVCIQSANKESPRKPKPLVIHFTRDAASRGYRGLRPISGCKPILFPYGSNKMVPWKYAPQKPSKKKEKATSIDIPSAKVTNIIGLSGVTHSGRVFTAPDLSVRPTDAKGKVKVIVEETNEASPTLDEDVSARRFAEKRGDFGRKKVSMEEANEFLRIIQ

SEQ ID NO: 106337 - protein, 160 aa, Glycine max
  Coding DNA Sequence Number=SeqID_14652
MTGETAGRRTPPPHRRLRRRDPHPAGHTGLPPHRAGAVPGRLLHLRPAVHGAAAAARIQPPLRRVRRRQRDVAVADHRHAGGGHAAGRPAVRRGRPSPVDDRCAAGLGHAVAEHRAGGRLDHAAGAAHPARPGAERRAGGSDDLPGRGNGQPRAGPGDGP

SEQ ID NO: 106338 - protein, 108 aa, Glycine max
  Coding DNA Sequence Number=SeqID_14653
  Gene Ontology: Mol. function=RNA-directed DNA polymerase activity; Biological process=RNA-dependent DNA replication
  Homolog annotation: Hit_ID=A5AZG1; Match level="QueryCoverage=50%, HitCoverage=16%, E-value=8e-08, Identity=50%"; Hit description =Putative uncharacterized protein
MKRGKQVSYSSHDSGNSLSEELNDYYRGRHSSHTEHHSQRREKDRRPQEVNISLPYFHGKDNVEAYLDWEIKVAQLLACHHISEERKVPLATLSFQGYALLDKWPQLS

SEQ ID NO: 106339 - protein, 79 aa, Glycine max
  Coding DNA Sequence Number=SeqID_14654
  Subcellular localization annotation: CTP_CleavageSite=61; ConfidenceScore=5.09e-01
MARLGELAGKHLPYFAINRGGSEEEKGKSKPRRFRNVSVTFSVRNFAKVFDRSSTFFIVLRSSTGKYLEPSFSIHSMYS

SEQ ID NO: 106340 - protein, 100 aa, Glycine max
  Coding DNA Sequence Number=SeqID_14655
MGDQEETQEQMKVNMSALKEQMASMMEAMLGMRQLMEKNVATAAAVSSAAEADPTLQATAHHPPPNTLGRGTNTLGHNNNPHLGYNRAAYPYGLPPNTHC

SEQ ID NO: 106341 - protein, 207 aa, Glycine max
  Coding DNA Sequence Number=SeqID_14656
  Gene Ontology: Cellular component=integral to membrane; Biological process=conjugation
  Homolog annotation: Hit_ID=P54914; Match level="QueryCoverage=100%, HitCoverage=94%, E-value=1e-110, Identity=95%"; Hit description =Conjugal transfer protein trbF
  Pfam annotation: Domain name=TrbF; Domain location=2-207; Score =418.8; E_value=8.1e-123; Accession=PF04585.3; Description=Conjugal transfer protein
MAGQNVPDNPYIAARNEWNERYGSYVKAAAAWRVVGIAGMSMAVIGFGYALYQSTQVKLIPYIVEVDKLGTSVNAGFPQQIEYADPRVVRATLGSFVSNFRSVTPDAVVQKQYIDRTYGLLRTSDPATEKVNAWFRSNSPFEKAKTATVAIEVNNIVALSNQSYQIDWTEFERDRRGKETGTRRFRGIATVTLTPAQDEGVIRLNPI

SEQ ID NO: 106342 - protein, 95 aa, Glycine max
  Coding DNA Sequence Number=SeqID_14657
MSKYKVSILFFFYQAAVCRLSTTPEFDVRKIPVWGELEHGCQRGKGIGHLILLSRNVVKGYVIEVLYQFPDVGLVGYQLMIPDLPFPSQLVDYQG

SEQ ID NO: 106343 - protein, 97 aa, Glycine max
  Coding DNA Sequence Number=SeqID_14658
MEWNEMLSNGASGTFSGTFFPDFLALFDVETSSSTSSSESDEEISFLFYGRDCNFAPSGCGANLLAMGSSSDSTSSRSMRSPGADSGARGARVSSVA

SEQ ID NO: 106344 - protein, 161 aa, Glycine max
  Coding DNA Sequence Number=SeqID_14659
MEGEAPEEDKEVHAIKTELEKAQTVKEKFKSATVRIRKEDAELRDINIATTKALEQETKRPRKEEHGRNKLRGALWGSNSELKLRREERDQSRVDGLILKDELRVCLRSKRSLSQQLCEIETDMLAIISKYQEELNLAMTHEHKVADEYARVYAEKETRGR

SEQ ID NO: 106345 - protein, 106 aa, Glycine max
  Coding DNA Sequence Number=SeqID_14660
MPQHPIPLPAPLTIGVVQLPVDSKPQTSFPSHHILLSDLDLFPSVMFIAIATDMKLDHHFLPSVVTIDDAEWLHFCSTHLHSLIPSPILIWDPGSNFGAMVVAPTP

SEQ ID NO: 106346 - protein, 101 aa, Glycine max
  Coding DNA Sequence Number=SeqID_14661
  Gene Ontology: Mol. function=pyroglutamyl-peptidase I activity; Biological process=proteolysis
  Homolog annotation: Hit_ID=A7PRL3; Match level="QueryCoverage=41%, HitCoverage=19%, E-value=4e-10, Identity=71%"; Hit description =Chromosome chr14 scaffold_27, whole genome shotgun sequence
MYIVDEAKGVLRRYVEEQDAWEEILENHRLKGVEQIFAQRGKLCVILPSSGISVVDVAAKFHGVLENPTETIANNLTEYMNKKGLPKRLVIGSSSILETAG

SEQ ID NO: 106347 - protein, 134 aa, Glycine max
  Coding DNA Sequence Number=SeqID_14662
EAPQRQRPTTPIRRQREATLVTKDVHHVDDAADEVHEQPQEATVDDEVVDAQGFSGRPHDTSVLTVYVDHVAVIVWNGEECPELKLSSHERKVQKSGRPTTMIEKLVVVVGLSPIIACSLDTGDRGLISAFVER

SEQ ID NO: 106348 - protein, 205 aa, Glycine max
  Coding DNA Sequence Number=SeqID_14663
  Gene Ontology: Mol. function=beta-lactamase activity; Cellular component=integral to membrane; Biological process=beta-lactam antibiotic catabolic process
  Homolog annotation: Hit_ID=A6B9Y3; Match level="QueryCoverage=47%, HitCoverage=100%, E-value=4e-47, Identity=96%"; Hit description=Beta- lactamase TEM
MTMITNSSSVPIEHLAARLLRQAGLALQRARHGADGGSSRVDLQACKLGTGRRLQRRDWENPGVTQLNRLAAHPPFASWRNSEEARTDRPSQQLRSLNGEWRLMRKSMSIQHFRVALIPFFAAFCLPVFAHPETLVKVKDAEDQLGARVGYIELDLNSGKILESFRPEERFPMMSTFKVLLCGAVLSRIDAGQEATRSPHTLFSE

SEQ ID NO: 106349 - protein, 68 aa, Glycine max
  Coding DNA Sequence Number=SeqID_14664
  Homolog annotation: Hit_ID=A6FJQ2; Match level="QueryCoverage=55%, HitCoverage=84%, E-value=3e-11, Identity=92%"; Hit description=50S ribosomal protein L5
MQLPGDGHSLSMRKEKIPHQAPFAIQAAQLLGRAIGAGLFAITPAGERGMCCKAIKLGNARVFPVTTL

SEQ ID NO: 106350 - protein, 82 aa, Glycine max
  Coding DNA Sequence Number=SeqID_14665
RLTPELRNLQRELRESATLPEGRKADRYPVSGRVGTGERTRELPGGNAWGAEPMEKRQQRGLFTVPGLLLAFCSHVLSCVIP

SEQ ID NO: 106351 - protein, 111 aa, Glycine max
  Coding DNA Sequence Number=SeqID_14666
  Homolog annotation: Hit_ID=A6FJQ2; Match level="QueryCoverage=34%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPALRKLACQVIVRQVEHLKEACIAK

SEQ ID NO: 106352 - protein, 127 aa, Glycine max
  Coding DNA Sequence Number=SeqID_14667
  Homolog annotation: Hit_ID=A6FJQ2; Match level="QueryCoverage=29%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPQSGGCYFLHLQVASCTHFLAFGLMADFGF

SEQ ID NO: 106353 - protein, 127 aa, Glycine max
  Coding DNA Sequence Number=SeqID_14668
  Subcellular localization annotation: CTP_CleavageSite=59; ConfidenceScore=5.18e-01
KWFFRKHSGRKGSSGKVFRKSASSGILPDEPLLPESSRKRFSGSLPEEGFFRKTFGYFRKNTSSGNFPENVLPELPEEPLTVHNKTKAKKKATYLESKWVQGLSEKLAEKKLVGEERREEAFAEETQ

SEQ ID NO: 106354 - protein, 31 aa, Glycine max
  Coding DNA Sequence Number=SeqID_14669
MEIMTLPGSSFSSINQKQAQHGCQGFTIHEP

SEQ ID NO: 106355 - protein, 251 aa, Glycine max
  Coding DNA Sequence Number=SeqID_14670
  Homolog annotation: Hit_ID=UPI0000ECBAF8; Match level="QueryCoverage =16%, HitCoverage=48%, E-value=4e-16, Identity=100%"; Hit description= UPI0000ECBAF8 related cluster
ERTRELPGETPGIFIVLSVFATSDLSVDFCDARQGGGAYGKTPATRPFYADTARRSRTTERSESVSEEAEERPIRKPPLPAPDNNFTQETAMTMITNSSSVPGKQAVLRLTENQFAVEQHFTQDDIGFVRIKTRTNVSEQSILFFYVFNLELPAVMAGHGVTRIEHHAGYRGVIASVQAVFTGGREEEGNHTRIDGNDGMQAWHWPSFYNVVTGKTLALPNLIALQHIPLSPAGVIAKRPAPIALPNSCAA

SEQ ID NO: 106356 - protein, 109 aa, Glycine max
  Coding DNA Sequence Number=SeqID_14671
  Subcellular localization annotation: CTP_CleavageSite=11; ConfidenceScore=5.30e-01
MAQKKSTPITPATSRRSKHSPNSFLIQQILGQDATAFPWLPHQKITASVSPAVPSNLRTRKTAKQHPQPIRNSWSSFQQGTGSQKYAILHRIGAANVPTIYFHVATRLG

SEQ ID NO: 106357 - protein, 68 aa, Glycine max
  Coding DNA Sequence Number=SeqID_14672
  Homolog annotation: Hit_ID=A0ST23; Match level="QueryCoverage=66%, HitCoverage=91%, E-value=1e-11, Identity=73%"; Hit description =Putative reverse transcriptase
MEKSHLMDVGLKFLPQHFNSVVGTELEFVIMVIAVSFGKPVVPAALMNRPTRGERRFAYWALFRFLAH

SEQ ID NO: 106358 - protein, 80 aa, Glycine max
  Coding DNA Sequence Number=SeqID_14673
  Homolog annotation: Hit_ID=A6FJQ2; Match level="QueryCoverage=47%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLVCHIVNPTLPLHLVGVVGERSLLNRGQLVQGGYA

SEQ ID NO: 106359 - protein, 62 aa, Glycine max
  Coding DNA Sequence Number=SeqID_14674
MEFYANAWPTKEGVRDMPSWVSVHVAQLISDAIYQFVGIAPTRGGDKAQEDEDMADMLDFLL

SEQ ID NO: 106360 - protein, 83 aa, Glycine max
  Coding DNA Sequence Number=SeqID_14675
MGRDPKKFLLHLNSISVINPVTKANCPSNESWPEKNEKKSYKERRSKKEYIAWDDNDSSDGSEKEINLLSKDYESDENISQEV

SEQ ID NO: 106361 - protein, 64 aa, Glycine max
  Coding DNA Sequence Number=SeqID_14676
MSIVAKFVKFCNVMQSYPARALDRKLQVDWARDAREGPRVLMSLRVGYPRNIGFFSPCILGHLD

SEQ ID NO: 106362 - protein, 175 aa, Glycine max
  Coding DNA Sequence Number=SeqID_14677
  Homolog annotation: Hit_ID=A5BSR3; Match level="QueryCoverage=65%, HitCoverage=31%, E-value=3e-10, Identity=40%"; Hit description =Putative uncharacterized protein
AEFDIPEASDTDQDGVKDTVCDKYGISKEKWALFCQTRRDPSWEDVRIKAQAIQKQNTAPHVLSRGGYDYLEQKLLAEKTKKKLQEDAHSGSVDGVIDPPSPVRHHVKWKMARTKKTGEMTIEAAKEITEKIDSFEEQTTQGSFVPHGRQDVLAAAIGRPEHPGRVPIAGAGVTI

SEQ ID NO: 106363 - protein, 161 aa, Glycine max
  Coding DNA Sequence Number=SeqID_14678
  Gene Ontology: Mol. function=peptidase activity
  Homolog annotation: Hit_ID=A5C7A2; Match level="QueryCoverage=75%, HitCoverage=11%, E-value=3e-19, Identity=44%"; Hit description =Putative uncharacterized protein
MASSDPLFHEGNSIHRPPSFNGEGYHYWKTRMQIFIEAIDLNIWDRIELGPHIPTIVDASTSTTTQKPRDQWVEEDRRKIQQWQPKVTAISESKDLSSMSLATLFGKLQEHEMELQRLNQNEENDKKKRSIALKASSSIQEENEEEDSDDEEHFSFFVKKF

SEQ ID NO: 106364 - protein, 532 aa, Glycine max
  Coding DNA Sequence Number=SeqID_14679
  Gene Ontology: Mol. function=NADH dehydrogenase (quinone) activity; Cellular component=integral to membrane; Biological process=electron transport
  Homolog annotation: Hit_ID=Q57M35; Match level="QueryCoverage=26%, HitCoverage=77%, E-value=1e-78, Identity=96%"; Hit description=NADH -quinone oxidoreductase subunit I
  Pfam annotation: Domain name=Branch_AA_trans; Domain location=284 -531; Score=-341.6; E_value=0.068; Accession=PF05525.4; Description =Branched-chain amino acid transport protein
  Pfam annotation: Domain name=Fer4; Domain location=204-227; Score =21.9; E_value=0.00014; Accession=PF00037.18; Description=4Fe-4S binding domain
  Pfam annotation: Domain name=Fer4; Domain location=243-266; Score =38.1; E_value=3.2e-08; Accession=PF00037.18; Description=4Fe-4S binding domain
  Pfam annotation: Domain name=NADHdh; Domain location=1-163; Score =107.8; E_value=3.4e-29; Accession=PF00146.12; Description=NADH dehydrogenase
  Pfam annotation: Domain name=Oxidored_q2; Domain location=465-532; Score=26.8; E_value=8.2e-05; Accession=PF00420.15; Description=NADH -ubiquinoneplastoquinone oxidore
  Pfam annotation: Domain name=Oxidored_q3; Domain location=317-479; Score=88.3; E_value=2.5e-23; Accession=PF00499.11; Description=NADH -ubiquinoneplastoquinone oxidore
  Pfam module annotation: Pfam domain module=Branch_AA_trans::Fer4::Fer4 ::NADHdh::Oxidored_q2::Oxidored_q3; Domain location=284-531::204 -227::243-266::1-163::465-532::317-479
FLGLSLMGVVAQAGSFNLNAIVESQTHLWNIIPQFFGFVTFCIAGVAVCHRHPFDQPEAEQELADGYHIEYAGMKFGLFFVGEYVAITTVSALIVTLFFGGWHGPFLPPFIWFALKTAFFMVMFILIRAALPRPRYDQVLSFGWKVCLPLTLLNLLATAAVILYNAHIWMIGMHAFAKRETQMYPEEPVYLPPRYRGRIVLTRDPDGEERCVACNLCAVACPVGCISLQKAEMQDGRWYPEFFRINFSRCIFCGLCEEACPTTAIQLTPDFELGEFKRQDLVYEKEDLLISGPGKYPEYNFYRMAGMEFAFYLCGLVAVLTTLRVITHTNPVHALLYLIVSLLSIAGVFFSMGAYLAGALEIIVYAGAIMVLFVFVVMMLNLGKTQQDQEREWLKPSLWIGPGIVSLLLLVVMIYAILTATDQGIDGTVIDAKAVGISLFGPYVLAVELASMLLLAGARMIPLQHGLILAAVLFVLGLTSLVLRRNLLFLLIGLEIMINAAALALVVAGSYWGQADGQVMYILAISLTAAEA

SEQ ID NO: 106365 - protein, 292 aa, Glycine max
  Coding DNA Sequence Number=SeqID_14680
  Gene Ontology: Mol. function=acetyl-CoA carboxylase activity; Cellular component=acetyl-CoA carboxylase complex; Biological process=fatty acid biosynthetic process
  Homolog annotation: Hit_ID=P0A9Q6; Match level="QueryCoverage=98%, HitCoverage=97%, E-value=1e-128, Identity=80%"; Hit description =Acetyl-coenzyme A carboxylase carboxyl transferase subunit beta
MSWIERILNKSTTTPSRKASIPEGVWTKCDSCGQVLYRAELERNLEVCPKCDHHMRMHARERLHSLMDEGSMTELGSELEPKDLLKFRDSKKYLYRLVVALKETGQLHGMPVVAAAFEFSFMGGSMGSVVGARFVRAVEQALEDNCPLICFSASGGARMQEALQSLMQMAKTSAALAKMQERGLPYISVLTDPTMGGVSASFAMLGDLNVAEPKALIGFAGPRVIEQTVREKLPPGFQRSEFLIEKGAIDMIIRRPEMRFKLASLLAKMMNLPAPLQDGDRPTAAEPESNEA

SEQ ID NO: 106366 - protein, 292 aa, Glycine max
  Coding DNA Sequence Number=SeqID_14681
  Gene Ontology: Mol. function=tRNA-pseudouridine synthase activity; Cellular component=cytoplasm; Biological process=tRNA pseudouridine synthesis
  Homolog annotation: Hit_ID=Q0T2G7; Match level="QueryCoverage=76%, HitCoverage=82%, E-value=1e-111, Identity=84%"; Hit description=tRNA pseudouridine synthase A
  Pfam annotation: Domain name=PseudoU_synth_1; Domain location=211 -292; Score=48.2; E_value=2.9e-11; Accession=PF01416.11; Description =tRNA pseudouridine synthase
  Pfam annotation: Domain name=PseudoU_synth_1; Domain location=74-172; Score=135.3; E_value=1.7e-37; Accession=PF01416.11; Description=tRNA pseudouridine synthase
  Pfam module annotation: Pfam domain module=PseudoU_synth_1::PseudoU _synth_1; Domain location=211-292::74-172
  Subcellular localization annotation: CTP_CleavageSite=5; ConfidenceScore=5.02e-01
MSTILAAAGVQPAAAAGGQCRQRGERAPAGRSVLVGGRQHPLRRRADGGENCREAGAGVSVLMLEDATPFKLALGIEYDGSRYYGWQRQNEVRSVQEKLEKALAKVANHPVNVFCAGRTDAGVHGTGQVVHFETTSSRADSAWTLGVNANLPDDIAVRWVKAVPESFHARFSATARRYRYVIYNQRLRPAILGKGITHFYHPLDAEKMHRAAQALLGENDFTSFRAVQCQSRTPWRNVMHLNVTRLGPYVIVDIKANAFVHHMVRNIVGSLLEIGCGNQPETWMATLLGGKR

SEQ ID NO: 106367 - protein, 339 aa, Glycine max
  Coding DNA Sequence Number=SeqID_14682
  Gene Ontology: Mol. function=transferase activity, transferring phosphorus-containing groups; Cellular component=integral to membrane; Biological process=two-component signal transduction system (phosphorelay)
  Homolog annotation: Hit_ID=A8GH47; Match level="QueryCoverage=100%, HitCoverage=81%, E-value=7e-54, Identity=58%"; Hit description =Integral membrane sensor signal transduction histidine kinase precursor
  Pfam annotation: Domain name=2CSK_N; Domain location=1-83; Score= -5.7; E_value=8.9e-06; Accession=PF08521.1; Description=Two-component sensor kinase N-terminal
  Pfam annotation: Domain name=HATPase_c; Domain location=236-339; Score=89.9; E_value=8.2e-24; Accession=PF02518.17; Description =Histidine kinase-, DNA gyrase B-, and HSP90-like ATPase
  Pfam annotation: Domain name=HisKA; Domain location=125-190; Score =55.4; E_value=2e-13; Accession=PF00512.16; Description=His Kinase A (phosphoacceptor) domain
  Pfam module annotation: Pfam domain module=2CSK_N::HATPase_c::HisKA; Domain location=1-83::236-339::125-190
MNDQLFYQVISPEGRTLSGYPDLPLVPGNAPLSDVYPALVHFYDAHYRKQPIRVAALWQPVNEEGVQGMALSAAHRADQPEFSGADHAAAGRAAAAESAAPAAPAVTHDAAPRAGRTDTAAVAAAVERFSADVSHQLRTPLTILKTQVGVALSSDDPQQWRESLQGMRHTLDDTVQLTDRLLQLAQIKARHGEDKPFSEVNLSDIVQQACFSGYAAARRKQIDLGFEEQAASQVQGDALLLAELCANLLDNAIKYTPHGGTVTARLRQKVLEIEDSGPGIAADQQRQALQPFGRLDHASQPGAGIGLALVQDICAWHGAQLQLDRSPQLGGLRVTVSFR

SEQ ID NO: 106368 - protein, 200 aa, Glycine max
  Coding DNA Sequence Number=SeqID_14683
  Gene Ontology: Cellular component=outer membrane-bounded periplasmic space
  Homolog annotation: Hit_ID=Q7BVH5; Match level="QueryCoverage=48%, HitCoverage=29%, E-value=4e-41, Identity=79%"; Hit description=TctC
MRYVAFEGGGEPVTALLGNHIQVVSGDMSEMVPHLQGGKMRVLAVMSDKRLPGELADIPTAKEQGFNVEWPIIRGYYLGPKVSDADYQWWEQTFKKLTTVNRRNRSAWRNNGGTDERSYLCGGVAGALHRRDGYRLADSKRVQLRAGWSTPFPAAAARSDGDLRGDDAAAQAGRRTVAGGGNAEKAAGAVRDADGVRLAV

SEQ ID NO: 106369 - protein, 536 aa, Glycine max
  Coding DNA Sequence Number=SeqID_14684
  Gene Ontology: Mol. function=transferase activity, transferring nitrogenous groups; Cellular component=intracellular; Biological process=regulation of transcription, DNA-dependent
  Homolog annotation: Hit_ID=A0KPM5; Match level="QueryCoverage=83%, HitCoverage=93%, E-value=1e-107, Identity=47%"; Hit description =Transcriptional regulator, GntR family
  Pfam annotation: Domain name=Aminotran_1_2; Domain location=180-530; Score=6.0; E_value=1.8e-07; Accession=PF00155.12; Description =Aminotransferase class I and II
  Pfam annotation: Domain name=GntR; Domain location=81-144; Score =57.8; E_value=3.8e-14; Accession=PF00392.12; Description=Bacterial regulatory proteins, gntR fam
  Pfam module annotation: Pfam domain module=Aminotran_1_2::GntR; Domain location=180-530::81-144
MRQRQRAAEMSGLIRLAAAGINHHNLRDALRQIRRQIPGIGVVADVRQSGLHPDTTLTVAIRPLCSTPFCHCFAIRRRAVYVSGCAPRCAKAIVSGHLRFGQKLPSSRQLAADLALSRVTVEAAYSQLESEGYVQRHSGRGTFVAIALPPPAEKATAQRAPRFSQRGTQVLATGGCQDPPFPLAFAAGSPELRAFPHRQWQRLSHSVQRALGSQVMGYGDPLGYAPLRQAVADYLALSRGVRCTAEQVIMLTSSQQALQLLALMFLDAEDEVWLEEPGYRGARNAFLAAGARCRAMPLDDQGALPLSGRAQLVYLTPGHQYPTGTPMSLARRLQWLAWARQHDSWLIEDDYDSEFHYDGRPAPALQGMEADSRVISLGTFSKTLFPSLRLAWMVVPAALVTALGRARSVLDGHSALLPQAITAEFIQQGYFASHLRLMRQLYHSRRDRLLVQLEQHLQPWLRPLPATGGLQLTVELLQGDEARLTHLAQADGLLLPPLSPLYAGASPQQGWILGFAALTPGEIDRACAKLVRLLAT

SEQ ID NO: 106370 - protein, 306 aa, Glycine max
  Coding DNA Sequence Number=SeqID_14685
  Gene Ontology: Mol. function=oxidoreductase activity; Biological process=metabolic process
  Homolog annotation: Hit_ID=A8ADQ4; Match level="QueryCoverage=100%, HitCoverage=48%, E-value=7e-77, Identity=51%"; Hit description =Putative uncharacterized protein
  Pfam annotation: Domain name=DUF752; Domain location=1-210; Score =212.5; E_value=1e-60; Accession=PF05430.2; Description=Protein of unknown function (DUF752)
MSLSREGTPVSRAFDDVYFSNDNGLEETRYVFLDGNHLPQRFAAHPRDLFIVAESGVRSLPRRPSASQLAPPALHQLRKIPADPRRSGERARALAGTGPVGRTATAAVAAGPARLSAPAVQWRRGDAGSVAGLNGQVDAWFLDGFAPAKNPEMWTPSLFAAMARLARPGGTFATFTSAGFVRRGLQQAGFSVAKRKGFGHKREMLTGVLDSAPGQRPAQPWYARPQATSREVALIGGGVASAVLALALLRRGWQVTLYCADAAPALGASGNRQGALYPLLNQHDPALATFFPAAFSFARRLYDALP

SEQ ID NO: 106371 - protein, 773 aa, Glycine max
  Coding DNA Sequence Number=SeqID_14686
  Gene Ontology: Mol. function=oxidoreductase activity, acting on NADH or NADPH; Cellular component=membrane; Biological process=ATP synthesis coupled electron transport
  Homolog annotation: Hit_ID=Q8ZDL2; Match level="QueryCoverage=100%, HitCoverage=85%, E-value=0.0, Identity=82%"; Hit description=NADH -quinone oxidoreductase subunit G
  Pfam annotation: Domain name=AAA_3; Domain location=507-632; Score= -22.3; E_value=0.094; Accession=PF07726.2; Description=ATPase family associated with various
  Pfam annotation: Domain name=Fer2; Domain location=4-73; Score=57.1; E_value=5.9e-14; Accession=PF00111.18; Description=2Fe-2S iron -sulfur cluster binding domain
  Pfam annotation: Domain name=Molybdop_Fe4S4; Domain location=221-275; Score=58.1; E_value=3.1e-14; Accession=PF04879.7; Description =Molybdopterin oxidoreductase Fe4S4 domain
  Pfam annotation: Domain name=Molybdopterin; Domain location=275-648; Score=-81.9; E_value=0.00022; Accession=PF00384.13; Description =Molybdopterin oxidoreductase
  Pfam annotation: Domain name=TPP_enzyme_M; Domain location=483-587; Score=-31.0; E_value=0.061; Accession=PF00205.13; Description =Thiamine pyrophosphate enzyme, centra
  Pfam module annotation: Pfam domain module=AAA_3::Fer2::Molybdop _Fe4S4::Molybdopterin::TPP_enzyme_M; Domain location=507-632::4 -73::221-275::275-648::483-587
MATIHVDGKEYDVNGADNLLQACLSLGLDIPYFCWHPALGSVGACRQCAVKQFQNAEDTRGRLVMSCMTPASDGTFISIDDGEAKEFRESVVEWLMTNHPHDCPVCEEGGNCHLQDMTVMTGHSFRRYRFTKRTHQNQDLGPFISHEMNRCIACYRCVRYYKDYADGKDLGVYGAHDNVYFGRPEDGTLESEFSGNLVEICPTGVFTDKTHSERYNRKWDMQFAPSICQQCSVGCNTSPGERYGELRRIENRYNGSVNHYFLCDRGRFGYGYVNRKDRPRHPEQLRGSDRITLNAEQAVNAAADILRQAKKVIGIGSPRASIESNFALRELVGAENFSTGMPAAEQARVELMLKVLQQGGIYTPSLREIESYDAVLVLGEDLTQVGARVALSVRQAVKGKAREMAAAQKVADWQIAAILNIGQHAKHPLFVTNVDETRLDDIAAWSYRAPVEDQARLGFAIAHALDDSAPAVSDFDSSLNGKLDVVVQALAGAKKPLIISGTHSGSTAMIEAAANVAKALKARGADVGITFLAGAANSFGLGLMGGQSLDSALEQLDKGEAEALVVLENDLYRHAPKATVDAALHNTAHVIVVDHQRTATLEKAGLVLSTASFAESDGTSINHEGRAQRFFQVYDPAYYDDSVVMLESWRWLHSLHSAVESRQIDWTQLDHVIDAAIVALPQLKGIKDAAPDASFRIRGQKLARSPHRASGRTAARANISVHEPRQPQDKDTMFAFSMEGNNQPSAPRSQIPFAWAPGWNSPQAWNKFQAEVG

SEQ ID NO: 106372 - protein, 292 aa, Glycine max
  Coding DNA Sequence Number=SeqID_14687
  Gene Ontology: Mol. function=protein methyltransferase activity; Cellular component=ribosome; Biological process=protein amino acid methylation
  Homolog annotation: Hit_ID=A7MH68; Match level="QueryCoverage=100%, HitCoverage=86%, E-value=1e-143, Identity=82%"; Hit description =Putative uncharacterized protein
  Pfam annotation: Domain name=MTS; Domain location=104-277; Score= -0.7; E_value=7.6e-09; Accession=PF05175.5; Description =Methyltransferase small domain
  Pfam annotation: Domain name=Methyltransf_12; Domain location=119 -240; Score=9.2; E_value=0.058; Accession=PF08242.3; Description =Methyltransferase domain
  Pfam annotation: Domain name=UPF0020; Domain location=91-257; Score= -52.8; E_value=0.011; Accession=PF01170.9; Description=Putative RNA methylase family UPF0020
  Pfam module annotation: Pfam domain module=MTS::Methyltransf _12::UPF0020; Domain location=104-277::119-240::91-257
MLRWAVSRFSAAGIWYGHGTDNPWDEAVQLVLPTLWLPLDIPEDMRHARLTASERHRIVERVIRRVNERIPVAYLTNKAWFCGHEFYVDERVLVPRSPIGELIENRFAGLIDGAPRHILDMCTGSGCIAIACAYAFPEAEVDAVDISTDALAVAEQNIEEHGLLHHVTPIRADLFRNLPQVKYDLIVTNPPYVDAEDMDDLPNEYRHEPELGLAAGSDGLKLVRRILACAPDYLSEQGVLICEVGNSMVHMMEQYPDVPFTWLEFDNGGDGVFMLTRDQIVAAQSHFSFYKD

SEQ ID NO: 106373 - protein, 436 aa, Glycine max
  Coding DNA Sequence Number=SeqID_14688
  Gene Ontology: Mol. function=acetyl-CoA C-acyltransferase activity; Cellular component=cytoplasm; Biological process=fatty acid metabolic process
  Homolog annotation: Hit_ID=A6TC20; Match level="QueryCoverage=100%, HitCoverage=100%, E-value=1e-176, Identity=72%"; Hit description=3 -ketoacyl-CoA thiolase
  Pfam annotation: Domain name=Thiolase_C; Domain location=295-435; Score=172.0; E_value=1.5e-48; Accession=PF02803.9; Description =Thiolase, C-terminal domain
  Pfam annotation: Domain name=Thiolase_N; Domain location=12-288; Score=213.5; E_value=5.1e-61; Accession=PF00108.14; Description =Thiolase, N-terminal domain
  Pfam module annotation: Pfam domain module=Thiolase_C::Thiolase_N; Domain location=295-435::12-288
MSKAQPLLTRQGERIAITHGLRTPFARQASDFHGIPALELGRMVVSELMARSELPVEVIDQLVFGQVVQMPEAPNIAREIVLSSGLSVHTDAYSVSRACATSFQAVANVAESLMAGTIDAGIAGGADSSSVLPIGVSKTLARALVDLNKARTLSKKLHILRRLRPRDLLPVPPAVAEYSTGLRMGDTAEQMAKTHGITREQQDALALRSHHRAAQAWQSGVLAQEVMPAFVPPWKAPIEQDNNIRFNASAADYAKLRPAFDRRHGSVTAANSTPLTDGAAALILMREGRARELGITPLGYLRSYAFAAIDVWQDMLLGPAYASPLALDRAGITLGDLTLIDMHEAFAAQTLANLRLFNDERFAREVLKRDRALGEVDETRFNVLGGSIAYGHPFAATGARMITQTLHELRRRGGGLGLVTACAAGGLGSAMVLEAK

SEQ ID NO: 106374 - protein, 409 aa, Glycine max
  Coding DNA Sequence Number=SeqID_14689
  Gene Ontology: Mol. function=heme transporter activity; Cellular component=membrane; Biological process=respiratory chain complex IV assembly
  Homolog annotation: Hit_ID=Q9Z649; Match level="QueryCoverage=52%, HitCoverage=86%, E-value=1e-100, Identity=80%"; Hit description=CcmC
  Pfam annotation: Domain name=CcmE; Domain location=277-391; Score =188.8; E_value=1.3e-53; Accession=PF03100.6; Description=CcmE
  Pfam annotation: Domain name=Cytochrom_C_asm; Domain location=7-186; Score=203.0; E_value=7.1e-58; Accession=PF01578.11; Description =Cytochrome C assembly protein
  Pfam module annotation: Pfam domain module=CcmE::Cytochrom_C_asm; Domain location=277-391::7-186
MSMWKWLHQWAKPERLYQLCGRLIPWFAILGVGALLLGWIWGFGFAPADYQQGNSFRIMYIHVPAAMWSMGVYASMAIAAFIGLVWQMKMADLAAAAMAPIGAVFTFIALVTGSAWGKPMWGTWWIWDARLTSELVLLFLYMGVIALYHSFDDRRTAGRAAGILILVGVVNLPIIHFSVQWWNTLHQGSSGILQQAIDPSMRTPLRWSILGYLLVEDAKHDACLLIVERVFRHGRLCLLRLAGRVFYADSADRSGAAHRVVPSPPAGRDSPARVRVNIRRRNRLYVVVAVLVGLGLATSLVMYALRSNIDLFYTPSEILYGKGEDHQKPEAGQRLRVGGMVMPGSVKRDPKTLAVSFKLAGRGGAGRAGRRNLVNAKEVLAKHDEKYTPPEIQDAMKRSYGPGSGLSAG

SEQ ID NO: 106375 - protein, 425 aa, Glycine max
  Coding DNA Sequence Number=SeqID_14690
  Gene Ontology: Mol. function=oxidoreductase activity, acting on NADH or NADPH; Cellular component=integral to membrane; Biological process=mitochondrial electron transport, NADH to ubiquinone
  Homolog annotation: Hit_ID=O85274; Match level="QueryCoverage=44%, HitCoverage=83%, E-value=1e-102, Identity=94%"; Hit description=NADH- quinone oxidoreductase subunit B
  Pfam annotation: Domain name=Oxidored_q4; Domain location=23-123; Score=132.9; E_value=9e-37; Accession=PF00507.10; Description=NADH -ubiquinoneplastoquinone oxidore
  Pfam annotation: Domain name=Oxidored_q6; Domain location=184-291; Score=175.0; E_value=1.9e-49; Accession=PF01058.13; Description=NADH ubiquinone oxidoreductase, 20 Kd sub
  Pfam module annotation: Pfam domain module=Oxidored_q4::Oxidored_q6; Domain location=23-123::184-291
MSTTTEVIAHHWAFIVFIVIAFGLCAFMLTGGWLLGGRARARHKNTPFESGIESVGDTHIRLSAKFYLVAMFFVIFDVEALYLYAWSTSIRESGWVGFVEAAIFILVLLAGLVYLVRIGALDWAPARRRVVVKSSPEIVTDPLEQHVHRSVYMGKLEHALHDMVNWGRKNSLWPYNFGLSCCYVEMTTSFTAVHDVARFGAEVMRASPRQADFMVIAGTPFTKMAPVIQRLYDQMLEPKWVISMGACANSGGMYDIYSVVQGVDKFLPVDVYIPGCPPRPEAYMQALLLLRESIGKERRPLSWVVGDQGVYRANMQSERERKRDLTTQDLAQPAWQTRDHLDDPVIGELRNRFGPDAFTVQATRTGIPVVWVKREQLLEIIEFLRKLPKPYVMLYDLHGFDERLRTHRAGLPAADFSVFYHSAVD

SEQ ID NO: 106376 - protein, 199 aa, Glycine max
  Coding DNA Sequence Number=SeqID_14691
  Gene Ontology: Mol. function=catalytic activity
  Homolog annotation: Hit_ID=A8GH19; Match level="QueryCoverage=100%, HitCoverage=94%, E-value=2e-90, Identity=80%"; Hit description=Metal dependent phosphohydrolase
  Pfam annotation: Domain name=HD; Domain location=30-142; Score=55.0; E_value=2.5e-13; Accession=PF01966.13; Description=HD domain
MTRSHFFAHLSRLKLINRWPLMRNVRTENVSEHSLQVAMVAHALAIIKNKKFNGNLNADRIAMLALYHDASEVLTGDLPTPVKYYNAQIAHEYKKIEKIAQHKLIEMLPPELQDAYRPLLDEHLHSESEQAVVKQADALCAYLKCLEELSAGNNEFLLAKARLEKTLAQRRSPEMDYFVEVFIPSFSLSLDEISQDTPL

SEQ ID NO: 106377 - protein, 219 aa, Glycine max
  Coding DNA Sequence Number=SeqID_14692
  Subcellular localization annotation: CTP_CleavageSite=38; ConfidenceScore=5.13e-01
SSTAAQPGRGVRPSLTRRDSRPAVNPPASRLNQTETPCTSHVAPYSGIEDLRDFILAEVILTRTSVPHRQHALVFFPHRGLRIEAVGAGIEMGIAPFHVNHKAYVAEVTRFGGRVEAEKRQATLFNVARRLVIGPGNMQRMMHFHNVDQRTAGRLAQLAELFVQLAQLQSIAAFNNGLIAAIALGVIRLKHRHHLVLIRKNQSLCMGHFHGLLPGRRAA

SEQ ID NO: 106378 - protein, 145 aa, Glycine max
  Coding DNA Sequence Number=SeqID_14693
  Gene Ontology: Mol. function=4-aminobutyrate transaminase activity; Biological process=gamma-aminobutyric acid metabolic process
  Homolog annotation: Hit_ID=Q6D5I7; Match level="QueryCoverage=99%, HitCoverage=34%, E-value=3e-40, Identity=59%"; Hit description=4 -aminobutyrate aminotransferase
MSAVSGRAEVMDAPEPGGMGGTYAGHPPAMAAAHAVLDIIREENLCERAQWLGTQLAEALNGAGCRALAEVRGYGSMMAAEFHDASGRPSAEIAKAIQQQALAEGLILLTCGVHSNVIRFLYPLTIPDAQFSTALNILTRILSQH

SEQ ID NO: 106379 - protein, 798 aa, Glycine max
  Coding DNA Sequence Number=SeqID_14694
  Gene Ontology: Mol. function=transporter activity; Cellular component= integral to membrane; Biological process=transport
  Homolog annotation: Hit_ID=UPI00005F8F74; Match level="QueryCoverage =43%, HitCoverage=79%, E-value=1e-144, Identity=68%"; Hit description= COG0477: Permeases of the major facilitator superfamily
  Pfam annotation: Domain name=FGGY_C; Domain location=246-459; Score= -19.5; E_value=9.1e-06; Accession=PF02782.7; Description=FGGY family of carbohydrate kinases, C-terminal domain
  Pfam annotation: Domain name=FGGY_N; Domain location=1-243; Score =371.6; E_value=1.3e-108; Accession=PF00370.12; Description=FGGY family of carbohydrate kinases,
  Pfam annotation: Domain name=MFS_1; Domain location=461-797; Score =39.1; E_value=1.6e-08; Accession=PF07690.7; Description=Major Facilitator Superfamily
  Pfam module annotation: Pfam domain module=FGGY_C::FGGY_N::MFS_1; Domain location=246-459::1-243::461-797
MYLGIDIGTSELKALIVNPQGEIVASNHATLSVQRPHPHWAEQDPERWWQACGQAIAGLRQQAPDAWAAIRAIGLSGQMHGAVLLDAAGEVLRPCILWNDTRSAAQCDALRQHHPQMMEIAANLIMPGFTAPKLHWVAEHEPEIFRRIDKVLLPKDYLRWRLTGRFVSEPSDAAGTLWLDVAQRDWSDALLAISGLTRAQMPELVEGCAVSAPLRADLASEWGLAATVSVAGGGGDNAASAVGVGAVNAGDAFISLGTSGVIFVVNDRLRADPQSGVHAFCHALPGRWHQMSVMLSAASCLRWLCNLLSVTESQLMDEIAQLSAEQLRQAPLFLPYLSGRSVWPGGWPGSAGRYATADSAVQPDRRRCAQHAVGAADCRRAAAADSDPSGQRLRRAGCGATGVAGRRRQRSRRVPEAASAGALSARCGARGRAAAAAAPVPKIVMQSNAYWFGLPKKMFWGFLAIAIFMAGDGFEMAFLSRHITDMGFSPAQSAVVFTFYGLAAALAAWASGVVAELITPQRAMMIGFVLWIVMHALFMSLGLGLRNYPLMVLFYGIRGLAYPLFIYSFMMMLVQVLPRDKLAAATGWFWAMYSVGIGVVGSYLPSLTIPMLGETGTLWLAIVWVACGGVLAYFSLRNVPVDRSRVNLPLRDKMTEMSRAVTILFTNQHVFYACLIRIINTLSLFGFAIIMPLLFVDRLGFTISEWLQIWAVFFFVTIFTNIFWGITGEKLGWIRQVRWFGCLGMAISSLAFYYLPLYAGHNFWVALIPAIMLGIFVAAFVPMTAVFPTLEPHHKGAA

SEQ ID NO: 106380 - protein, 169 aa, Glycine max
  Coding DNA Sequence Number=SeqID_14695
  Homolog annotation: Hit_ID=Q0KIL1; Match level="QueryCoverage=54%, HitCoverage=10%, E-value=1e-07, Identity=36%"; Hit description =Gag/pol polyprotein, 3'-partial, putative
  Pfam annotation: Domain name=G-patch; Domain location=51-95; Score =17.7; E_value=0.0014; Accession=PF01585.14; Description=G-patch domain
SGGEDMLVCCPTSAPYVEAAEESLETTFQSFEVVSCASVETGPLLPCLSSAALMVARVILRHGYEPGMGLGKESLGNVDVVDIRGNPYKYGLGYEPGKPGRRNALSRLWADRKWPGHVSQCFTSVGIMFEEEDPTNEGLIIDFDREVSQIINEEEEEDVLSPELERLIA

SEQ ID NO: 106381 - protein, 121 aa, Glycine max
  Coding DNA Sequence Number=SeqID_14696
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVDSRGSPTKINSGHSLRAMKPGMAARNPNFRAYVKTK

SEQ ID NO: 106382 - protein, 84 aa, Glycine max
  Coding DNA Sequence Number=SeqID_14697
MSVKNHPGALRSTQQDTPHNGFVRSLITNFARMLQPYEISIGLKEHSNPVTPKAYTPKSPSGPLPPDSDTAHELYNTHDLTLVF

SEQ ID NO: 106383 - protein, 318 aa, Glycine max
  Coding DNA Sequence Number=SeqID_14698
  Gene Ontology: Mol. function=nucleoside-triphosphatase activity; Cellular component=chloroplast
  Homolog annotation: Hit_ID=Q2PMM5; Match level="QueryCoverage=71%, HitCoverage=9%, E-value=1e-134, Identity=100%"; Hit description =Protein ycf2
MQLGGFDERTSIQILDFRIERDIERNQEFSLFLRFMDPIQFSGIFHSYFFPSREFYKTLGLPNLEYPTFTQFTGFNKQSIFHDQVDCSAPVSPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSK

SEQ ID NO: 106384 - protein, 159 aa, Glycine max
  Coding DNA Sequence Number=SeqID_14699
  Homolog annotation: Hit_ID=P03851; Match level="QueryCoverage=52%, HitCoverage=100%, E-value=4e-44, Identity=98%"; Hit description =Uncharacterized 9.4 kDa protein
DPPAHSKAVYGYPQNQGITQERTCEQKASKRPGTVAKPDRTIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 106385 - protein, 92 aa, Glycine max
  Coding DNA Sequence Number=SeqID_14700
  Gene Ontology: Mol. function=metalloendopeptidase activity; Biological process=proteolysis
  Homolog annotation: Hit_ID=A2Q1L2; Match level="QueryCoverage=43%, HitCoverage=7%, E-value=2e-15, Identity=92%"; Hit description =Peptidase M50, mammalian sterol-regulatory element binding protein
  Subcellular localization annotation: CTP_CleavageSite=52; ConfidenceScore=5.39e-01
PNDRAQRASERGSGRAPNTQTASPRRVGRFINAAGTTGFPTGKRAVSATQLIAMHAETVPIHPLVIAGWCGLTIQAFNMLPVGCLDGGRAVQ

SEQ ID NO: 106386 - protein, 59 aa, Glycine max
  Coding DNA Sequence Number=SeqID_14701
MRKRHAFPKGERRTGGRSLWKNASNAAFLRFLAFCWPFAHMFFPALSPDSVDNRITAFE

SEQ ID NO: 106387 - protein, 145 aa, Glycine max
  Coding DNA Sequence Number=SeqID_14702
  Homolog annotation: Hit_ID=A0ST23; Match level="QueryCoverage=31%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTFVSFVTWGGGTELEFVIMVIAVSFGKPVVPAALMNRPTRGERRFAYWALFRFLAH

SEQ ID NO: 106388 - protein, 97 aa, Glycine max
  Coding DNA Sequence Number=SeqID_14703
AGAVTSFGYRKDRNGQWLKKDVLQDERTPSPPPKHDDSSALMTEVLSELRGLRTYVGERFDSLDGRFEGMDTRITQFEEDVTYICQSFDLPPSPPPS

SEQ ID NO: 106389 - protein, 123 aa, Glycine max
  Coding DNA Sequence Number=SeqID_14704
MSKSCGFGMTGPLDESISCFLIRVDPWVLVPITFRGLHVLALRGLHALTLEGCTPSPPEDYHVLALRGLHALTLGTSYPHRQRTTRPALRGLHVLTIRGLHALTSRGLHVLALRGLHALIFGY

SEQ ID NO: 106390 - protein, 283 aa, Glycine max
  Coding DNA Sequence Number=SeqID_14705
  Gene Ontology: Mol. function=motor activity; Cellular component=cell projection
  Homolog annotation: Hit_ID=UPI00016621D1; Match level="QueryCoverage =76%, HitCoverage=40%, E-value=1e-21, Identity=33%"; Hit description =UPI00016621D1 related cluster
MLQLFLVLGKFFLQESTASFILLCYKVMTKDSNWYLKALHWGNEGHLPIAFRGLHAHTFRGLHVLAIKGLHALTFRGLHVLTFRGLHVLAFRGLHVLAFRGLHILTFRGLHVLTLRGLHALAFRGLHALAFVGLHILTFRGLHTFAFVGLHVLTFRGLHAFAFVGLHVLTFRRLHAFAFVGLHVLTVRGLHVLAFRGLHVLTFRGLHTFAFVGLHVLTFRGLHVLAFRGLHALAFRGLHVLTFRGLHVFAFRGLHVLIFRGLHALRGLHFLALRGLDALAFKG

SEQ ID NO: 106391 - protein, 84 aa, Glycine max
  Coding DNA Sequence Number=SeqID_14706
  Homolog annotation: Hit_ID=A5BPN8; Match level="QueryCoverage=61%, HitCoverage=5%, E-value=2e-09, Identity=61%"; Hit description =Putative uncharacterized protein
MYQISCLACEERYVSYFDSGATANISVSMQGCLSYRKPIDSERWIYVGDVKSVELPMVNPLMRNCVVLSVELIIQTQEHYGISA

SEQ ID NO: 106392 - protein, 136 aa, Glycine max
  Coding DNA Sequence Number=SeqID_14707
MDMNLGYIISSQISMIAQHDSSWLGFAALITALCKARGVTSDSLSFESLNPTINLAYGSHKAKGKRSEAPPSSAFPTSALSTSTVAPYAPASSVPAPALAPVSSRPSTFSSETLFAMLQSLHKGQIIIMQSLQISG

SEQ ID NO: 106393 - protein, 72 aa, Glycine max
  Coding DNA Sequence Number=SeqID_14708
MVPPPLSVLFKGLTVRCNHVLQLSAIGSHIEIVLILPKEGNNQILPSEDAGSFQISVPNDRGSSRAILEKVH

SEQ ID NO: 106394 - protein, 206 aa, Glycine max
  Coding DNA Sequence Number=SeqID_14709
MGDQEETQEQMKADMSALKEQMASMMEAMLSMKQLIEKNAATAAAASSAAEADPTLLATTHHPPSNIVGRGRDTLGHDGSPHLGYNRAAYPYGLPPNYSPPVLQEDAGHIASPVHEREPPQQPDEVHKDPQDYARRDVEFYPPIPEGPAPGTLPQPNIAVPPIVLSTEGPPPATEERRKLDLLEERLRAVERFGDYPFADMTDLCL

SEQ ID NO: 106395 - protein, 72 aa, Glycine max
  Coding DNA Sequence Number=SeqID_14710
MLLSSNVIYICVRVVMLMRMIHTCLFAAARVKYCPGMHSSCVIASLSGCACTVGRPPVSGGRPETPSDGKDV

SEQ ID NO: 106396 - protein, 156 aa, Glycine max
  Coding DNA Sequence Number=SeqID_14711
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPHQHFLSEDRCSNP

SEQ ID NO: 106397 - protein, 200 aa, Glycine max
  Coding DNA Sequence Number=SeqID_14712
MALAIIWATRTVIRVKMRHPYLSQSSHAGAHNPHPPPRSGLGKVLHNSWAIASSSKPEAWSLLWLNSHRWFSSKISGWPRNWLRASNSRTISGSNLAMGVTRVLILYVLSPVTVELRRGAGAFPMGVPPVPLCGELLRSHLLLGMNNNAKWNQKTLRNGGARPGELTSPRQANPGLLNMRSQSQDDDLLTISLVPARTRP

SEQ ID NO: 106398 - protein, 147 aa, Glycine max
  Coding DNA Sequence Number=SeqID_14713
  Gene Ontology: Mol. function=oxidoreductase activity, acting on NADH or NADPH; Cellular component=mitochondrion; Biological process =electron transport
  Homolog annotation: Hit_ID=A7QCZ6; Match level="QueryCoverage=54%, HitCoverage=73%, E-value=2e-38, Identity=97%"; Hit description =Chromosome undetermined scaffold_79, whole genome shotgun sequence
  Pfam annotation: Domain name=ATP-synt_ab_N; Domain location=84-146; Score=59.2; E_value=1.4e-14; Accession=PF02874.14; Description=ATP synthase alphabeta family, beta-barrel domain
  Pfam annotation: Domain name=Complex1_49kDa; Domain location=1-87; Score=-135.4; E_value=0.0018; Accession=PF00346.10; Description =Respiratory-chain NADH dehydrogenase,
  Pfam annotation: Domain name=HAS-barrel; Domain location=84-143; Score=31.9; E_value=2.3e-06; Accession=PF09378.1; Description=HAS barrel domain
  Pfam module annotation: Pfam domain module=ATP-synt_ab_N::Complex1 _49kDa::HAS-barrel; Domain location=84-146::1-87::84-143
MTTGSSVYSTSIHHFELYTEGFSVPAPSTYTAVEAPKGEFGVFLVSNGSNRPYRRKIRAPGSAHSQGLDSMSKHHMPADVVTIIVDEIGRVVSVGDGIARVYGLNEIQAGEMVEFASGVKGIALNLENENVGLVVFGSDTAIKEGDL

SEQ ID NO: 106399 - protein, 102 aa, Glycine max
  Coding DNA Sequence Number=SeqID_14714
MKKLPAALRSLWLIVTMVLGVVFVWMMRFAAGCCRVGPDSASLMAWRCRSGVGREHLGIESALITRSWYHVTALTPAGSLCTIVGLAGQLIGRGVFYGCVLP

SEQ ID NO: 106400 - protein, 214 aa, Glycine max
  Coding DNA Sequence Number=SeqID_14715
  Homolog annotation: Hit_ID=Q84VH5; Match level="QueryCoverage=78%, HitCoverage=37%, E-value=2e-68, Identity=97%"; Hit description =Envelope-like protein
MDLIKAAGLLKTVTKLGDCYESLVREFIVNIPSDITNRKSDDYQKVFVRGKCVRFSPAVINKYLGRPTEGVVDIAVSEHQIAKEITAKQVQHWPKKGKLSAGKLSVKYAILHRIGAANWVPTNHTSTVATGKAAASGAVSKDALIAELKDTCKVLGATIKATTEKKMELERLIERLSESGIDDGEAAEEEEAAEQEEDAAEDTKSDDDDSDATP

SEQ ID NO: 106401 - protein, 79 aa, Glycine max
  Coding DNA Sequence Number=SeqID_14716
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=64%, HitCoverage=44%, E-value=5e-09, Identity=54%"; Hit description=CTV.20
MALFDTGADSNCILEGLIPKKFFEKTSEKLSTTNGSKLKINYKLSNAIIENQERNILSISLMRKTLGKNKFPQKPGRFK

SEQ ID NO: 106402 - protein, 263 aa, Glycine max
  Coding DNA Sequence Number=SeqID_14717
MIMRDQDIYSSHEETTSCPSSSGSEFEIRGEESSEEVYPHEEGDLLMKNKKKKKDSKALSSKAKGKEKEEKDSSKKIVKKENHFATQGDIKRALLLKQSFYLLLSRETSLSTAIPLELEVIPQVKEFLDEGLVRKSLNPRALLVPKIGIIRHQIPMIGGIMNVLSGATLFCKITHAPNIFMICVHRDSLDSDQGFPMNPKRIKVILEWPTPSSIREIWGFNILKNFYKSVEEGIHEFQEPLDLRSNPFQGRGNDAIIPPKDIG

SEQ ID NO: 106403 - protein, 45 aa, Glycine max
  Coding DNA Sequence Number=SeqID_14718
MEVEESLMGSQLPFHYRADTGGWCLVLDVHQVDFVADLGVAFEDD

SEQ ID NO: 106404 - protein, 80 aa, Glycine max
  Coding DNA Sequence Number=SeqID_14719
MGAEYLEVVKRGSHPNKQMAQNDHNLSLRALGHNRAWVARRRMTIICLCVPPGTIASGWRKGVGNDHNLSSPTSRLTVPK

SEQ ID NO: 106405 - protein, 38 aa, Glycine max
  Coding DNA Sequence Number=SeqID_14720
MEHRLKGAIKGINSRKHQQESSQGYCESNQWGKTHRIK

SEQ ID NO: 106406 - protein, 76 aa, Glycine max
  Coding DNA Sequence Number=SeqID_14721
DLLCRNVPFRGRAKARLTGALSKGGKMRGVATNEGISTSHVDKSGAFAPTYPPSKRKSNLRSSFIRVNQVILFTLE

SEQ ID NO: 106407 - protein, 136 aa, Glycine max
  Coding DNA Sequence Number=SeqID_14722
MIRGDTLRLFAPLYHPEAAGPMIRGDTLRLFAPFCHPEAAGPMTSRDQVWSFCTLVSSRGGGPDDTRKYPSETDIVFCTFCSSRNNKSFTCGNFMVARDSRQPGGAKLVSYTNFRGPLLDDMRPFFGPCEVLGTHH

SEQ ID NO: 106408 - protein, 112 aa, Glycine max
  Coding DNA Sequence Number=SeqID_14723
MACPQWMLWSMECSICGVKIKYAGPTERGAESGISEGAGGITGISVEEEGGSVEEEGPLVSGAEVEGTSDLFSLAFLGPLNVTVGSSRFQQFFLMYAKLMARLRLSKDLELD

SEQ ID NO: 106409 - protein, 48 aa, Glycine max
  Coding DNA Sequence Number=SeqID_14724
MFVFNSALKGLDDTPQSKSKAATRWIVVKYFNYAIPLEPERLKALRIR

SEQ ID NO: 106410 - protein, 73 aa, Glycine max
  Coding DNA Sequence Number=SeqID_14725
MASMKVGSTSAEYKSQKVADDPRENFATQQQMLTATKETNDEISQMKSMCTRMPVHYGVNYFVRYYTLLFACN

SEQ ID NO: 106411 - protein, 200 aa, Glycine max
  Coding DNA Sequence Number=SeqID_14726
  Subcellular localization annotation: CTP_CleavageSite=41; ConfidenceScore=5.61e-01
MAEPSKKRKGSSSTAAAAAHRRHGPSGASTTPIHPSLSSPRSSTLFSSDDQRLRYLSQFSSRIILDPKYLDVEFFNDETFDCYQVFQNSGLVDFMSLKLPHYPELVKVFYCNLKIQDGIITSEVHGIPMVIDQSLFFSLTHLPNQGAPFEGTILFMTGNLIILVMMLVVWLKAQVEKDEGLSGEGQSPRVEKDEGPSGER

SEQ ID NO: 106412 - protein, 111 aa, Glycine max
  Coding DNA Sequence Number=SeqID_14727
  Homolog annotation: Hit_ID=A0ST23; Match level="QueryCoverage=22%, HitCoverage=51%, E-value=3e-07, Identity=100%"; Hit description =Putative reverse transcriptase
MVASHNNCKGLRKSCRKAIQDQAYRYRRPRGGARYQLLFPLVRVNFELGVIMVIAVSFGKPVVPAALMNRPTRGERRFAYWALAECILAYYVGTDEGVSEVLHVAEKKGCT

SEQ ID NO: 106413 - protein, 164 aa, Glycine max
  Coding DNA Sequence Number=SeqID_14728
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=54%, HitCoverage=75%, E-value=5e-25, Identity=67%"; Hit description=LacZ protein
  Subcellular localization annotation: CTP_CleavageSite=28; ConfidenceScore=5.60e-01
MWRNGKMPTDMPLSRLTSKVRTMSSQPSACAREPRMTRMLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106414 - protein, 72 aa, Glycine max
  Coding DNA Sequence Number=SeqID_14729
LGRIDGDPVLRGTRIRATWEYVSSVKSGTWRYVAGVKRPWGRQASSWQSTDKRTKTTKQGGLCGGWPAVNLV

SEQ ID NO: 106415 - protein, 86 aa, Glycine max
  Coding DNA Sequence Number=SeqID_14730
KVGVEEVRDADAPIPIPTKKFIVGPMKPADRPDHDVDYPLYLMTLTIPQLFLKPLQVMWDAIVFGDFNDNFPLYIKHEGLFEIAHD

SEQ ID NO: 106416 - protein, 80 aa, Glycine max
  Coding DNA Sequence Number=SeqID_14731
MKKRDTGHQSVSLKNKTGDSTMLKIGDSAKVVIKQDMKGRRHKYGFNNNKREKPEKVRVVDDETGDKHQPDPVGTVLSSS

SEQ ID NO: 106417 - protein, 106 aa, Glycine max
  Coding DNA Sequence Number=SeqID_14732
  Homolog annotation: Hit_ID=A1FVK9; Match level="QueryCoverage=29%, HitCoverage=9%, E-value=5e-10, Identity=96%"; Hit description =Secretion protein HlyD precursor
MAPGAVQPGAVRDRAWPAVPPPALDAIVNKIRSRDRRPAGAAPAVGGTGRVRAGGNGERGRQPGGEEGRRAVRDRPRALPHRAGTGPSQPGRAPGLGGAAAPRNRP

SEQ ID NO: 106418 - protein, 130 aa, Glycine max
  Coding DNA Sequence Number=SeqID_14733
  Homolog annotation: Hit_ID=A5B1X5; Match level="QueryCoverage=95%, HitCoverage=9%, E-value=8e-10, Identity=32%"; Hit description =Putative uncharacterized protein
NTGVRIDDVGFTLLDLKKFAYQNDTLIMAEQAKQVFYVQDPCDERQMATPPSSPPSPTVAESQSPSTLKRTRKATQLRSLATRLVGAERPMVHVDPGTGKANNPHRKKLRTYLGIVARDKVDVTYENLKT

SEQ ID NO: 106419 - protein, 124 aa, Glycine max
  Coding DNA Sequence Number=SeqID_14734
DLPKVQEKLVVAVMRDRDQHVNHRQQVPRRIKSSQAHKHKVADEYARVYAEKEARGRVIDSLHQEATMWMDRFSLTLNGSQQLPRLLAKAKAMADAYSAPEEIHELLNYCKHMIDLMAHIIRNH

SEQ ID NO: 106420 - protein, 217 aa, Glycine max
  Coding DNA Sequence Number=SeqID_14735
  Subcellular localization annotation: CTP_CleavageSite=75; ConfidenceScore=5.23e-01
GQNQLAVVRCQDEVGGRNPSRLGSRPMGRRPLPSSGQMKSAAARQPKGANCANTTREGGYHAATMHTGARFHPCRCKKTSADRAHQHDHSYTDMGHAHKTPSGLGEVQQGPGVSSSRIAPAGHPVDPKKSNRVLGLPALITGLCQFYGVPVTPSKVIRPPTNRAFIKKYCAPRQAEGNKCTAATSRAPQLIHRKVRDRQVIRRPAQDVKEALLGGNP

SEQ ID NO: 106421 - protein, 139 aa, Glycine max
  Coding DNA Sequence Number=SeqID_14736
  Gene Ontology: Biological process=transposition, DNA-mediated
  Homolog annotation: Hit_ID=Q1J7G7; Match level="QueryCoverage=24%, HitCoverage=48%, E-value=7e-12, Identity=97%"; Hit description =Transposase
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDLKGTA

SEQ ID NO: 106422 - protein, 229 aa, Glycine max
  Coding DNA Sequence Number=SeqID_14737
MYEVYGIKMVIDQSLFYDSTQLPSKGVPFEGTLIDDWKFDFSVHDARRLVCTNQADMTERLLAGSLAFESRILHYLIVRILLPRSSNIAQVSEEDLIVMWDFHKVTLFLQHFNIPLDSEPYFPIKRSFLIGASVIASFGYQKEHDGSWVKKGARHVGEEGHDEEDSSLLSKILDRFDGLQTFVGERFDTLELQVDMRFNEMESRITKVEEDVSYIRSSFGLPPPPPPLS

SEQ ID NO: 106423 - protein, 66 aa, Glycine max
  Coding DNA Sequence Number=SeqID_14738
MASKIQILPVVGVVAMYIMNSIITFLYFNGRVYEDNDGVIFEGSKKAIQIKRGISFNALKKKIGDK

SEQ ID NO: 106424 - protein, 124 aa, Glycine max
  Coding DNA Sequence Number=SeqID_14739
MSVGSLMGSTERSGTSTSDHAIPVSCAGGLLLFITDRKGSCDSLATRRPFLLLQSIHGSREVCVVLGACSSDYMDWFFRISHPFMTPSHALDHLPHGHAPQPRVAPQAPQTDIPRRHLRRSPNM

SEQ ID NO: 106425 - protein, 351 aa, Glycine max
  Coding DNA Sequence Number=SeqID_14740
  Homolog annotation: Hit_ID=Q6WAY6; Match level="QueryCoverage=75%, HitCoverage=51%, E-value=7e-31, Identity=29%"; Hit description =Putative uncharacterized protein
PLRCFTFGDFQMVPTIEEFEEILGCPLGGRKPYLFSGFLPSLSKIAAVVGDSAKKLDRMKQTRNDVVGLPRKYLEGKARDMASQEKWGPFADILALLIFGVVLFPNVDGLVYLAAIDAFLDITIARKVQWWLSWQICLTPLTGEKGRVDWDQHLAEIGGSAINWFPRWKKGKEGVHFSCGDYPNVPLIGTRGCINYNPALAIRQLGYPMRGAPTEGSLSPFLVKDLGTQGLKVIQRIHKAWRSPLRKDKELRGIRNGVIGGYHGWLRIHTRGLDWLSKLKVIDEENFEAPEEDEEVRALKLELGKARLAKEKFKSAATHIRKECTELQEENAATARALEQETKRDRREERD

SEQ ID NO: 106426 - protein, 60 aa, Glycine max
  Coding DNA Sequence Number=SeqID_14741
MATKMKQCLFEALGSIAPIMYVTHIENGHGADNTFNGTGGALTLSTKDIPTQEETGCQPL

SEQ ID NO: 106427 - protein, 50 aa, Glycine max
  Coding DNA Sequence Number=SeqID_14742
MARHEYIGRGLVVRAAASKDEKGADNHKRKPGNFDKNRNHSKCINLAQDF

SEQ ID NO: 106428 - protein, 252 aa, Glycine max
  Coding DNA Sequence Number=SeqID_14743
  Homolog annotation: Hit_ID=A5BS60; Match level="QueryCoverage=76%, HitCoverage=40%, E-value=2e-08, Identity=24%"; Hit description =Putative uncharacterized protein
MVIDQSLFHDLTQLSSDGVPFEGTLNDDWKFDFSAHDARQLVCTNHADMTVRLLVGSLAFESRILHYLIVHILLPRSSNLAQVFEEDLVIMWAFHTGRQLDWAHLVRYRMHKALRLNAPLPYPHLVTLFFRHFQIPLDSEPYVPIKRSFLIGAAVIAYFGYRKEHDGSWVKKGAQPANDEDNLPVEDNSSLLRKLLDKFDGLQTFVGDKFDAMELQVDMQFDAMESRITKVEEDVSFIRTCFDPPPLPPSSS

SEQ ID NO: 106429 - protein, 256 aa, Glycine max
  Coding DNA Sequence Number=SeqID_14744
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPRASRYQQGHQDLFILRSDLPSQWLLFLSAVPPVQLLTGWCVTAKAPPDISAGKCSGRVPFAIQAAQLLGRAIGAGLFAITPAGERGMCCKAIKLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106430 - protein, 115 aa, Glycine max
  Coding DNA Sequence Number=SeqID_14745
  Homolog annotation: Hit_ID=Q1J7G7; Match level="QueryCoverage=31%, HitCoverage=64%, E-value=8e-07, Identity=60%"; Hit description =Transposase
WTSYVPINVSFRPKVGPGLPGINRDTRIYLFCEVISVTAVPPVQLLTGWCVTAKAPPDISAGKCSGRVPFAIQAAQLLGRAIGAGLFAITPAGERGMCCKAIKLGNARVFPVTTL

SEQ ID NO: 106431 - protein, 315 aa, Glycine max
  Coding DNA Sequence Number=SeqID_14746
  Gene Ontology: Biological process=transposition, DNA-mediated
  Homolog annotation: Hit_ID=Q6UUU1; Match level="QueryCoverage=19%, HitCoverage=40%, E-value=5e-18, Identity=78%"; Hit description =Putative uncharacterized protein
MVKVGTSYVPINVSFRQKLAQGFPVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIQTAASKGKAIEMEDMDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 106432 - protein, 56 aa, Glycine max
  Coding DNA Sequence Number=SeqID_14747
MAGDWPEAQAGEAPQKLPAMEKKPTRMRRWPICLTSWEGVETRDWEIPRFIAYIFA

SEQ ID NO: 106433 - protein, 132 aa, Glycine max
  Coding DNA Sequence Number=SeqID_14748
  Homolog annotation: Hit_ID=A6FJQ2; Match level="QueryCoverage=28%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPGKRHPETTDFKEQCGGTRPPTFTACTASERTITTRVPQEAVMMDD

SEQ ID NO: 106434 - protein, 82 aa, Glycine max
  Coding DNA Sequence Number=SeqID_14749
MVFFLSYTKAKAENAQVRNGLGHGNIAHTLDIFSKIPMVRSWTSVLVLQQSYFIAYKIVKLVRHGFRKQAKLEWNHIEMQTT

SEQ ID NO: 106435 - protein, 115 aa, Glycine max
  Coding DNA Sequence Number=SeqID_14750
  Subcellular localization annotation: CTP_CleavageSite=42; ConfidenceScore=5.25e-01
MHMTQMQFTNTGAREIVSFLDTTFGQHGTQRMFFKKATRTLRRFAKKNLTRLLQMINICFKNNSRLLQQTKPLFQDSLKTKPCLKTKCFQDMQGSGNRLPGSVIDYQKTGLRNSC

SEQ ID NO: 106436 - protein, 68 aa, Glycine max
  Coding DNA Sequence Number=SeqID_14751
  Subcellular localization annotation: CTP_CleavageSite=54; ConfidenceScore=5.11e-01
MVKVGTSYVPINVSFSPKVGPGLPVAIWFLSAVPSCSATDGELVIRSIRTQALRAGSISAGKCKAWGA

SEQ ID NO: 106437 - protein, 56 aa, Glycine max
  Coding DNA Sequence Number=SeqID_14752
MTKARQKGVRKGKRGRWLPPSSPRRAGLLPPAGTTFCWKILEGPSGPNCYLHTLVY

SEQ ID NO: 106438 - protein, 103 aa, Glycine max
  Coding DNA Sequence Number=SeqID_14753
  Subcellular localization annotation: CTP_CleavageSite=74; ConfidenceScore=5.20e-01
MRSDCLVQFSILNLFRSPMNCVFVQVSPTFEFGAMRSDCLGQFSILNLFGAPGIAFSFRCPPPSSLELCVVIALCNSPFSFFSEPHELRFRSSVPPLRVWSYA

SEQ ID NO: 106439 - protein, 97 aa, Glycine max
  Coding DNA Sequence Number=SeqID_14754
  Homolog annotation: Hit_ID=A5BBN5; Match level="QueryCoverage=96%, HitCoverage=11%, E-value=8e-08, Identity=32%"; Hit description =Putative uncharacterized protein
MIIEESIHVVFYETNPIRPRKKTLDDITNSLEDMHIHKEGHKDKGDENDEDSQIDETKTNTDLSREWRTSRYHHLDNIIGDISKGITTRHSLKDAWE

SEQ ID NO: 106440 - protein, 49 aa, Glycine max
  Coding DNA Sequence Number=SeqID_14755
MTMITPSSKLTLTKGNKSWLKTQVEKDEGLSGEGQSLRVEKDEGPSGKG

SEQ ID NO: 106441 - protein, 72 aa, Glycine max
  Coding DNA Sequence Number=SeqID_14756
MAAEWRRKRERRRHFKEKMSLEEAHHHKRPWIIAWRKKEMNEGRGREEHEIFPLIQDQFQDSPLSVLRCHEA

SEQ ID NO: 106442 - protein, 59 aa, Glycine max
  Coding DNA Sequence Number=SeqID_14757
  Homolog annotation: Hit_ID=A0PAV3; Match level="QueryCoverage=64%, HitCoverage=17%, E-value=5e-07, Identity=76%"; Hit description =Restriction endonuclease
MVKVGTSYVPINVSFSPKVGPGLPGINRDTRIYLFCEVIFRHRCSSGFCFYPLSLLFSY

SEQ ID NO: 106443 - protein, 361 aa, Glycine max
  Coding DNA Sequence Number=SeqID_14758
  Gene Ontology: Mol. function=thiamin pyrophosphate binding; Cellular component=cytoplasm; Biological process=branched chain family amino acid biosynthetic process
  Homolog annotation: Hit_ID=A8ANK2; Match level="QueryCoverage=90%, HitCoverage=51%, E-value=1e-142, Identity=78%"; Hit description =Putative uncharacterized protein
  Pfam annotation: Domain name=TPP_enzyme_M; Domain location=249-360; Score=96.4; E_value=8.9e-26; Accession=PF00205.13; Description =Thiamine pyrophosphate enzyme, centra
  Pfam annotation: Domain name=TPP_enzyme_N; Domain location=36-229; Score=9.7; E_value=4.2e-09; Accession=PF02776.9; Description =Thiamine pyrophosphate enzyme, N-term
  Pfam module annotation: Pfam domain module=TPP_enzyme_M::TPP_enzyme _N; Domain location=249-360::36-229
MKTITRTLAGNAAGDRRCVLHANAGLTGGVMQTERMTMAQALVRFLNQQYVSVDGDEMPFVEGVATIFGHGNVLGIGQALEQDPGHLQVMQGCNEQGIAHMATGFAKQHRRQRIFAVTSSVGPGAANMVTAAATATANRIPLLLLPGDIYASRQPDPVLQQIEQYHDLSISTNDCFRPVSRYWDRINRPEQLMSAMLSAMRTLTDPANTGAVTLCLPQDVQGEAWDYPLSFFARRVHHIERRPPDPQRLAQARALIARKRRPLVVCGGGVRYSGAHEAFREFVETLQLPFAETQAGKGALVSDHPLNLGGVGVTGGLAANQLAPQADLVIGIGHASYGTLPPGSKALFSHPDVEFLLLNVA

SEQ ID NO: 106444 - protein, 291 aa, Glycine max
  Coding DNA Sequence Number=SeqID_14759
LLERNVEIYHTEFDEFKAELERRNFHKLLANLQEGSIDVAVVKEFYANLYILEDQAPKYARVRGHLIKIDADSLNESLQTPVLLEEGESLPAYSRFCILRSDPREMEASLCIPGRGFILNTKGQPWKLFRKDLTTLAQTWSVFSYSNLAPTSHTSDLNTDRARLVYGLITRMDMNIGCLISGQITMVAQPNSSRLGFLALITALWARKTKLRAVDVPSSFTPIAGIPSSSTPAPPPALADPFSQSFQTSNARLHSLFEGPILIIRSLQELAQQRPIMSVEQFIEKVAWPRA

SEQ ID NO: 106445 - protein, 53 aa, Glycine max
  Coding DNA Sequence Number=SeqID_14760
MSRNLTDYAIVPSLAFGMLQNFTDCALTLPFDSRHVAELHGLPNDGRIISNLA

SEQ ID NO: 106446 - protein, 104 aa, Glycine max
  Coding DNA Sequence Number=SeqID_14761
  Subcellular localization annotation: CTP_CleavageSite=53; ConfidenceScore=5.10e-01
MSARWLHKRISILVLYCYHYAPTNKGSRSSQVPTTRYKNCEGKTRQQVSRSPCAAQATPPQGDQPESQGSSKLSDKAPSTSIPPHEKLQVLTDKVYTISISYEV

SEQ ID NO: 106447 - protein, 170 aa, Glycine max
  Coding DNA Sequence Number=SeqID_14762
MDKARFVYGLVTRMEMDVGSFISRQISQMAQSNSSQLGFPTLITARGFVPDSLTFKSLSPAINMAYIRKNCCNPDDPTITYLGTRHFCSFLLCSPCSSSTSTTSSRTSTLRHLRSEHIDLTADTAEPSPWLMPGDAEHSRFGSASNHCEHGGFHGTCGLARSPAFSCGGR

SEQ ID NO: 106448 - protein, 142 aa, Glycine max
  Coding DNA Sequence Number=SeqID_14763
  Gene Ontology: Biological process=transposition, DNA-mediated
  Homolog annotation: Hit_ID=Q1J7G7; Match level="QueryCoverage=28%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDMLNVSTHPTLISLLLCIPPE

SEQ ID NO: 106449 - protein, 36 aa, Glycine max
  Coding DNA Sequence Number=SeqID_14764
MMDTSEPYTGAMKGTMREPQANLGAGGVTNPGILVD

SEQ ID NO: 106450 - protein, 298 aa, Glycine max
  Coding DNA Sequence Number=SeqID_14765
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIQGEGIITVQTDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106451 - protein, 82 aa, Glycine max
  Coding DNA Sequence Number=SeqID_14766
MVARVMLGNGYDPGMGLGKNNGGRTSLICTRGNCGKFGGSQGSQLGRKVKGGPPCHINRSFISAGLGHVGQVVVICEDDSLS

SEQ ID NO: 106452 - protein, 276 aa, Glycine max
  Coding DNA Sequence Number=SeqID_14767
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDGIYNSPFTKKSQGWNSINGKWVVGDGVQYSPAIETEIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106453 - protein, 59 aa, Glycine max
  Coding DNA Sequence Number=SeqID_14768
MGQLQRQAFAKPMGSTPHWPEFLKSPNLGAGIRPPKASRKWGGRNIEKIFGGKSKNLGR

SEQ ID NO: 106454 - protein, 204 aa, Glycine max
  Coding DNA Sequence Number=SeqID_14769
  Homolog annotation: Hit_ID=Q2HW90; Match level="QueryCoverage=88%, HitCoverage=36%, E-value=9e-19, Identity=33%"; Hit description =Putative uncharacterized protein
MGTNQIGKRFYQVKIKGLDVTSLKELGRLMGPLQRQAFRKLYEKILDLTTAEVFTEAVVSLAQYYDQPLRCFTFGDFQIVPTVEEFEEILGCPLGGRKPYLFSGFLPSLSKIAAVVGDSARELDRMKKTRNGVMGLPRKYLEGKARDMANQEECVPCADILALLIFRVVLFPNMDGLVDLAAIDAFLAYHHSKESSVQGEQRTD

SEQ ID NO: 106455 - protein, 160 aa, Glycine max
  Coding DNA Sequence Number=SeqID_14770
MTRGNLGDLQPFDPEIDRTFHRLVRHSMHPGHSMHFGHFELFEHSAYSVAGDSEHSDFEHSTTNFHTENMAQPPPHERTLREMAAPDFTYESFCIQYLDEDVPYVLKTGLIHLLPKFHGLASEDPHKHLKEFHIVCSTMKPPDVPRRSYLSKSFSSFTRR

SEQ ID NO: 106456 - protein, 161 aa, Glycine max
  Coding DNA Sequence Number=SeqID_14771
  Homolog annotation: Hit_ID=A5B4G8; Match level="QueryCoverage=50%, HitCoverage=9%, E-value=1e-07, Identity=37%"; Hit description =Putative uncharacterized protein
MAARHRLAECMTRGNPSDLQPFDPELDRTFHRLVRHHFIPFEHPKHYVTSESMHSVIGDFEHPDFEHYNFEHSDFEHSENMAQPPPRERTLREMAAPDFTYESLCIQYPDEDVPYVLKTGLIHLLPKFHGLASEDPHKHLKEFHIVCSTLKPPDVQEDHIF

SEQ ID NO: 106457 - protein, 74 aa, Glycine max
  Coding DNA Sequence Number=SeqID_14772
MAEVSTEAIAQYYDQPLSQNLDTGIRPQKASRKWGGWGTKEMFGSKGESLGESRQQLMLVLPFTTARKARLSLS

SEQ ID NO: 106458 - protein, 66 aa, Glycine max
  Coding DNA Sequence Number=SeqID_14773
MYPLLVPQRMYPPMCWDKNSQAVSLLNLCKGETKDISGGRRETQKNSGGAKADEGRHGGEENEKDE

SEQ ID NO: 106459 - protein, 33 aa, Glycine max
  Coding DNA Sequence Number=SeqID_14774
MVRITPFCENAPTIWDQHRLKEALKSSVFTPKA

SEQ ID NO: 106460 - protein, 232 aa, Glycine max
  Coding DNA Sequence Number=SeqID_14775
  Gene Ontology: Biological process=transposition, DNA-mediated
  Homolog annotation: Hit_ID=Q1J7G7; Match level="QueryCoverage=17%, HitCoverage=71%, E-value=6e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLTDQAYRYRRPRGGARYQLLFPLVRVNFELGVIMVIAVSFGKPVVPAALMNRPTRGERRFAYWALAECILAYYVGTDEGSVKCFMWQEKKGCTGASAEYVIQDIFRFLAH

SEQ ID NO: 106461 - protein, 144 aa, Glycine max
  Coding DNA Sequence Number=SeqID_14776
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=5e-25, Identity=55%"; Hit description =Putative uncharacterized protein
  Subcellular localization annotation: CTP_CleavageSite=38; ConfidenceScore=5.30e-01
MTMITPSSKLTLTKGNKSWLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106462 - protein, 118 aa, Glycine max
  Coding DNA Sequence Number=SeqID_14777
MSLHSSSSVNGEGSTPKDPLYKILDELRSLKLWKEKQERKEKGKKRVEEISQDEKEKIREKERRKIMKEMKREKHASFSSHDSCKSLSEELSDYYRGRHSSHTKHHSHRREEDNRPPE

SEQ ID NO: 106463 - protein, 109 aa, Glycine max
  Coding DNA Sequence Number=SeqID_14778
MKRIKIKHIIINNMIKYLSMKNRMILGWMFHGIKNVKMNNNIAKFHRQYAKINIYLGSGCKGPRDKELKMDRGMTLTDAPRSSMAFSNLLFLIMQGIQKVPGSLHFSRM

SEQ ID NO: 106464 - protein, 242 aa, Glycine max
  Coding DNA Sequence Number=SeqID_14779
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGSDLKGHLVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106465 - protein, 94 aa, Glycine max
  Coding DNA Sequence Number=SeqID_14780
MTIGSIGFDGPYDVYPPHGKRPRGGHDIQRMWRGIDIVHERLTFMAFPYMGAAITFHEAILLSWVMENSSLTVNHLIQPYFNLLSENQLRVFNT

SEQ ID NO: 106466 - protein, 155 aa, Glycine max
  Coding DNA Sequence Number=SeqID_14781
MGLGKDCLGKADVVDIKGNPYKYGLGYEPGMPGRRNVPSRFRADRVWPGRISQCFTSAGMVSEEEVAVIEEEFPQDPPCFVQPCHPDSQVGNWHVISQSEVYTADSICEGRFFEEPNNEGLTIDFDRDISQTVKRGRGRGRPVTRVGEVGRSGRT

SEQ ID NO: 106467 - protein, 144 aa, Glycine max
  Coding DNA Sequence Number=SeqID_14782
  Gene Ontology: Biological process=transposition, DNA-mediated
  Homolog annotation: Hit_ID=Q1J7G7; Match level="QueryCoverage=28%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSINLVASSNAISIHYMMCPQ

SEQ ID NO: 106468 - protein, 157 aa, Glycine max
  Coding DNA Sequence Number=SeqID_14783
MSDGFCGTHLQIMVRTRGLGSALGHVTARGVGRGDHDDSDDAPQRRRPTASAQRQRVAVTAAHDEPVIPTPDVQDDPMEAPAALEDILADTGAEASEDKHEGFSGGPSDPSVLTLYADHVACSVWTGEECPELKLSSHGRKVHSLGRPVPAIEGLVA

SEQ ID NO: 106469 - protein, 128 aa, Glycine max
  Coding DNA Sequence Number=SeqID_14784
  Gene Ontology: Mol. function=helicase activity; Biological process =viral genome replication
  Homolog annotation: Hit_ID=Q2R1R7; Match level="QueryCoverage=99%, HitCoverage=7%, E-value=6e-32, Identity=50%"; Hit description=AT hook motif-containing protein, putative
MKNGIELDNRFVVPYNPQLLLKYKTHLNVEWCNQSTSIKYLFKYINKGSDRIIATLLNHHTSNGDHSQVQDETKQYLDCRYVSSPEACWKIFAFPMHRRSPAVERLYFHLENQQHVYWTDDQQIGEVL

SEQ ID NO: 106470 - protein, 73 aa, Glycine max
  Coding DNA Sequence Number=SeqID_14785
MSLMVETRLFCGLGRKTLTSPGKVQMTKLVTASYQTLESDGRNKTFSRSQPEDADISGKGADDEVSHCELPDP

SEQ ID NO: 106471 - protein, 107 aa, Glycine max
  Coding DNA Sequence Number=SeqID_14786
MLSGGVGWWQTTCRSRLPRYKRVHKLGGKRVNEWRACPFSDDGNTLQKIASSVVYKLTWFEGRVASMMSGIKGFLNCSNCLPKMCIFTSKGDDFFGVMTMHVQDLSL

SEQ ID NO: 106472 - protein, 29 aa, Glycine max
  Coding DNA Sequence Number=SeqID_14787
MAFLLELEGRLVMGFRKASSVMPSDQVYH

SEQ ID NO: 106473 - protein, 316 aa, Glycine max
  Coding DNA Sequence Number=SeqID_14788
  Gene Ontology: Mol. function=helicase activity; Cellular component =chromatin; Biological process=protein amino acid phosphorylation
  Homolog annotation: Hit_ID=Q9M184; Match level="QueryCoverage=95%, HitCoverage=41%, E-value=7e-83, Identity=44%"; Hit description =Putative uncharacterized protein T5C2_50
  Pfam annotation: Domain name=DUF889; Domain location=235-316; Score= -83.0; E_value=7.6e-06; Accession=PF05970.5; Description=Eukaryotic protein of unknown function (DUF889)
MMISTAKGAQSYSDIRTVNGVVYGTFKETCFAKGFLGSDQEFISALQEANNWGTAHYLRKLFVKILFMNTMDRPEYVWQQTWQWMADDITFDHRKQDEQKTIVDTIIRIVNTQSAVVYFLYGYGGTGKTFVWTTLSSAIRSNGRIVCTVASSGIASLLLPGGRTAHSKFAIPVPATQNSTCNIHQGSELAELLKVTKLIVWDEAPMCHRFAFEALDKSLKDIMPNNLPFGGKIVVFGGDFRQILPIVPKGNRSDIVHATINASYIWDHFQILKLTKNMRLLSSAPEQPDNQELKQFSEWLLDIGDGKIGQDNDGFS

SEQ ID NO: 106474 - protein, 94 aa, Glycine max
  Coding DNA Sequence Number=SeqID_14789
MEIKKETYLFWIDSRSFDDNKNDDKNLKSQDHFMITKMMTFKNEFKIESRTLQRSRGNLISRIKNQDSRFKNNQDQDSRLKDSKIKRRLNQDKY

SEQ ID NO: 106475 - protein, 226 aa, Glycine max
  Coding DNA Sequence Number=SeqID_14790
MAAVRLQLAAAGLPPAAGHAIFLYEGFANGRPDKLGGSDQHFIELAQDHDQSRKPQCPVGLLQVHWVSRRPTDTSAVGGLNYGRWGECLAPPLAKLTMLAFLQDQWMPQKLVDGILIEGDPLAPRPGVFVSNFLLCRPCAGIKLHDYLGIVFSHGLMEACLWGFYGGWIFELQWGLLMVIFHHGDAAEDKEKELGEDASMEEKKEGEKERGGSTKLKEEKGREVEL

SEQ ID NO: 106476 - protein, 147 aa, Glycine max
  Coding DNA Sequence Number=SeqID_14791
MECGANKRIRSLGEAVMGSSAETPEESEEVQALKVELERAQAVKEKFKTMAIKVHKECDELRDINIATTEALEWETKRARKEEWGQNKTKENMWAIIDQYKEKLNLAATHEQRLEDEFAFTLNGSQELPRLLAKAKAMADVYSAPEE

SEQ ID NO: 106477 - protein, 182 aa, Glycine max
  Coding DNA Sequence Number=SeqID_14792
MISPLIKLPWSPQEFGRLRIDPQEIVACLCIPGRGFVLNAEGMSWRLQRRDLTTLAQTWSVLSYSNLAPTSHTFDLNLDRARLVYGSLQEFSKLSSASATHILGGVHSVGGLVAWLGAQPSPIGGGEDSTAQEPRPHQDESSSSSESETVPPEPFIYEANPGTTLEETQEATTPEITPQQAA

SEQ ID NO: 106478 - protein, 74 aa, Glycine max
  Coding DNA Sequence Number=SeqID_14793
  Subcellular localization annotation: CTP_CleavageSite=43; ConfidenceScore=5.29e-01
MQSGSPSWANLSSWAKRISTAKHSFSVLSAKENLTEHQHQRPRAKREISALSIASAFSQAKLETGAKPNFTYSR

SEQ ID NO: 106479 - protein, 185 aa, Glycine max
  Coding DNA Sequence Number=SeqID_14794
MASETEQEAPYQDNELVGLQQVLEVDLVVINESLVDIDGGGEEIDVDLLKQLDLVEPDEDECILMNMKENISDLFWCRKHVYMADRGRCGGRKTFNRGRRCGVSLGVLITTNPSTSSIHISTSELMIHVIAPTPNTLPTTQDQPNPTFVRELIPTTAIGDVSPLALDDSLTPEYPPDPNCEHIVD

SEQ ID NO: 106480 - protein, 87 aa, Glycine max
  Coding DNA Sequence Number=SeqID_14795
  Subcellular localization annotation: CTP_CleavageSite=32; ConfidenceScore=5.78e-01
MASPPASPPPPPPSPPPSDTSASPSTVKRTRKASRLRSLSTRPPGAERPVVHVDPATGNGPHRKKLRTYLGIVARDKVDVTYENWKE

SEQ ID NO: 106481 - protein, 44 aa, Glycine max
  Coding DNA Sequence Number=SeqID_14796
MVVYAILPRRGPITRAMARRLQEDWVRDAGEDPMVLMRLRGFIV

SEQ ID NO: 106482 - protein, 177 aa, Glycine max
  Coding DNA Sequence Number=SeqID_14797
  Homolog annotation: Hit_ID=A7NSI9; Match level="QueryCoverage=27%, HitCoverage=20%, E-value=2e-13, Identity=75%"; Hit description =Chromosome chr18 scaffold_1, whole genome shotgun sequence
MAKLHYCCSRHTVLLNPYHPLCHHAETQEGQQMHNQVNHDVKESRGKIHLQLAQYNCGLILQLIKLDKINDFATYGMEEKVQIYFSEYPYGANGVVIEIGCWIDHTGVCVCVCEEHKVDFKDNRSVDPEKYTFSLTGRKPISLEEKRKLGERYIPLLQTSIPEKKETLTSHFRVRVG

SEQ ID NO: 106483 - protein, 96 aa, Glycine max
  Coding DNA Sequence Number=SeqID_14798
MAIADHVRIQHGSDLPLEFIFQGKRLLMGGFLENTCVSLKKTIQCRVGVNSGSGCDVGRGGVGLVPRAEAGLGCMGTSAHSVMGWFSYVKLIVNDE

SEQ ID NO: 106484 - protein, 173 aa, Glycine max
  Coding DNA Sequence Number=SeqID_14799
MAPRKLPAKRSRKDKAAEGTRATPEYDSHRFRSAEHQQRFEAIKGWSFHRERRVQLRDDEYTDFQEEIARQRWTSLVTPMAKFDPDIVLEFYANAWPTQEGMRDMRSWGRGQWIPFDADALSQFLGYPLVLEEGQECEYGQRRNRADGFDEEAIAQLLCILGQDFAQTAAGRR

SEQ ID NO: 106485 - protein, 150 aa, Glycine max
  Coding DNA Sequence Number=SeqID_14800
MPLEGTLIDDWKPIYSSLDARKMHFKISLTNEPSVKVKRLFTIGAATVDSFSYKKDLDGQWVRKQDYQAKAPDECTPSPPHRDPSSALLNDVLNEIRATCSTTFAKPKNVSRRNQLLIGLSDINTLSAQSLAAEHDQSTELHRTPTTSTT

SEQ ID NO: 106486 - protein, 249 aa, Glycine max
  Coding DNA Sequence Number=SeqID_14801
  Gene Ontology: Mol. function=protein binding; Biological process =protein metabolic process
  Homolog annotation: Hit_ID=A5C486; Match level="QueryCoverage=90%, HitCoverage=29%, E-value=1e-68, Identity=55%"; Hit description =Putative uncharacterized protein
MRGGICSIQLQPLTPEATTVVKQAVNLATTRGHAQVTPLHVASARLATSTGLLCKACRQCHSHPLQCNALELCFNIALNRLPASTSSPVLAPQYSTPSLSNALVATFKRAQGNQHRGFIENQQQHILALKIKVEQLVISILDDPSVSRVMREAGFSSSLVKTRVEQPVSMEVCSQKASSNRSHAKENISCPIIVMSELVRRKNTIIVGEGVANAEGLAREVMERFEENFGSYMEVTKTSINGWKLHGSY

SEQ ID NO: 106487 - protein, 64 aa, Glycine max
  Coding DNA Sequence Number=SeqID_14802
MTFLWKSLKKTTLLEKSRSMSILLGVQRRCTAVFECDVVVDLRPIYDGLQTPFYKDAIPAMGMT

SEQ ID NO: 106488 - protein, 122 aa, Glycine max
  Coding DNA Sequence Number=SeqID_14803
MTSRKRRVVPTPGEASNWDSSRFTSEIAWHRYQDNIQLQNILPERNVELGPGMFDKFLQELRRHRWDQVLTHLPEKRIDVALVKEFYSNLYDPEDHSPRFYRVRGQDVRFDADTINDFVDTP

SEQ ID NO: 106489 - protein, 210 aa, Glycine max
  Coding DNA Sequence Number=SeqID_14804
  Gene Ontology: Mol. function=catalytic activity; Cellular component =beta-galactosidase complex; Biological process=cellular metabolic process
  Homolog annotation: Hit_ID=A2Y3J1; Match level="QueryCoverage=25%, HitCoverage=78%, E-value=2e-22, Identity=92%"; Hit description =Putative uncharacterized protein
MWLPFMRKLVTFSILHISFLLSPNGSMPSLKNLIENEYGAQSKLQGAAGQNYVNWAAKMAVEMGTGVSWVMCKEDDAPDLVILLKSVLIFNPGMDFLYSSVYSQEQPFVTNFILKIEDSIAWFNVPMLSDNYVWLYVNFPKEKPGPEGVRGRKSDNTLIKEKLGWAPTMRLKDGLRITYFWIKEQIEKEKAQGIDIFVLLRWFFKALRGA

SEQ ID NO: 106490 - protein, 223 aa, Glycine max
  Coding DNA Sequence Number=SeqID_14805
  Gene Ontology: Mol. function=helicase activity; Biological process =protein amino acid phosphorylation
  Homolog annotation: Hit_ID=Q2A9E0; Match level="QueryCoverage=74%, HitCoverage=11%, E-value=8e-38, Identity=48%"; Hit description =Putative uncharacterized protein
  Pfam annotation: Domain name=DUF889; Domain location=34-222; Score =74.2; E_value=4.4e-19; Accession=PF05970.5; Description=Eukaryotic protein of unknown function (DUF889)
MAHKFFFQALDQSLTDIIKEKKNPNQIFGGKVIVFGGDFRQILPVIPRGSCSDIINATINSSYLWPSCEVLTLTKNMRLQGNAQSIDDQETTKFAKWILDIGDEVIGNQNDGYATVEILDYLLITEYNDPIDAIVKSTFPDLYQHHNNPQFFKSRAILASTNETVEERCNSGDYGAIDNDGGGSNVNSDDKSHYVTMTITLVTTNSINDNSNDGDGDNGRLWM

SEQ ID NO: 106491 - protein, 92 aa, Glycine max
  Coding DNA Sequence Number=SeqID_14806
MDMHGQMLRSIHVGQQLIMQNMHRLSLHLQMDPPLITPEAYRQQVAWPGDQPSTDRGEEPSGAAEDPAVDEDLIADLASADWGPWADLGGGS

SEQ ID NO: 106492 - protein, 87 aa, Glycine max
  Coding DNA Sequence Number=SeqID_14807
  Subcellular localization annotation: CTP_CleavageSite=48; ConfidenceScore=5.09e-01
MDKWICRNMPFCGRAKARLTGALSKGGKMRGVTTNVDKSGALAPTYPPSKRKSDLRSSFLRVNHMISFYLKGDHLKVLDLKNDPLTW

SEQ ID NO: 106493 - protein, 64 aa, Glycine max
  Coding DNA Sequence Number=SeqID_14808
  Subcellular localization annotation: CTP_CleavageSite=16; ConfidenceScore=5.08e-01
MRTRSPLKARACSPLQARTYSPLKVIGTSTQGSTFMRKQEIDSSRGQLFMGQMKKYTKKAMETF

SEQ ID NO: 106494 - protein, 82 aa, Glycine max
  Coding DNA Sequence Number=SeqID_14809
MGGDRKQNGIDIGLRLGQQRVVRSQRQKFWIRREEGKNLLKQNVYFADEKKCGGGLAAQMESGDRKDLSGGASFWFLVGSGI

SEQ ID NO: 106495 - protein, 94 aa, Glycine max
  Coding DNA Sequence Number=SeqID_14810
MWSKGPRINEALGLNPELGLDLKRTLLLCCLFILHLWVSYRREVFCQFQKSFVEHSYKGRKKRRGISANGDSRHWQCTMADYWREKIKGKSGRS

SEQ ID NO: 106496 - protein, 110 aa, Glycine max
  Coding DNA Sequence Number=SeqID_14811
LSYVVARGPQVYPSNLPNNWYQSRWFKLVTGSDEYASIAGGQNGERHSVPRRWSGVARMASGQDKYRRWSWLYSWMIKTFARGGDYHVKETHTCRGDVLGYKCEVKSHIG

SEQ ID NO: 106497 - protein, 139 aa, Glycine max
  Coding DNA Sequence Number=SeqID_14812
  Homolog annotation: Hit_ID=A2Q320; Match level="QueryCoverage=25%, HitCoverage=11%, E-value=2e-08, Identity=72%"; Hit description =Epoxide hydrolase
MTEVGTEYVVKSILTTHKSGAPILPKGEFGTGINPDMEFDDVKVWDIWDGWDDKYTCCENLISDVIFRYPDISRYDRISEVYDRSWDIAFVFKFDGDKESIKGFWVLPLYATASGFKQETFESESIDGEQLPALKRRRA

SEQ ID NO: 106498 - protein, 47 aa, Glycine max
  Coding DNA Sequence Number=SeqID_14813
MQDSIENIIDVKADGFFTRPLSFTTIGVVVEYTLSFSGKAVAHPVHR

SEQ ID NO: 106499 - protein, 167 aa, Glycine max
  Coding DNA Sequence Number=SeqID_14814
  Homolog annotation: Hit_ID=Q6WAY4; Match level="QueryCoverage=92%, HitCoverage=28%, E-value=2e-17, Identity=34%"; Hit description =Putative uncharacterized protein
MGQLQRQAFRKAYGKIWDLAMAEVSTEAIASLAQYYDQPLRCFTFGDFQLSPIVEEYEEILGCPLGGRKPYLLSGFYPSLARASKIVQISAQELDHRKQVENGVVGVPRKCLEAKAQILAGRGEWAPFIDILALLIFGGVLFPNVDGFVDLAAIDAFLVFHDRKESP

SEQ ID NO: 106500 - protein, 236 aa, Glycine max
  Coding DNA Sequence Number=SeqID_14815
  Subcellular localization annotation: CTP_CleavageSite=75; ConfidenceScore=5.14e-01
MTCPYESLPYSSTPRFVFYLFFFLIVPLLLISSSFLFASCHAHCWFLRRAPLCFIFFVAAQCWLLVVLVGFIFFQAEQLGRRQASDDDNDAPNGEDLPHLAACNDIKSVLLRILLRLQRNCTKSSKKHLLRILLLMRDYEIHIALRIWNGEERPELKLSSHGRKMAKFRRPAPKIEGLVNASRLSPLIVYSLDTGDRGLMSAFVECWHKETSSFHLPVENVGSSGLEIIKKGGGLN

SEQ ID NO: 106501 - protein, 46 aa, Glycine max
  Coding DNA Sequence Number=SeqID_14816
MDICNEQETLCCQEKETLFHHSSVLAGGATLAARRLVEENGILKVN

SEQ ID NO: 106502 - protein, 106 aa, Glycine max
  Coding DNA Sequence Number=SeqID_14817
MGHILYRITILSYNCIGIKKGDDSWVKKGAQPNDDEGQLPVEGDSSLLQSILDRFDGLQTYVGERFDALEQQIDMQFDAMDSRITKVEEDVTIIRDCLDLPPPPSV

SEQ ID NO: 106503 - protein, 194 aa, Glycine max
  Coding DNA Sequence Number=SeqID_14818
MGPKSTLRLIRTLGPSLASLAHSTWGLLSNALAGQAFPPHALLSRVNLAGSHHHAQPPCTAIDFPETGEHYRQTTAPPPQPPLYNRRLAANLVREFADLVTTLLYDVSYCSLALSFSKENVWVLQLDLEFGLKHRMESVEVVGIVGGGWSCRQAESAEGGIVGEKEGEEAEGEEAKEKRMKERERRENDVTLMC

SEQ ID NO: 106504 - protein, 134 aa, Glycine max
  Coding DNA Sequence Number=SeqID_14819
MRKVGYVQTIPPHSSTSRLCLEDIDDRWMHFSEYLAPVGQIYVVSGQCAPDYIDWFYMISHPFMRMAQPGDPVRHPPVVQDDTYDACQAIAERLEQLLNLRIVTKGIEAYSVMEECLRITRGVTMKRNVYVRSR

SEQ ID NO: 106505 - protein, 336 aa, Glycine max
  Coding DNA Sequence Number=SeqID_14820
  Subcellular localization annotation: CTP_CleavageSite=40; ConfidenceScore=5.65e-01
MSSGGVDPPRDSLTSSTSSSSSVSILVRSPDVAPIQSPPPTEARQSSCHVNARGPSLEPTPTPSPSSIDARGPSPVPTSTPVPSPPVGNMPTDEDAINLATEEPLPPPPPLNDLLMVTLINGSQVEAKAATLSIRQQFGQPWPTWGAIPKDHHELFPSILRMLEMKIKGHIGLEIVFGTIYYHIRMHLSIFPSVHRPKTIGHMKSEGVYTQVVLSACKIMPFACQMSLVDQYIWMRFFSKLIYERILEEFEARLSQARSDVALSVGESQLTPLDPDEEQRLRSRYLVHTYKCGNDNFMQHTQGSSSHAEDAVEINCLKEELHQSKEEMHVFQSVVF

SEQ ID NO: 106506 - protein, 137 aa, Glycine max
  Coding DNA Sequence Number=SeqID_14821
MVSLGYGMTETSGGGGVMLMEGARQKVRTVLMTEVEAANPTTTVREKRDGASGVAIEERGGGVLQTEMKKHIDGENPGGEAREVGGVSVSVQGQGTKWRVVVAAPERSNALGTWSFWKTMVLEQEHEYNDCRRRLPK

SEQ ID NO: 106507 - protein, 71 aa, Glycine max
  Coding DNA Sequence Number=SeqID_14822
MVCLLMKKMRGVTTSVYSRKTLEKPKRQRSADFEYKGSGVVYARRRRWTLKQPQVMFDEKRRESLWCWTLK

SEQ ID NO: 106508 - protein, 307 aa, Glycine max
  Coding DNA Sequence Number=SeqID_14823
MAEAHSLSEPHVLSPKPYWPQASKPVWWLKELRLTSLTFWVCDELAKRGCFANESHSLSHWSLLAKRVSGAKPLLLELCCRAKHTLRAKRLMVTLQDWLSEPCLKSPMIHPDSCLKLLGSDMRQIAPPVAQEPHAAMENHIDLALVKKFYSNLYDPEDRSPRQCKIAQSNSSRLGFPALITALCLARGVVSDFLTFESLSPAINLEYILKNYWNPDDPSITFLGSRKAKVRAPSADAPVPPPPAPAPVGPSMSSTANNDHIMPMLQSIHHGLYLAAEGTPEDEEAAEDTLEAQNTTQEAKEDIGAAE

SEQ ID NO: 106509 - protein, 84 aa, Glycine max
  Coding DNA Sequence Number=SeqID_14824
MTAKVTYSEKLMMVMQEWCVRMSMEVMGSMVRQNDDDGRRWRVSGDGGMSMMEQVLSGGVDGVEWCDGGYGVGGSKIEEEGEVA

SEQ ID NO: 106510 - protein, 537 aa, Glycine max
  Coding DNA Sequence Number=SeqID_14825
  Gene Ontology: Mol. function=endonuclease activity; Cellular component=cytoplasm; Biological process=regulation of transcription, DNA-dependent
  Homolog annotation: Hit_ID=A9PF97; Match level="QueryCoverage=96%, HitCoverage=91%, E-value=0.0, Identity=71%"; Hit description =Putative uncharacterized protein
  Pfam annotation: Domain name=Exo_endo_phos; Domain location=218-528; Score=84.4; E_value=3.7e-22; Accession=PF03372.14; Description =EndonucleaseExonucleasephosphatase family
MSVLVEENLSLPVNITGSDTWYRVQSDKKVAVCSIHPSEQATLQCLGCVKAKIPVSKSYHCTTKCFSDAWQHHRVLHDRAASALNENGNEEEEVFGRFNSTGSGATNSSLSASASSASLTNGSATPLYPAAITQRSGETWFEVGRSKTYTPTADDIGHVLKFECVAVDAETKLPVGHVNTILTSRVIPAPSPIPRRLIPVDGMAHLDVDGRMTSSGTFTVLSYNVLSEAYASNDLYNYCPSWALSWPYRRQNLLREIIGYRPDIICLQEVYSGNTNTIDGCATFFRRDRFSHVKKYEVEFNKAAQSLTEATIPTTQKKTALNRLDNVALIVVLEAKVNNQPFDNAGKRQLLCVANTHVNVSQDLKDVKLWQVHTLLKGLEKIAASADIPMLVCGDFNSVPGSAPHALLAMGKVDPSHPDLAVDPLNILRPHSKLVHQLPLVSAYTSFARTVGLGYEQHKRRLDGGTNEPLFTNVTRDFIGTLDYIFYTADSLVVESLLELLDEESLRKDTALPSPEWSSDHIALLAEFRCCKNKSRR

SEQ ID NO: 106511 - protein, 211 aa, Glycine max
  Coding DNA Sequence Number=SeqID_14826
  Homolog annotation: Hit_ID=A2Q4P8; Match level="QueryCoverage=20%, HitCoverage=18%, E-value=7e-09, Identity=65%"; Hit description=IMP dehydrogenase/GMP reductase, related
  Pfam annotation: Domain name=DUF1723; Domain location=1-44; Score =25.8; E_value=0.00016; Accession=PF08330.1; Description=Protein of unknown function (DUF1723)
MSAFVKRWHKETSSFHLPIEEVTITLDDIASLLHLLIVGAFHSFELLHVDDAVDMLVELLESESYAWGTAILVHMYDNLNDASKSTVRQLDYDERRPRACRWTSGKALLVSTYRRHLDRLTPDMFGYIQTIFPHLTASSLSAKEIDDRWMQFSEYIAPVGQLCVVPDHFLADYMDWFYMISHPFMSPAQSGDPHRVSPIQQYDTFVEPNVY

SEQ ID NO: 106512 - protein, 90 aa, Glycine max
  Coding DNA Sequence Number=SeqID_14827
MPTTELVCLCLASVLELYVSNAVLFDMVGNLRVLLCATSFAHDDINESRTHLIGEDGDVRACDAEPLAWHRVTIIPIGESGGAKGIHDGL

SEQ ID NO: 106513 - protein, 71 aa, Glycine max
  Coding DNA Sequence Number=SeqID_14828
  Pfam annotation: Domain name=zf-CCHC; Domain location=46-63; Score =14.2; E_value=0.011; Accession=PF00098.14; Description=Zinc knuckle
MCVQEEERLIMEEGERVNLTIHGKEKGNQPKNKGKIPAQSVIKKESKCFFCKKKNHMKKDFLKFKSWMDKK

SEQ ID NO: 106514 - protein, 215 aa, Glycine max
  Coding DNA Sequence Number=SeqID_14829
  Gene Ontology: Mol. function=catalytic activity; Biological process =metabolic process
  Homolog annotation: Hit_ID=Q53E54; Match level="QueryCoverage=84%, HitCoverage=30%, E-value=1e-71, Identity=71%"; Hit description=Male sterility protein 2-1 mutant
  Pfam annotation: Domain name=Sterile; Domain location=127-209; Score =50.0; E_value=8.2e-12; Accession=PF03015.10; Description=Male sterility protein
ALTTVENRRDMAIRTDLKSNFSSSGSTGCADMVVNATLAAMARHGMNQKPDINVYQIASSVVNPLVFQDLARLLYEHYSSSPCIDSMGRPIQVPLMKFFSSTEEFSGHLWRDAIQKRGITAMASSKAKMSQKLENMCRKSVEQAKYLANIYEPYTFYGGRFDNSNTQRLMESMSEEEKREFDFDVKSIDWNDYITNVHIPGLRRHVMKGRGMGSQ

SEQ ID NO: 106515 - protein, 63 aa, Glycine max
  Coding DNA Sequence Number=SeqID_14830
  Gene Ontology: Mol. function=aspartic-type endopeptidase activity; Cellular component=chromatin; Biological process=RNA-dependent DNA replication
  Homolog annotation: Hit_ID=A5AP28; Match level="QueryCoverage=100%, HitCoverage=15%, E-value=3e-13, Identity=45%"; Hit description =Putative uncharacterized protein
MDFIGGLPKAQGKDTILVVVDRLTKDRLFMSLFWKELFKRPGTQLKMSTAYCPQIDGQTEVVN

SEQ ID NO: 106516 - protein, 253 aa, Glycine max
  Coding DNA Sequence Number=SeqID_14831
MEEEVDPSMKREKHKENSVKNVGCTDHFLDNPIPKLIKKEAEAGDATKPHSFQDSDFHKKIVMIKQKSLLGLNSIMKVDGTLMMLEPCYVNLLGEPLALNFVMSMAEILAVELRQKECTEAVMLQGMQLSSNNQRKLEEVSVCNSSFQIPTLRTRLIFRRGVLLGCKEKGKLVKIRNLGALVAALAAKGDTLRLGVGERGEAGVAGGAGGGGGGVADSGGGRVYEVAGGDGASGEDRAAHGLGERDSDGRRRR

SEQ ID NO: 106517 - protein, 152 aa, Glycine max
  Coding DNA Sequence Number=SeqID_14832
MQSLESKLKRERIQNPQSKRHNGNGKWKTGKACSNGNEKTFLGGKLDRWHGDPLALAMPRQHCQGLVCIMIDDKKVGDRNVVVVPLRCHDSLNVVGNEVLGREAVAHATCAHGDGVTDANDVEVEGHHAGGDAVSHGLEEVEVHVVGVALVL

SEQ ID NO: 106518 - protein, 240 aa, Glycine max
  Coding DNA Sequence Number=SeqID_14833
MSLHDVHVCNTVDYDIHHVQSPDLENMTDSPMLFTFGMTYQFKVVFHIDRNIIEVPSLYHKQWAPDYPNYVVLDYNGNKHHIRVRKFNNRVYIVDGLKHFRRDMRIYEGVMITFAAPDKNWKFDIHFSPPLHAQACGKPPHYAREYVFTMDVDNRMIVRLYPLVTLWRQYIIVLGVRGRRHFWKLSIHNGLQCLAEPWFQLLTENDLMVGDEVVFYFRPNQLLWEVIARKQTVWDEDDSP

SEQ ID NO: 106519 - protein, 361 aa, Glycine max
  Coding DNA Sequence Number=SeqID_14834
  Gene Ontology: Mol. function=helicase activity; Biological process =viral genome replication
  Homolog annotation: Hit_ID=Q2A9E0; Match level="QueryCoverage=99%, HitCoverage=33%, E-value=3e-57, Identity=46%"; Hit description =Putative uncharacterized protein
MWYDERINKDKQTKNPKFSLCCGDGKIQLPILHDALQPLRQLLFDSRDSQAKKFQQNICLYNLMFAFTSPGVKVDTSYNTGRGPPTLRIHGQSHHLIGSLLPMPDNSPKFAQLYIYDTENEVNNRLSQYPIKNNVDEDIIIGIKNMLDTHNPYAQKFRMARDKLESSAVCDLKLKLISDRQSDGRLYNLTNASEVAALIVGDEHTVNNRDIIIEKQTGMLQRINELHPAYLPLQYPLLYPHGEDGYRPNILHKDHPNNHAAKRNKSQKLNYVRQHQQELRVDKYINLNDCNNQPLTQGNEKVVYTIERQKRGLPHAHILIFLHPSNKYPNPEDIDNIISVEIPNKDAHPELYQIVSNHMMH

SEQ ID NO: 106520 - protein, 206 aa, Glycine max
  Coding DNA Sequence Number=SeqID_14835
  Pfam annotation: Domain name=G-patch; Domain location=37-81; Score =15.2; E_value=0.0027; Accession=PF01585.14; Description=G-patch domain
MYVEAAEESLETAFQSFEVVSNASVESLPMRPPMSNAMMMVARVMLGHRYEPKMGLGKNNDGVASLVEFKENHRRFGLGYRPTRANVRKSALERRSKGMDQQQRPQVKEAPPCHISKSFVSAGWRSDDESCKGINTEDPDVNFERIASQAEDGEDEDAGFPLELERMVTQEDREMKLHQKETEIVNLGVGEERKEVKVGRGMTTPV

SEQ ID NO: 106521 - protein, 267 aa, Glycine max
  Coding DNA Sequence Number=SeqID_14836
  Gene Ontology: Mol. function=histone-lysine N-methyltransferase activity; Cellular component=nucleus; Biological process=chromatin modification
  Homolog annotation: Hit_ID=A7PXL8; Match level="QueryCoverage=26%, HitCoverage=3%, E-value=2e-16, Identity=63%"; Hit description =Chromosome chr12 scaffold_36, whole genome shotgun sequence
  Pfam annotation: Domain name=DUF827; Domain location=91-178; Score= -84.4; E_value=0.00038; Accession=PF05701.2; Description=Plant protein of unknown function (DUF827)
MSIWHTSVHNGEFVPPEKPVMMSRRSEIENGEIAGERWKKGEAERGEFVSGKWRKLVSNFLILQDRLVAKIRQSATESPNPKPEVGEIDTSPPFQSVKDVVSLFGEGAFSGEKPIFKKAKPYSAEESDKLADMKVAAAKAQVEAVKASENEALKRLETTQKEIEDIKGGSPSYLPGENPRSKQLYDARKSSSILSRDAQTRRWSIKKSESGYNRMEQFLASRLREIMKANSCDFFMPKGFGGEEGRMGVEEECGVEGGGGTEKKMKR

SEQ ID NO: 106522 - protein, 605 aa, Glycine max
  Coding DNA Sequence Number=SeqID_14837
  Gene Ontology: Mol. function=RNA binding; Cellular component =intracellular; Biological process=mRNA processing
  Homolog annotation: Hit_ID=A7PW23; Match level="QueryCoverage=82%, HitCoverage=25%, E-value=1e-177, Identity=63%"; Hit description =Chromosome chr8 scaffold_34, whole genome shotgun sequence
  Pfam annotation: Domain name=S1; Domain location=526-597; Score=47.1; E_value=6.1e-11; Accession=PF00575.14; Description=S1 RNA binding domain
MAPHSKKPQKKNDSVDKPKIDKASKKIFKPKKREQNIAVAAAKSEALSLPLEDEVPDFPRGGEFSAKGRNDYDEFGAEDPSKKTRKKKKGKNASGKSNEAADDWGSLSGNGITGKLPRRVNKITLRNITPGMKLWGVVAEVNEKDLVVSLPGGLRGLVHASDAVDPIFDDKIELVSCVVLRLDDDKKEKGSRKIWLSLRLSLLHKNYNLDVVQEGMVLAAYVKSIEDHGYILHFGLPFFMGFLPKNSSAGKSQAPAVNLLLILSGMIEPSSICEGWGGEVKIGKLLQGLVRSIDKVRKVVYLSSDPDTITKSVTKDLRGLSIDLLVPGMLVNACVKSILENGVMLSFLTYFTGTVDLFHLQNIYPGKNWKDKCSESQKVVSRILFIDPSSRAVGLTLNPHLVQNRAPPSHVKIGDIYDNSKVVRVDRGLGLLLEVPSIPEPTPAFVSISDIAEEIPKLEKKYKEGNHVRVRILGLRYLEGIATGVLKVVIVFLFGEWVMWRMRMGYLERWRESASALEEEVFTHSDVKPGMVVKAKILSVDSFGAIVQIPGGVKALCPLRHMSELEISKPGKKFKVGAELVFRVLGCKSKRVTVTHKKTLVCFYM

SEQ ID NO: 106523 - protein, 125 aa, Glycine max
  Coding DNA Sequence Number=SeqID_14838
MRIVASCLHWIQERRVPTAAQVVEDEDLETIGKNLFKEKLKLLKTKLWGWHVEVFDGLGANINSKVEELEVVKTRLCVRVEDVGGRRLILSKEFWRSLKKWPKNIGWDGFMRVMKNSMFFHSSLK

SEQ ID NO: 106524 - protein, 132 aa, Glycine max
  Coding DNA Sequence Number=SeqID_14839
  Subcellular localization annotation: CTP_CleavageSite=74; ConfidenceScore=5.22e-01
MSVIVQSKEPFGVSIRKTKDTKKGGQKAFGSPGPPDNFKAKGLAFLGELTTSRLSFSSPRRVATAPRWPFDEDMAKTKGKEPLEGIGRPMTSARTKKAKEALQQVLTMLFEFRPKLQVEKLQIVNCTMFQEE

SEQ ID NO: 106525 - protein, 545 aa, Glycine max
  Coding DNA Sequence Number=SeqID_14840
  Subcellular localization annotation: CTP_CleavageSite=32; ConfidenceScore=5.44e-01
MSFISDFATGMGGSDSGVSRRVVGGTSRLRTRAQPLASSLDREPVLVTMILPPMFLGKQEGVMVGTLALPSCAPEPQDNVLKYRSSLTSMVSVATLQHQVKLANPEGSGMLAVQACGSDDFLFLRAVSGSLPLSAFQCALLEHLNVATSQLHPNSWFLVKHDEPSSGIVPLSTVIPPTGEGVVEVSPSMPSSILAKRKCDNDTRVSGRKKSRAPSSLRAVRQAGLPMAPSTVQAPASAAPAVATHAPPPSPVAFVQEISTSLIAEVSASAALVGPVMAPPSTIVVPLLSASVATTSAPEMPPLPFSTPLVSPSAVLASTSPSFSSHPNLPLEKYGDLRGEWITTPGGSEQSGILGGWVKRLKVANTTVAFDEPMRSNHRLSSKVGSVLAKFLCSRLDGDELFERYKGLWREKNELVGEVESATAEKDKLTKVVADLEAQLKESESELEEELLIYKKEAVEENEKDFHKAIRQVGFFDKDLDLGLFDPFKDMRDVVLLDKKDIVAKKEDAVEEQDVRASLADQSGGNLLCLVELGPLAILIVVPKE

SEQ ID NO: 106526 - protein, 141 aa, Glycine max
  Coding DNA Sequence Number=SeqID_14841
MYKTKGVEPNPRVERNKKKENPRGFTLAHLRRKLIRPGARGKCPKTIMKVGSKLHDESRLIQRSFDDNKGDDKKLKESKDEFKMFKIESRTLQGSRGNLISRIKNQDSRIKIQGSSFQESRSRFKIKIQESRSRFKNQEKN

SEQ ID NO: 106527 - protein, 118 aa, Glycine max
  Coding DNA Sequence Number=SeqID_14842
  Subcellular localization annotation: CTP_CleavageSite=26; ConfidenceScore=5.37e-01
MQHTPVAIAYVSLVKWSTNGVECQLQCKARNHSVFRSRRQKTPRKEGKRVFSLFFLGPSSPRTAFGSPGPPNNFTAKGLARLCELTASRLGDMQSPQGGLLPINRHPMGVLKGSKVQK

SEQ ID NO: 106528 - protein, 97 aa, Glycine max
  Coding DNA Sequence Number=SeqID_14843
MSSTHFFINLQPSFKIKCFLLVFGAILGVGTALDELDVLDLGIADVGSDDDVGAGKDRGVIDLALLEWERGWRKEKREVGVLEALLEWAVHDTEGYS

SEQ ID NO: 106529 - protein, 341 aa, Glycine max
  Coding DNA Sequence Number=SeqID_14844
  Gene Ontology: Mol. function=prenyltransferase activity; Cellular component=integral to membrane; Biological process=bacteriochlorophyl l biosynthetic process
  Homolog annotation: Hit_ID=Q1ACB2; Match level="QueryCoverage=100%, HitCoverage=85%, E-value=1e-154, Identity=84%"; Hit description =Homogentisate phytyltransferase VTE2-2
  Pfam annotation: Domain name=UbiA; Domain location=119-337; Score= -18.2; E_value=0.0019; Accession=PF01040.9; Description=UbiA prenyltransferase family
  Subcellular localization annotation: CTP_CleavageSite=56; ConfidenceScore=5.61e-01
MELSLSPTSHRVPSTIPTLNFAKLSSTKATTSQPLFLGFSKHFNSIGLNHHSYRCCSNAVPKRPQRPSSIREKKLMGFAEQFMACTGVGAAGSDRPLAERLLDLKDACWRFLRPHTIRGTALGSFALVARALIENTNLIKWSLLFKAFSGLFALICGNGYIVGINQIYDISIDKVNKPYLPIAAGDLSVQSAWFLVIFFAAAGLSIAGLNFGPFIFSLYTLGLFLGTIYSVPPLRMKRFPVAAFLIIATLKRLTEEAYAELPLGLHLNGGGSPVVFITTFVTFFALVIAITKDLPDVEGDRKYQISTFATKLGVRNIAFLGSGILLVNYIVSVLAAIYMPQ

SEQ ID NO: 106530 - protein, 77 aa, Glycine max
  Coding DNA Sequence Number=SeqID_14845
MICEKGRYNKQKGVEIKKKRRKSEEAQVQQGDHPSIDRGEGPSGAATEDPAVDEDLMADLAGADWGPWADLGGSAGH

SEQ ID NO: 106531 - protein, 123 aa, Glycine max
  Coding DNA Sequence Number=SeqID_14846
MSASFVHRLPRIPRSEAFIFAFNLCEAMPEKFICEVSFKFPKRPAILEISFQPCKNHFTSKDPQGMYPPLFSLNNLVDVSSTRTDPQEMYPLLFSVNNPSRCTLYLYHKGCTLQCVKTKFSGG

SEQ ID NO: 106532 - protein, 47 aa, Glycine max
  Coding DNA Sequence Number=SeqID_14847
MTKSKGKDPLEGLGGPMTRARARKAKEALQQVLSILFEYKPKLVGHY

SEQ ID NO: 106533 - protein, 38 aa, Glycine max
  Coding DNA Sequence Number=SeqID_14848
MVVWKGPVTRTMSKRLQEDWARAAEEGPRVLMNLRVDF

SEQ ID NO: 106534 - protein, 260 aa, Glycine max
  Coding DNA Sequence Number=SeqID_14849
MLGGHVWQDIVGVVTDLIDVKTVNPPHRMTVRLRDNNNCDILMTVWEDYAIQLHDAIDKNLLLQEPLVVMLTLGKIKDATGEINNLRQDCYYLTVGTVDEIIIDAPWSYDSCPNCTTTFDPSKDGSACHSCQNSVTNTVPRLAMIIFCSNYLLTCFTVLPNFPDTAMDAKDGDDIKVFPTCVDEILSKTWAVIFKFCSQLRQSSVLDVSEEPHHIQTLIATLGLKEQSSKGKAIAVEPKSSPPIFLPTMLITLPGMQLPV

SEQ ID NO: 106535 - protein, 133 aa, Glycine max
  Coding DNA Sequence Number=SeqID_14850
MEFGFRFRVRTYRLRVDKVKIEFQTRRAKKQRDEEGNGFFFVKPNGEQRNPNTENEIRRKRDSELPSPSIEPRKHWKSFVDRRERERDRQREIQMKSRRCSGEPEGPVRGKAGTRRVWGRGQWVETVDCKGTD

SEQ ID NO: 106536 - protein, 296 aa, Glycine max
  Coding DNA Sequence Number=SeqID_14851
MNGLRFEKKDSRVVYARGRVDLDLVNTDRVLTWLTILSGRGAHIKKEGGPWVCQALDQKHVCPGFCQVCGVVLRLTKDGPWILWTCKDWQAWEHRFEESCVQHKCCALAYMALSVGVGLTKGRPWVLRALWRIDQGIVQLGFWEPCSCIHATRRGRHNDVLLHVCHSLWVAHTGGLVGLIRVLMRTCHSSWVTYTGVTMLGEGLTKGGPWVLRASEVSYDPEGTFPVGTKLSRSGIFSGFTSDSPYESPCRWFPNFKGDHSVCAICESGPEDDSISYLCLSVSLRMFDRDDYVLDA

SEQ ID NO: 106537 - protein, 93 aa, Glycine max
  Coding DNA Sequence Number=SeqID_14852
MAYGRPYLQMRCFQWSRYVHSPHGEGLRGAQIVKVIGRSVWEFGFSYSMTIISSTSMVGVWSVSWMMVLRCPTFLVLTNLNSRSTWVLLSLGM

SEQ ID NO: 106538 - protein, 152 aa, Glycine max
  Coding DNA Sequence Number=SeqID_14853
RHPLDPEKSNKALGFSALITGLCQFYGVLVTPSKVIQPPITQAFIEKYCTPRQAQGDTQQAADAPTPQQPDPVRPLSVEQYLRHVVRQQAANHRGEQFRAKVAWPGDWPTEEGTGPARSPGKAEEAHMDEDMTNLLGYLGEGGATRPRSPHL

SEQ ID NO: 106539 - protein, 110 aa, Glycine max
  Coding DNA Sequence Number=SeqID_14854
MTKLRVTITKTLYQASDEHKESMGCLTLDKLFVMSGGLALRKWMMDRDTLGYSGRRGLTLPILMGFETMLFELGDEGLVYNVSEQRTHPYNQQLLGIDDVEYTEASTGSM

SEQ ID NO: 106540 - protein, 79 aa, Glycine max
  Coding DNA Sequence Number=SeqID_14855
MVKKPTRLGELITSAPSFNSPGRLMGVLKRLEGQKLRELREERKNKKKEEEMKPRCYRIATAIIPYVIFWFCILRATVG

SEQ ID NO: 106541 - protein, 43 aa, Glycine max
  Coding DNA Sequence Number=SeqID_14856
MITERHLKKLGIRFVDHEWIMVGESAGRNVEEMEEDDEVEAQH

SEQ ID NO: 106542 - protein, 148 aa, Glycine max
  Coding DNA Sequence Number=SeqID_14857
ERSGYRYIEQLTEMPQNVLTMPLGYINGVGTSYVPINVSFSPKVGPGLPGNGVIRNGKSTAGHQAASVKRVHWLSYTTPAALNALPLQAAPIPSGKPAATVMRNGRSSAGLCVFASWRKGDVSRRLSWVTQGVPSERASVAGEKTTAS

SEQ ID NO: 106543 - protein, 91 aa, Glycine max
  Coding DNA Sequence Number=SeqID_14858
  Gene Ontology: Biological process=transposition, DNA-mediated
  Homolog annotation: Hit_ID=Q1J7G7; Match level="QueryCoverage=36%, HitCoverage=47%, E-value=1e-10, Identity=90%"; Hit description =Transposase
MVKVGTSYVPINVSFSPKVGPGLPRYQQGHQDLSILRSDLPSQVLQWFLYLSAVPPVQLLTGWCVTAKAPPDISAGKCSGHAARNHHSRRA

SEQ ID NO: 106544 - protein, 67 aa, Glycine max
  Coding DNA Sequence Number=SeqID_14859
  Gene Ontology: Mol. function=structural constituent of ribosome; Cellular component=ribonucleoprotein complex; Biological process =translation
  Homolog annotation: Hit_ID=A9P8K6; Match level="QueryCoverage=50%, HitCoverage=21%, E-value=1e-08, Identity=82%"; Hit description =Putative uncharacterized protein
SKKTRKGKSPRKGGNQFWKSIVLGFKTPREAIEGFKYLPTIVLCEDSVPLMVEAKDTNCLSCCSKFK

SEQ ID NO: 106545 - protein, 141 aa, Glycine max
  Coding DNA Sequence Number=SeqID_14860
MARGGTGLMGSMRTAAGRRVRIMRINMTTLTQIWMTLLLSNILPTDHNSDLPLPKCQLVYAILTRMSIHVAQLIADAIYIFAGMAPTRHPLDPDKSNRALGFPALITGLCQSFGVPVAPTKRIHFCLDCCVSVYIITINDV

SEQ ID NO: 106546 - protein, 141 aa, Glycine max
  Coding DNA Sequence Number=SeqID_14861
MGDQEETQEQMKADMSALKEQMASMMEAMLGMRQLMENNVATVAAVILAAKADPTLPATAHHPLPNAPDEVHEDHQEYAQGDVDFYTPVPVEGPMPNILPQHNLTTQPIFLSTEGPPPTAEERRKLDLIEERLRAVEGFGD

SEQ ID NO: 106547 - protein, 55 aa, Glycine max
  Coding DNA Sequence Number=SeqID_14862
MTPVTRKAGTGERTREPPGGNARGAEPMEKRLCRGPLSSLLSIFMASSRKCPSRS

SEQ ID NO: 106548 - protein, 497 aa, Glycine max
  Coding DNA Sequence Number=SeqID_14863
  Gene Ontology: Mol. function=alcohol dehydrogenase activity; Cellular component=membrane; Biological process=electron transport
  Homolog annotation: Hit_ID=A8GE76; Match level="QueryCoverage=100%, HitCoverage=41%, E-value=1e-180, Identity=61%"; Hit description =Aldehyde oxidase and xanthine dehydrogenase molybdopterin binding
  Pfam annotation: Domain name=Cytochrom_C; Domain location=117-218; Score=12.6; E_value=0.013; Accession=PF00034.12; Description =Cytochrome c
  Pfam annotation: Domain name=Cytochrom_C; Domain location=386-473; Score=28.2; E_value=3e-05; Accession=PF00034.12; Description =Cytochrome c
  Pfam module annotation: Pfam domain module=Cytochrom_C::Cytochrom_C; Domain location=117-218::386-473
MVPRPHEPPLGAGESASVPSAAAIANAVFDATGIRFRELPITADKLRQALNGPDPQPEPQLAAPAQTVRRRSRKWALGGVTGLLGLAAGVAINALPWRAPIAPVTPPAAGSWSAEMLERGRQVAAAGDCAVCHTTEGGATNAGGLKMETPFGTLYTTNITPDKQTGIGSWSFNAFDRAMRQGISRDGHHLYPAFPYTSFRQLSEGDMQALYAWLMSQPAVQQAPPENQMRFPYNLRFLMAGWNALYLGRGEYQPDPRKSAEWNRGAYLVNGAGHCGACHSPRNLLGAEKRGDNFLAGGWVDGWEAPALNQLSKAPQPWTAQSLYNYLRSGYDAQHGVAAGPMAPVVSHLATLPEADVRAMASYLADINGQAARPVAVPAAKPAWNTAAGERLFKGACQACHSASEGGPQLFGVSPSMANSSSITSATPDNLLQVVLHGIDKPATDALGYMPGFAASLSDKQVADIAAWLRQRYAPDQPAWQNLSEKVAQVRANPGSH

SEQ ID NO: 106549 - protein, 67 aa, Glycine max
  Coding DNA Sequence Number=SeqID_14864
MRVVVGGDTEGLPKCFQGVYHQLLSLQWHIRAKARSRLDCDGEFHVSPPRFKRHVHDQFGVVGSQWV

SEQ ID NO: 106550 - protein, 76 aa, Glycine max
  Coding DNA Sequence Number=SeqID_14865
MAPKKLSTKRSRRDAIGEGSSAAREFDSHHFRSAKHQQRFEAIRGWSFHRERRVQLREDEYTDFQEEIAHRCWTPL

SEQ ID NO: 106551 - protein, 283 aa, Glycine max
  Coding DNA Sequence Number=SeqID_14866
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGGDGPTYFDDVAILDTRTFQWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 106552 - protein, 304 aa, Glycine max
  Coding DNA Sequence Number=SeqID_14867
MRGAPTEKSLSPFLVRDFGAQSIKVIQRVHKAWRSPLRKDKELRGIRNGVIGGYHGWLRVHTRGLDWLPKLKVINEENFEAPEEDEEVQALKLELGKARLAKEKFKSAATNIRKECTELREENATTARALEQETKRARKEEHGRDKFRGALWGSNNELKLWREERDQSRVHGMILKEELAACARSKRSFTQHLEAMEQSMLAIIGQYKEELNQSVTHEQKLVEDFAQVYAEKEARGRVIDALHQEATMWMDRFALTLNGSQDLPRLLAKAKAITEVCTSPKEIHGLINYCQHMIDLMAHIIRNR

SEQ ID NO: 106553 - protein, 156 aa, Glycine max
  Coding DNA Sequence Number=SeqID_14868
MKADREAMKEQMATMMEAMMSMKKIMEANAVALAATSAVDKVNPTPPSGLNQMNHPISDIVGKDLGSTGGPHYVQIQNKHAFPLYGLPANYTPPNVAYTPNENVNNSTPILIESQQPQSDHAHVSQPMGETHEIPHHNLADFEPCLGYATEGQAVG

SEQ ID NO: 106554 - protein, 46 aa, Glycine max
  Coding DNA Sequence Number=SeqID_14869
MATTPPVLLKNGIPGLPGHPSPGRAKVAWASWAATSSPLFSYKKAE

SEQ ID NO: 106555 - protein, 168 aa, Glycine max
  Coding DNA Sequence Number=SeqID_14870
MAKGAEDDVSLCASTGSFAPWLTKGAGNHTVQRTMLVSARYRALEIDCAEKLPLYLRMSTDFRVNVTESAEDDVNLRVSTGSWAAIDKGVSVTESAKDDVNLRVPTGSWAAIDKGCRRRQIDCAEKLLVYPRMSPDFRVSVTESAKDNVNLRVSTGSWAAIDKGCRRR

SEQ ID NO: 106556 - protein, 80 aa, Glycine max
  Coding DNA Sequence Number=SeqID_14871
MYLYTKQKIVNADGSDITAADQSDAAPVNYALHAMWSQIDVNLNGTVISQSSMTYPYRAYIEAKLNYNKHAKESHMQQRL

SEQ ID NO: 106557 - protein, 68 aa, Glycine max
  Coding DNA Sequence Number=SeqID_14872
MFFFAIGQIVAFTGNNRAGGDIFGIQQSMARQQTQEIAAMSVGPIKHGRDRKTVGGKSGRRGFWHHGE

SEQ ID NO: 106558 - protein, 276 aa, Glycine max
  Coding DNA Sequence Number=SeqID_14873
  Homolog annotation: Hit_ID=A5B5V0; Match level="QueryCoverage=77%, HitCoverage=48%, E-value=8e-10, Identity=27%"; Hit description =Putative uncharacterized protein
MSLKLPYFPKLVKVFYNNLKIQDGVLYSEVHNIPIIVYQSLCFSLTKLPSQGVPFEGTFVDDWKFDYSSRDARKMVCNDQTNMTGRSLAGSFTFDCCIMHYIIVHILLPRSLNLAQASEEDLILLWAIQTGRQIDWAHLVWYWMHKALRANAHLLYPHLVTLFLHHFNVPLDDEPYVKAKRSFSIGAGVVTSFGYRKDVDGQWVRKQDLPPPIPDEHTPSPPPQRDASSSLLTEVLTELCNLRAFVGEHFDVMDTRFDGMDTHITRLKDYIELVYG

SEQ ID NO: 106559 - protein, 98 aa, Glycine max
  Coding DNA Sequence Number=SeqID_14874
IQGTNRLRILCLKTLEGTSFCGTSRAYIYLSCNTQNKRGYVSCGSVQVEGTSSWLFKENKGGCIPCGSLLVKDFTRLLEISRIGGCLGTGRRLGLWPN

SEQ ID NO: 106560 - protein, 452 aa, Glycine max
  Coding DNA Sequence Number=SeqID_14875
  Gene Ontology: Mol. function=sugar binding; Cellular component =membrane; Biological process=protein amino acid phosphorylation
  Homolog annotation: Hit_ID=Q2PP76; Match level="QueryCoverage=51%, HitCoverage=89%, E-value=1e-76, Identity=62%"; Hit description =Lectin-like protein
  Pfam annotation: Domain name=Lectin_leg-like; Domain location=27-265; Score=-111.3; E_value=0.066; Accession=PF03388.4; Description=Legume -like lectin family
  Pfam annotation: Domain name=Lectin_legB; Domain location=31-261; Score=258.3; E_value=1.6e-74; Accession=PF00139.10; Description =Legume lectin domain
  Pfam module annotation: Pfam domain module=Lectin_leg-like::Lectin _legB; Domain location=27-265::31-261
MAIKNSRAQTQTLFSILVLIISFLALVHNVKSVSFSFPSFGSYTNDITLQGDAYVNSEGAIKLTPVAPNSVGRASYAAPVHLWDAKTGKLAGFNTTFSFVVMPNVPGLFGDGIAFFLAPFNSNIPNNSSGGFLGLFSPNYALNVYKNQIVAVELDSFSGNPWDPPSAHVGIDVNSIASVATRKWETGNAVNGFVAYANLNYEPVGKSLNVLVTYPGSKVNATSLSFVIDLRTVLPEWVTVGFSGATGQLVEIHKIFSWTFTHTDLAAFHALYIVFELKQWLNLMEALNNVWLKLISHLANLPQDLERPMELVEAWEVNEADEARVGLEAAKGGVGLDVEDLDEVREVGGGEENGVGAEGGAACASTSITSSSRYENQKRHDWNTFGQYLKNHEVMEWVELKPIKDALVGLQGIDGLSTEQRKRLTIAVELVANPSIIFIDEPTSGLDATTAS

SEQ ID NO: 106561 - protein, 78 aa, Glycine max
  Coding DNA Sequence Number=SeqID_14876
MKKRVVDKLIELVGHVLEGVTKGKLMGVVSRIFPLDLMMKFVQFQVKKRLSHEVLKVTVELSSVVGLSAHPSLSTTSA

SEQ ID NO: 106562 - protein, 92 aa, Glycine max
  Coding DNA Sequence Number=SeqID_14877
  Homolog annotation: Hit_ID=A6FJQ2; Match level="QueryCoverage=41%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLSTLEDPTTDLVEENRYLQSKESALEATFLMKMMES

SEQ ID NO: 106563 - protein, 232 aa, Glycine max
  Coding DNA Sequence Number=SeqID_14878
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=73%, E-value=2e-32, Identity=90%"; Hit description=LacZ protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTRLAGGSKINVPIQHLLVNSIIKTWDVQRDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 106564 - protein, 54 aa, Glycine max
  Coding DNA Sequence Number=SeqID_14879
THLLLEVASPLSLPFSILLPFIFQEAKESIDEEDPRPTSSNGAYITNDSPQIKL

SEQ ID NO: 106565 - protein, 98 aa, Glycine max
  Coding DNA Sequence Number=SeqID_14880
  Homolog annotation: Hit_ID=UPI0000ECBAF8; Match level="QueryCoverage =41%, HitCoverage=48%, E-value=1e-16, Identity=100%"; Hit description= UPI0000ECBAF8 related cluster
MLSLTKLNSSSLDNPLSGGDVEEVEGWWKKRVGGGGGRQVCAYDAGMQAWHWPSFYNVVTGKTLALPNLIALQHIPLSPAGVIAKRPAPIALPNSCAA

SEQ ID NO: 106566 - protein, 100 aa, Glycine max
  Coding DNA Sequence Number=SeqID_14881
MVPEDIRTKRKPFVKHLKSSWDWKVQSYVPMELGEDHIDEEQRSEKCVPQSENHINEEQRSEECDPQPKNLRSQRNRRLPLKLNDCQMIPDNMITIDGKL

SEQ ID NO: 106567 - protein, 59 aa, Glycine max
  Coding DNA Sequence Number=SeqID_14882
MKFGNQELPVLTNEFTTLDLMQSYPPRALDRRLQEYWTKDAKEGPRVLMSLRVDFGPMG

SEQ ID NO: 106568 - protein, 195 aa, Glycine max
  Coding DNA Sequence Number=SeqID_14883
MPRTQGLGRAIGRVVGRDRPVDEDAGDVPERRRPTASVRRLHVHQMTTEGRDMAEDVADMTDDVPEQPTEAPEMRTHRVLIVVRGQMEHPDLKLVSHGRKVTLIGRLVPEIEGLVVATGLSPLIDCSVITGDPGLISAFVERWHSETSTFHLIFPSSFYGGGQILAYGVAGSACRGGQSRDNTHTWSICTIRMGS

SEQ ID NO: 106569 - protein, 153 aa, Glycine max
  Coding DNA Sequence Number=SeqID_14884
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPVIDYQQLKMF

SEQ ID NO: 106570 - protein, 136 aa, Glycine max
  Coding DNA Sequence Number=SeqID_14885
  Subcellular localization annotation: CTP_CleavageSite=40; ConfidenceScore=5.83e-01
MGSPPASTTPPPPPSPPSPPPPPLTSDASASTSAVKRTCKASRLRSLSTKPPGVERPVVHVDPATGKADGGHHLRELEGGPYCSEGPDLGGYSDLTRKWALTADQDGVEDTVCDKYGISKEKWAQFCQTRRDPSWE

SEQ ID NO: 106571 - protein, 527 aa, Glycine max
  Coding DNA Sequence Number=SeqID_14886
  Gene Ontology: Mol. function=hydrolase activity, acting on carbon -nitrogen (but not peptide) bonds; Cellular component=cytoplasm; Biological process=pyrimidine nucleotide biosynthetic process
  Homolog annotation: Hit_ID=Q1GZG7; Match level="QueryCoverage=79%, HitCoverage=99%, E-value=1e-140, Identity=59%"; Hit description =Dihydroorotase
  Pfam annotation: Domain name=Amidohydro_1; Domain location=152-481; Score=13.6; E_value=4.6e-07; Accession=PF01979.11; Description =Amidohydrolase family
  Pfam annotation: Domain name=Amidohydro_3; Domain location=152-479; Score=-88.8; E_value=0.05; Accession=PF07969.2; Description =Amidohydrolase family
  Pfam annotation: Domain name=OTCace; Domain location=1-94; Score= -22.7; E_value=0.00023; Accession=PF00185.15; Description =Aspartateornithine carbamoyltransferase, AspOrn binding domain
  Pfam module annotation: Pfam domain module=Amidohydro_1::Amidohydro _3::OTCace; Domain location=152-481::152-479::1-94
MEQGLKDVDVVMMLRLQNERMSGALLPSSQEFFQTFGLTPERLALAKPDAIVMHPGPMNRGVEIDSAVADGKQSVILPQVTYGIAVRMALMAISGGRQRRMNIVIKQGRLMDASQSLDQVKDLYISAGKIVAIGEAPAGFKADQTLDASGKWVLPGLVDLCARLREPGSEYKATLLSELRAAMAGGVTSLACPPDTDPVLDEPGLVEMLKHRAKSQALAHVYPLGAVTRQLEGQLLTEMYALTAAGCVGFSQADTAIVDTQVLWRAFEYAASFGYTLFMRAEDPYLAKNGVAHDGEVASRLGLKGIPSAAESIALQTMLRIAQATGVRLHIARVSTAESVELIRQAKQSGMQVTADVSIQHLHLTDMDIGFFDGMVNLKPPVRTQRDRDALRAGLMDGTLDAVCSDHTPVDDDAKALPFAEAHPGASALELLLPLTLKWAAQAKLAPVQALQKITQTPADILGIKAGNLQLNSTADVVIYDPEMEWRVDGRVLVSQGKNTPFVHHALTGKVTATLTEGNLSSGDPLE

SEQ ID NO: 106572 - protein, 211 aa, Glycine max
  Coding DNA Sequence Number=SeqID_14887
MTPPKKIVTIIYHNGHIVDDPVQGSMYTSANPIFVYISRSITFTQIIQKINNRLPARATEQVAQLLFCVPISFHMGQTRFISAQLFDNDDLKGAMETIVQNPQLNSAKFYVVTGLIPQPQPSSPQPSCPQLQLSPPQQLLYNNINLNNPISSYNNLESQDPFDIYISYTQLLSKNDSFFHAQQTSFDQQNHHSSPFTPPSQLPQMQTSNRD

SEQ ID NO: 106573 - protein, 50 aa, Glycine max
  Coding DNA Sequence Number=SeqID_14888
MGTTKDRRTTKNERKMAKNLHGITHGNVSDALRKLLDLDFLHGNDFFTNI

SEQ ID NO: 106574 - protein, 39 aa, Glycine max
  Coding DNA Sequence Number=SeqID_14889
  Homolog annotation: Hit_ID=Q2PMM5; Match level="QueryCoverage=66%, HitCoverage=1%, E-value=3e-08, Identity=100%"; Hit description =Protein ycf2
STLEDPLSSCSGTLGDSLEEIRSFAFGGNMLWGGGPTYG

SEQ ID NO: 106575 - protein, 186 aa, Glycine max
  Coding DNA Sequence Number=SeqID_14890
MGEVEEIQEKMKADMEAIKEKMATMMEAMMSVKKIMEANAVAIAATSVVAKVNPTSPSGLKQMNHPTSNMVGKDLGSTGGPHDVQIQNEHAFPSYGLPLNYTPSNVAYTPNKNTHEIPHHNLADFEPWLGYTTEGQAVGGIPLQNPLEGPQYHPQLHLLHSTAVKNPHDYGRNGKVGSSRGKAQGH

SEQ ID NO: 106576 - protein, 128 aa, Glycine max
  Coding DNA Sequence Number=SeqID_14891
  Homolog annotation: Hit_ID=A6FJQ2; Match level="QueryCoverage=29%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARERCAESPPTFICGKRRKNRRKPVETKILSSGVVFTFEEGISTSHVDKSGALAPTYPPSKRKSDLRSSFLSVNQAIIFT

SEQ ID NO: 106577 - protein, 491 aa, Glycine max
  Coding DNA Sequence Number=SeqID_14892
AHENPRAFSCISCPTFLESSIQCSCGLGLHQTNLGLDKPLEKRDSPRADLGYDEPMRLTKDIPWEHVCPVFSSFCCSWEKSLVVDGSLTSTGIKAFVPYGLEDNFVGCLYLTISLRMLTEEVFVRLSFELGVVVGDNGVREAIPTYEVFLATNKYLTALGAFGSGPTSLGEVRGVCPECWPVVAVTHHFGGKGVSPGVKAAHLFMKLSYDIVCYWLFKHFNKGIVKPLLNSLPSRMTGYPVWFHLFSNYNFLGVYGRGWERLLDDNLEVLGLFGDDQFGEQVYSSVAFPSIYWQLAPGQAMGDIVKAFKDDSCLTSLHVGCTVNIEAPPVSGALLGAMKYAAGEVDGKLVFPFLLSKGTPDLGLVNSFAFLASLVRNLDMDASVPFSFWTSWMLVGLCISNMAIHLSGLAFIPRCVIMKPGNLSPPTSKIGVVGANPPFVVGLFDQDDIGELGGILDFSDEVGFEELVHYSLTILRHSSPIFLFFYDTGLA

SEQ ID NO: 106578 - protein, 144 aa, Glycine max
  Coding DNA Sequence Number=SeqID_14893
MESSLLTLDNLFRSQAGSELGGTYVLSRAYKTHGSSYMTLKSIIYKPVIIYKGYYTTITGPYKQGLTGPSLHYNYQVDKSGALAPTYPPLKRKSDLRSSFLRVDQAILFTWKVIILRRLDLKNDPFTCFQRGYGTTERSDFILA

SEQ ID NO: 106579 - protein, 386 aa, Glycine max
  Coding DNA Sequence Number=SeqID_14894
MPLKLFEFHLNIFRHFKDHFFKVLATNVVVDGLPLMFNRDWGAPLPVLVDLLTLVERVNKAILEQLSAMLDAWGILSLPLVDDLYAALDDKVPNLVLFCIMGDFARRPLVKMVLPAGGTIPSSTVVPPAREGGQPVVKDGPVAEVAEVTPSIPSSILAKRKQDGLTPPLVVKVSALVATAIVVPASPPSSVVLVQEVAPAVEVSVPTTLAGPNVAPMSTITAPLVSACVITTSDPEMPPPPSLTPRVPPSAGVGYKSEQKTPVSFVVARRFKMLLILARFSSREVAKWKVTTQIVWRVEHLKVANATIAFTEAVRGPIEGVRNQLEEFELQAFKEREANKELEEEPLMQAGFFVKDLDLGLFDLFKDGVLLENEDIATEENAIEEE

SEQ ID NO: 106580 - protein, 105 aa, Glycine max
  Coding DNA Sequence Number=SeqID_14895
MAILQESSVLANFTWHYRVATVAIELLEDLYIRRCTSLTQSQQRQGGMMATQHYGYITPIEGGRIIVTEIGSLIEEVAEGYTLPRRQEMPLPVWGETLNLSEEED

SEQ ID NO: 106581 - protein, 32 aa, Glycine max
  Coding DNA Sequence Number=SeqID_14896
AFSVELAKHTYRAKRVHPLRMNTHALAELPVL

SEQ ID NO: 106582 - protein, 167 aa, Glycine max
  Coding DNA Sequence Number=SeqID_14897
RAKRWSTHPRETFGKPVKNEALERFRGLLRRTPTHGFSEPIQLNMFIDGLRPQTKQLLDASAGGKIKLKTLEEATELIENMLLPSVVRLMKQANVFPLKKTLKKFIIWEINSDKGILKEDFQASSRVPPYNQQGQWRTHPGNQFNKDQSRPSNKPIQQGPNKKPEDY

SEQ ID NO: 106583 - protein, 142 aa, Glycine max
  Coding DNA Sequence Number=SeqID_14898
MRRIATNVYSRKTLEKPERCRETRGTGTKEPARKLRQDFSIQKGPVFFSFIAEYEVKSKEKKLPAALFLPPCCFFSSSSPPLLPPLKLQIPLHFYPKLQGKTIFGVLEPTSTSWGLKFQVEKCEILKVRKAKFGVSGNWSLK

SEQ ID NO: 106584 - protein, 75 aa, Glycine max
  Coding DNA Sequence Number=SeqID_14899
MALEDMEKTIFVTLWGTRTLWLGVGSPSSKAVHAELHHLVGIQDGPDQVLLSEFDIVYVTQMAIKGSALVDYLAQ

SEQ ID NO: 106585 - protein, 86 aa, Glycine max
  Coding DNA Sequence Number=SeqID_14900
MMLSYNLRQDEWQRNGERERERRRHFKEKMSLEEAHQHRRPWIRAWRKKDMNEGRGREEHGILCSKRALKSEVHIPMIKVDQNAHT

SEQ ID NO: 106586 - protein, 104 aa, Glycine max
  Coding DNA Sequence Number=SeqID_14901
MSLATLFGKLQEHEMELMRLNQHEENDKKKKGITLKASSSIQEGSDKEDLNEDLENEVVNLSLMGRNYESDEEVTSSDNNLSISFDDYKMHSLIYIKNQLNLQN

SEQ ID NO: 106587 - protein, 216 aa, Glycine max
  Coding DNA Sequence Number=SeqID_14902
  Homolog annotation: Hit_ID=UPI0000ECC274; Match level="QueryCoverage =30%, HitCoverage=96%, E-value=5e-21, Identity=67%"; Hit description =UPI0000ECC274 related cluster
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIVLSPTRISRARYVGGATEFLKWWPNYGYTRRTVFGICALLKPVNFGKRV

SEQ ID NO: 106588 - protein, 78 aa, Glycine max
  Coding DNA Sequence Number=SeqID_14903
MRLTRSCNSVILPHQVAILAYRGHSQGLESLESSLVIKAPIFETDPCMPCSKSIGSCTEFPHLATPKLMSRMRFQTGR

SEQ ID NO: 106589 - protein, 67 aa, Glycine max
  Coding DNA Sequence Number=SeqID_14904
  Homolog annotation: Hit_ID=Q6WAY3; Match level="QueryCoverage=67%, HitCoverage=2%, E-value=3e-07, Identity=48%"; Hit description =Gag/pol polyprotein
MAMSHGRLYPQRIKNAFDKKISHAVKDNRGKWAPNYEGPFVVKKGFFWGGSGAHQYGWRGATLAREL

SEQ ID NO: 106590 - protein, 185 aa, Glycine max
  Coding DNA Sequence Number=SeqID_14905
MDERPRGPGMPPTRHPLDLDKSNKALGFLALITGLCQSFGVPVTPNKVIQPPITRAFIEKYCTPREADGDAPQAADAPPPPHQDGSLGMEHYLQHLVRQQAANHRGQVQIHECLYRFSLSQQGQGFTPFACPTLEQFGDEVAWPGDWPEAQAGEEPAGSPGEAKEARMDEEMTDLLGFLGGSGVT

SEQ ID NO: 106591 - protein, 155 aa, Glycine max
  Coding DNA Sequence Number=SeqID_14906
MASRKRKSIGARPTAQYDTRRFHSLDSWNRYTDNVLGRSIFTERKVEIYHTEFDDFKTELERRNLHKRLINLADGTIDLALVKEFYANLYSSEDPSPKQARVRGHLVKIDGDSLITFLETLVVLEEGKTLPIYSRYCRLPTDHREIEAALCIPGR

SEQ ID NO: 106592 - protein, 98 aa, Glycine max
  Coding DNA Sequence Number=SeqID_14907
  Subcellular localization annotation: CTP_CleavageSite=90; ConfidenceScore=5.10e-01
LSLTHQWAKRASIAKRNFSALRAIEESGRASISRSCAKHKISVLSTAVVFSQPQRTIGAKLNGTTLRIPRAHSTAHQSAYFGKRALEAARGAAFAEIP

SEQ ID NO: 106593 - protein, 57 aa, Glycine max
  Coding DNA Sequence Number=SeqID_14908
MCPHAGARRDTTAAWGWPAVGNGRTAATSRAPQLIYKGWSIAYDPWLTSRQPSPKPK

SEQ ID NO: 106594 - protein, 177 aa, Glycine max
  Coding DNA Sequence Number=SeqID_14909
TAGPDDKQRPKFGHSAPMIRGDTLWLFAPFCHPEAAGPMTSRDQVWSFCTHDTRRYLMVIRTLLSSRGGGPETFSSQTNGGLLMTQASWSLHPVAEIPYGYSHPFVIQRRRADDKQRPKTKFGHSAPMIRGDTLWLFAPFCHPEAAGPMTSRDQVWSFCTLVSSRGGGPDDTRKYPS

SEQ ID NO: 106595 - protein, 128 aa, Glycine max
  Coding DNA Sequence Number=SeqID_14910
YIMNSVITVLYFNGRVYEENDGVIFESSKKAIQIKLSGKYDALQICDDEDVETMLESFQQQDQMSVLELYIEKDVTGGSMFHSANSLTSCENNLSNNEAQPPRNVSNLHGDKDDDYLVSNSYVEESLD

SEQ ID NO: 106596 - protein, 123 aa, Glycine max
  Coding DNA Sequence Number=SeqID_14911
MLHPPLCMAEGGCTTCSIIEDGVITGYHILYQLHGFFSHLQLDLPTDGGIEELLGMGSQAINENESSGVTHGSGQVLHSTIHQGVGGRMRSPPYPQRSWTPGSTSSGTSPLPLPISAGYSLNE

SEQ ID NO: 106597 - protein, 109 aa, Glycine max
  Coding DNA Sequence Number=SeqID_14912
  Gene Ontology: Biological process=metabolic process
  Homolog annotation: Hit_ID=A5FFM9; Match level="QueryCoverage=100%, HitCoverage=39%, E-value=2e-27, Identity=56%"; Hit description =Peptidoglycan-binding domain 1 protein
  Pfam annotation: Domain name=PG_binding_1; Domain location=9-68; Score=51.5; E_value=2.9e-12; Accession=PF01471.9; Description =Putative peptidoglycan binding domain
MKLLKYNTKAPEVLTLCELLYKLGYPIKISDSFSLEVDAAVKDFQSKNALVIDGIVGIKTWAVLLQKNSNPIISTDKFLKESDLISFADQYDLELAAVKAVNEIESSGK

SEQ ID NO: 106598 - protein, 115 aa, Glycine max
  Coding DNA Sequence Number=SeqID_14913
  Homolog annotation: Hit_ID=Q2A9Z4; Match level="QueryCoverage=76%, HitCoverage=15%, E-value=4e-08, Identity=40%"; Hit description=Zinc knuckle family protein
MTIEESIHVSFDETIITSPRKEFLDDIADSLEDMLYQERNLKRKRNEENKDIQEDIAQENDDLPKEWKTSRNHPLDNSIGDISKGVMSYPNFVRGPLLDDVRPFFGPREVLGTHH

SEQ ID NO: 106599 - protein, 87 aa, Glycine max
  Coding DNA Sequence Number=SeqID_14914
  Subcellular localization annotation: CTP_CleavageSite=63; ConfidenceScore=5.16e-01
MHKKNRAWFSSHNHKKKHSCQHNVHAKNQQQSHLKRTLKPFQEASCDAILPRKGPVTRTMSKRLQEDWARAAEEGPRVLMNLRGSIL

SEQ ID NO: 106600 - protein, 98 aa, Glycine max
  Coding DNA Sequence Number=SeqID_14915
MSFEVMSSLTSFILKGEAMTGLSLLSLTFGNWYCVVGGILEVVSNPWRFIQGNWLCDSNLDNPTRIDRVLTEKDFLANSYSNLEASILDEKEFVLLKV

SEQ ID NO: 106601 - protein, 16 aa, Glycine max
  Coding DNA Sequence Number=SeqID_14916
MAPKTCSASGKCTGSH

SEQ ID NO: 106602 - protein, 52 aa, Glycine max
  Coding DNA Sequence Number=SeqID_14917
MKPQAWFRGTRNRETDYHQEAQEVTYMFFPLGQNHIFIIVSNQDQQTFGINV

SEQ ID NO: 106603 - protein, 37 aa, Glycine max
  Coding DNA Sequence Number=SeqID_14918
MWLFLQASWETSDWRARFHIDKNVKAKCKSLIGQKNA

SEQ ID NO: 106604 - protein, 272 aa, Glycine max
  Coding DNA Sequence Number=SeqID_14919
  Homolog annotation: Hit_ID=Q6WAY6; Match level="QueryCoverage=30%, HitCoverage=14%, E-value=4e-07, Identity=37%"; Hit description =Putative uncharacterized protein
MGMRGCISYNLVLAIRQLGYPMRGAPLEEEIAPVISRGFNKTNMETLQKVRKAWEMVRKKDKELRGSNNGPISGYRKWLKAHVQGFDWILSLRTAKREEVEAPEEDEEVQALRAELKQAQTIKERFKSAALKIRKENAELRDINIATTKALEQETKRDRREEHGRNMFRGALWGSNSELKLRIEEMDQSRVDSLILKDELKVCSRSKRNLSQWLCETETNMLAIISRYQEELNLATGHEHRVADEFAQVYAEKEARGRVIDSLHQEETMWMD

SEQ ID NO: 106605 - protein, 144 aa, Glycine max
  Coding DNA Sequence Number=SeqID_14920
  Gene Ontology: Biological process=transposition, DNA-mediated
  Homolog annotation: Hit_ID=Q1J7G7; Match level="QueryCoverage=25%, HitCoverage=65%, E-value=3e-10, Identity=71%"; Hit description =Transposase
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSICALERTSFVLHLV

SEQ ID NO: 106606 - protein, 75 aa, Glycine max
  Coding DNA Sequence Number=SeqID_14921
MAYTNWHLGRGRSELWSLSKTLLRSSVIHIWVRVVMLVRMIRTRLPAMVRAKSCPGMHSSWAMASSSKPSAWLLL

SEQ ID NO: 106607 - protein, 295 aa, Glycine max
  Coding DNA Sequence Number=SeqID_14922
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSINPIQYFLKKTLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 106608 - protein, 39 aa, Glycine max
  Coding DNA Sequence Number=SeqID_14923
MSLSTGDIPPHMNKEEKTETPSFLSKNTTLEKILLVRDP

SEQ ID NO: 106609 - protein, 204 aa, Glycine max
  Coding DNA Sequence Number=SeqID_14924
MIRGRYLTVIRPPFAIQTQSCSMASRDQVWSFCTHDTRRYLTVIRPPLPIRHSRVRWQAETKFGHSAHMIRGDTLRLSAPPLPFRHSRVRWQAETKFGHSAHMIRGDTLRLSAPPLPFRHSRVRWQAETKFGHSAHMIRGDTLRLSTPPLPFRHSRVRWQAETKSGHSAHMIRGDTLRLSAPLYHSDTVVFDGKQRPSLVILHP

SEQ ID NO: 106610 - protein, 201 aa, Glycine max
  Coding DNA Sequence Number=SeqID_14925
  Gene Ontology: Cellular component=integral to membrane
  Homolog annotation: Hit_ID=Q7CSW1; Match level="QueryCoverage=95%, HitCoverage=21%, E-value=1e-50, Identity=60%"; Hit description =Putative uncharacterized protein
MQQFMSELAQRMQNAPQANMNQQAQNVLRQRDLENMMNQIENLARSGNRDAAQEMLSQLQRMMNNLQAGRPQRQGQQGQQQSSKMRQQIDKLGEILQQQQKLMDETFKLDQALRDRMQRGDPQQGGESDDQQMGENGQQQPQSQQGQQGENGQQGGQQQTDQMTAEQLREALKNLRAQQDALGKQLGELQQGTSRSRHGAG

SEQ ID NO: 106611 - protein, 266 aa, Glycine max
  Coding DNA Sequence Number=SeqID_14926
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMGRTAGGEQQEHKSYCELYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106612 - protein, 163 aa, Glycine max
  Coding DNA Sequence Number=SeqID_14927
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
  Subcellular localization annotation: CTP_CleavageSite=20; ConfidenceScore=5.48e-01
MTMITPSSKLTLTKGNKSWRGSSSSNAHPPAAHLLLCGPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106613 - protein, 76 aa, Glycine max
  Coding DNA Sequence Number=SeqID_14928
MTKVNKEPFLGVFCLCPVFLVVMLGRIDGDPVLRETRIWATWEYVSSVGGGQQGMVGLCALCGCGKLVVHHRLIAT

SEQ ID NO: 106614 - protein, 166 aa, Glycine max
  Coding DNA Sequence Number=SeqID_14929
MTSRRFSYKALQKAGMIPRGGHKKDSCLMHPSVLHNMEMCSAVRNLLQQMIDQGRLEVSNEGKEEQHICMQSADKEDPKKPKPLVIHFTRDTAPQRPQHPSVVSSVRPIPFPYKNSRTVPWRNAPLGGRKEEATDIGSLSAKVTNITGLSGITRSGRAFALPGLPT

SEQ ID NO: 106615 - protein, 47 aa, Glycine max
  Coding DNA Sequence Number=SeqID_14930
MEKLGLSKIGEKLAAQLAQASKVASSRSNSLLEGPSGSGCYLHPPVY

SEQ ID NO: 106616 - protein, 163 aa, Glycine max
  Coding DNA Sequence Number=SeqID_14931
  Homolog annotation: Hit_ID=A5BSP7; Match level="QueryCoverage=56%, HitCoverage=7%, E-value=1e-07, Identity=31%"; Hit description =Putative uncharacterized protein
  Pfam annotation: Domain name=zf-CCHC; Domain location=90-107; Score =22.6; E_value=0.00058; Accession=PF00098.14; Description=Zinc knuckle
MKEGIGHILDLTPIGEKRKESLKRLTLTFHTSMERTMKSTSKSFGSHSYPKKDQGQGILGVTPSKPKDDKGKTIEKQPLKASMQEKTSSIKCFKCLGRGHITSQCPTKKTMIIRGQDISSSQDKATNSPSSSESEEAKGKESSEEIYSQEEGQPLMVKEEYKE

SEQ ID NO: 106617 - protein, 53 aa, Glycine max
  Coding DNA Sequence Number=SeqID_14932
MGKRKLELGFEDQKIDFDLFVEDKPALEHNVCLQHIRLPLNGKIKGFNFLGKD

SEQ ID NO: 106618 - protein, 142 aa, Glycine max
  Coding DNA Sequence Number=SeqID_14933
MDRAHKTPSGPGEIQQGLRVSSFGYGPLSVLQGARSPQQGIAPAGHPVDPKKSNRVLGLPTLITGLCQFYGVSVTPSKVIRPPNNRAFIKKYCAPRQVEGETPLQPGDGWQRATNAPPPPLEFISVHPQKRLEHCLRHMTDQ

SEQ ID NO: 106619 - protein, 189 aa, Glycine max
  Coding DNA Sequence Number=SeqID_14934
MYSRGHFVLNADDLPWKLLRKDMTTLAQTWSVVSYYDLAPTSHTSDVNLDRARLIYGLVSRMDMDVGSFISQQISEIAQSSTSRLGFPALITALCDIQGVVSDTLIFESLSPAINLAYVKKKCWNPADPSITFPGTRRTRTRASASASEAPLPTQPPSQPSSQRPRPPPASTSASMDMHGQMLRSIHVG

SEQ ID NO: 106620 - protein, 148 aa, Glycine max
  Coding DNA Sequence Number=SeqID_14935
GGGPDDTQRQNLVISAPLCHPEAAGPMTRRDILRLSAPFCHPEAAGPMTRRDKIWSFCTLVSSRGGEPDDTRRYLTVIRTLVSSRGGGPDDTPRQNLVILHPCVIQRGGGPDDTRRYLTVIRTLVSSRGGGPDDTQRQNLVILHPCVI

SEQ ID NO: 106621 - protein, 144 aa, Glycine max
  Coding DNA Sequence Number=SeqID_14936
MDLIKNMVASDIAILRDRAHIPTKKSLLELTSQDALLAQKKLLSKQLEALTETLRCAICGGAHNSGYYIPNEELAHEVNYMGNQPRQNFNAETLAQFMKVSMSNQKSTESAIKNLEIQVGQLAKQLADRPSSSFSANTEKNPKE

SEQ ID NO: 106622 - protein, 92 aa, Glycine max
  Coding DNA Sequence Number=SeqID_14937
  Subcellular localization annotation: CTP_CleavageSite=31; ConfidenceScore=5.68e-01
MGSPPASTPPLPPPPPSDALASPSTVKRTCKASRLRSLSTRPPGAKRPVVHVDPATGKADGPHRKKLRTCLGIVACDKGDITYENWKEVPTA

SEQ ID NO: 106623 - protein, 81 aa, Glycine max
  Coding DNA Sequence Number=SeqID_14938
MEELINKTQLSPKIISTSSRRLGGSTKESYFSYSTAVILLLEQGSRSSQVPTTWYKNCEGLSIPSTSRGGPGPAFVPFSEG

SEQ ID NO: 106624 - protein, 263 aa, Glycine max
  Coding DNA Sequence Number=SeqID_14939
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPNPDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 106625 - protein, 140 aa, Glycine max
  Coding DNA Sequence Number=SeqID_14940
MKTARTKIDVYAGTLSIEFGDIVVHFNILDAMKHLSEDHSVFRAELIDQIVDDYTFDFDSILHGRKHPFLSDLHTCYCLCIESESEFEFDPMADFHAECEFEFKSDVVPLDVDFLESECTNHVAGVGSSGLRIFKKGGLN

SEQ ID NO: 106626 - protein, 154 aa, Glycine max
  Coding DNA Sequence Number=SeqID_14941
  Pfam annotation: Domain name=G-patch; Domain location=11-54; Score =5.1; E_value=0.046; Accession=PF01585.14; Description=G-patch domain
TICRGSGGIIGSNFSNPSRWQGYEPGMGLGKDSHVNVDVVDIRGNPYKYGLGYEPGKAGRRNAPSRLRADRAWPGHVSQCSTSVGIMFEEEVAAIGEEAPQDPPSFVRSCHPNFQVGNWRVMSQSEVYTVDSICEDRSFEDPNNEGLIIDFDRE

SEQ ID NO: 106627 - protein, 173 aa, Glycine max
  Coding DNA Sequence Number=SeqID_14942
MACRDKLWSFCTLLSSRGGGPDDMRRQNLVIPHPFAIQTQSCPMARRDKLWSFCTLLSCRGGGPDDMRRQNLVIPHPFAIQTQSCPMARRDKLWSFCTLLSSRGGGPDDMRRQNLVIPHPFAIQSQSCPMACRDKLWSFCTLLSSRGGGPDDTRRFTSSSALTRSVILTFESR

SEQ ID NO: 106628 - protein, 165 aa, Glycine max
  Coding DNA Sequence Number=SeqID_14943
MTPVNRKAGTGERTREPPGGNACFFKIEFLQPVGKPLVLERAAHRGRSSTIRPIVSRIHIFTGRRFFSHNAFDWEHPGVTGQHSNAVCTHPLCAAGVIAKGPPRSPGCLIKQLPTGFLNGEWDAPCSGALSAAGVVVTRQRQTAYTCRADVRLVLLPLRTNPVSS

SEQ ID NO: 106629 - protein, 269 aa, Glycine max
  Coding DNA Sequence Number=SeqID_14944
  Gene Ontology: Biological process=transposition, DNA-mediated
  Homolog annotation: Hit_ID=Q6UUU1; Match level="QueryCoverage=37%, HitCoverage=90%, E-value=9e-22, Identity=50%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWAAPSCALLFLPFGLP

SEQ ID NO: 106630 - protein, 126 aa, Glycine max
  Coding DNA Sequence Number=SeqID_14945
  Subcellular localization annotation: CTP_CleavageSite=55; ConfidenceScore=5.18e-01
MENAMQFLMGLNESFSNIRGQILSMNPFPSVTMTSSAARNHPDNRFKGSSKNRPLCAHCAKKHSSSSKPPHKVAQQVSIDMSPSQPSSGDSGSQFQLTVQQYSQLMNLLESHATNVVIPQGVSSAS

SEQ ID NO: 106631 - protein, 357 aa, Glycine max
  Coding DNA Sequence Number=SeqID_14946
  Homolog annotation: Hit_ID=Q84VH5; Match level="QueryCoverage=89%, HitCoverage=50%, E-value=1e-145, Identity=77%"; Hit description =Envelope-like protein
KEISSSDSDDDVELDVPDIKRTKTSGKKVPGNVPDAPLDNISFHSIGNAERWKFVYQRRLALERELGRAALDCKEIMDLIMAAGLLKTVTKLGDCYESLVREFIVNIPSDITNRKSDEYQRVFVRGKCVRFSPAVINKYLGRPTDGVVDITVSEHQIAKEITAKQIQHWPKKGKLSAGKLSVKYAILHRIGAANWVPTNHTSTVATESFAVKLPIAFPTVLCGIMLSQHPNILNYTDSVMKRESPLSLHYKLFEGTHVPDSVSTSGKAAASGAVSKDALISELKDTCKVLEATIKATTEKKMELERLIKRLSESGIDDGEAAEEEEEAAEEEDAAAEEEEDAAEDTESDDDDSEATP

SEQ ID NO: 106632 - protein, 78 aa, Glycine max
  Coding DNA Sequence Number=SeqID_14947
MVCFLVGNVALSVLGLFLFCFCSMRGGQATDAQDFEQRMDILTLDQGLRLSWGFWLKACRTAEHDNMSGRGLARGFKG

SEQ ID NO: 106633 - protein, 249 aa, Glycine max
  Coding DNA Sequence Number=SeqID_14948
  Homolog annotation: Hit_ID=Q6WAY6; Match level="QueryCoverage=99%, HitCoverage=41%, E-value=4e-10, Identity=24%"; Hit description =Putative uncharacterized protein
MGTRGCISYNPVLAIRQLGYRMRGAPLEDELAPIISRGFNKTNVETLQKVCKAWEVLQKKDKELRGSNNGPIGGYRKWLKAHVQGLDWLLSLRTAKREEVEAPEEDEEVQALRMELKQAQTVKERFKSATLKIRKENAELRDINIATTKALEQMTKRARREEHGRNKFRGALWGSNRDQSGVDSLILKDELNVCSRSKRNLSQRLCETETNMLAIISKYQEELNLATAHEHRVADEMPKCTRRRRLEEG

SEQ ID NO: 106634 - protein, 294 aa, Glycine max
  Coding DNA Sequence Number=SeqID_14949
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRYAYKTHEHTTDTHGSYYLDQYASIGIQDWCTLPTWQRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 106635 - protein, 304 aa, Glycine max
  Coding DNA Sequence Number=SeqID_14950
MASRKRKAPTLVSQARYDRSRFVSQDAWNHYANNVLGRKILPKRNVNLYITEFDEFKREIERRNWHKELTNFSEGSINVALVKELYANLYDLEDKSPKQEGESLPSYSRFCRLRPDPQELATRLCIPGRGFKLNADKLPLKILRKNLTTLAQTWSTISFSSLYLSSFYLSSPSSSSNSNSSRSFFSKLRAILFYAAEPASGPALDHAELVECGAPAAGVQPSPLGGGEASAAQEPQQDQQEDIPEAVEPTPPEPFTLESDPVVVQADPAISPQPEPSAPVSDLPLSQDPSSALALDLNEHAQDY

SEQ ID NO: 106636 - protein, 79 aa, Glycine max
  Coding DNA Sequence Number=SeqID_14951
MVFHLRLVMSFKTKKGEHRLKEAIKGINSRKHHQELSQGYCASNQWGKTPQKIMMMDGSNSHKGKRITFKSSFQNYHDM

SEQ ID NO: 106637 - protein, 81 aa, Glycine max
  Coding DNA Sequence Number=SeqID_14952
MRKLIKERMTNKVVNFVGLNKVVLGIKWNNEMRKRRTRVKMKGRKESLFPARATHKGCECPLIQPGVLESLKNLGESLSLR

SEQ ID NO: 106638 - protein, 87 aa, Glycine max
  Coding DNA Sequence Number=SeqID_14953
NGNIVVIAVMITMIVTTINVTVATIVMNGGDDETTVTNNNGGSSGDGSCGKNGGNGGANGDGDTSSGSDCQVEDGDDGSGGKNNGGS

SEQ ID NO: 106639 - protein, 283 aa, Glycine max
  Coding DNA Sequence Number=SeqID_14954
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIEIWWIKIWKIIFVKYVTALCVLIFLCYITTSETICIVKNPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106640 - protein, 97 aa, Glycine max
  Coding DNA Sequence Number=SeqID_14955
MAASSDNPGSFLEIVPQQRLLFSCSATEIVIRVTIRNKHTDRKHQRGKCKRGAMTLQLTSHPPLNCVAATAARFPIRDCGNCLMNGQRDRARPVFAY

SEQ ID NO: 106641 - protein, 66 aa, Glycine max
  Coding DNA Sequence Number=SeqID_14956
  Subcellular localization annotation: CTP_CleavageSite=42; ConfidenceScore=5.01e-01
MGASSKKGKCVESPPTFIRGKCRKNRKRRGLETLSVKGSGVVFTHGEGCFPCSYVFLNCDKKIRPT

SEQ ID NO: 106642 - protein, 171 aa, Glycine max
  Coding DNA Sequence Number=SeqID_14957
MDAKYLEVVKRGLHPNNGWSPDEIRAASPMTCGDKLWSFHTFCQPEASEPVDTQRQIMASKPIDTQRQIMVILNLFSSRGGEPDDMQRQIMAASPMTCGDKLWSFAPFVTSEPVDTQRQIMVIMLLLSSKGDEPDDMRRQIMAASPMTCGDPYGHPRLSSTKRNEFGSIRM

SEQ ID NO: 106643 - protein, 63 aa, Glycine max
  Coding DNA Sequence Number=SeqID_14958
CFEDLTILHKVNPRLVLGGLLLNVIDKKEAPSYFNDVRPLEPERLKALRIQWAKYYLKVRNET

SEQ ID NO: 106644 - protein, 69 aa, Glycine max
  Coding DNA Sequence Number=SeqID_14959
MESNIPTWQELPSIRILKKMIQGADIGDPTEESLLKRSREMKLTQSQRDLQIPPELIQIMIQAQKLSMD

SEQ ID NO: 106645 - protein, 109 aa, Glycine max
  Coding DNA Sequence Number=SeqID_14960
  Gene Ontology: Biological process=transposition, DNA-mediated
  Homolog annotation: Hit_ID=Q1J7G7; Match level="QueryCoverage=29%, HitCoverage=45%, E-value=4e-11, Identity=96%"; Hit description =Transposase
MEQLIEMPQNVLYDAIGIYQRCWNVLRADQRLIFAKSWPRASRYQQGHQDLFILRSDHPSQVLQWLLFLSAVPPVQLLTGWCVTAKAPPDISVGKCSGHVARNHHTRRA

SEQ ID NO: 106646 - protein, 140 aa, Glycine max
  Coding DNA Sequence Number=SeqID_14961
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=72%, E-value=2e-24, Identity=70%"; Hit description=LacZ protein
MYEHCACKKQRNQLPISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106647 - protein, 76 aa, Glycine max
  Coding DNA Sequence Number=SeqID_14962
  Gene Ontology: Mol. function=hydrolase activity
  Homolog annotation: Hit_ID=Q6A848; Match level="QueryCoverage=65%, HitCoverage=20%, E-value=5e-21, Identity=98%"; Hit description=NADH pyrophosphatase
MWPFPRSLMFGYVARATGTIDVGHDELAEASFLSRQEVSDQVNAGRLQLPPIEFLQPGGSTSSRAAATAVELQFAL

SEQ ID NO: 106648 - protein, 267 aa, Glycine max
  Coding DNA Sequence Number=SeqID_14963
  Homolog annotation: Hit_ID=Q6UUU1; Match level="QueryCoverage=22%, HitCoverage=40%, E-value=3e-18, Identity=78%"; Hit description =Putative uncharacterized protein
  Subcellular localization annotation: CTP_CleavageSite=42; ConfidenceScore=5.13e-01
GTSYVPINVSFSPKVGPGLPAVPPVQLLTGWCVTAKAPPDISAGKCSGRVPFAIQAAQLLGRAIGAGLFAITPAGERGMCCKAIKLGNARVFPVTTFNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 106649 - protein, 137 aa, Glycine max
  Coding DNA Sequence Number=SeqID_14964
MALPKEISTLIYHNGHIVDDPVQGSTYQSQLFDNDDLRGAMETIIQNPQLNSAEFYAVTELIPQPQPSSPQPSCPQLQLPPPQQLPYNNIDLNNPDEDQQFFDHTNHQSDDQTDDEGVGKPRHLRHLRCNISNLGVQ

SEQ ID NO: 106650 - protein, 173 aa, Glycine max
  Coding DNA Sequence Number=SeqID_14965
MAPRKLASKRSRKDKAAEGTSSAPEYDSHRFRSAEHQQRFEAIKGWSFLRERRVQLRDDEYTDFQEEIVRRRWASLVTPMAKFDPDIVLEFYANAWPTEEGVRDMQSWVRGQWIPFDADALSQFLGYPLVLEEGQECEYGQKRNLADGFNEGAITQLLCIPGQDFARTAAGRR

SEQ ID NO: 106651 - protein, 175 aa, Glycine max
  Coding DNA Sequence Number=SeqID_14966
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=29%, HitCoverage=50%, E-value=6e-24, Identity=100%"; Hit description=LacZ protein
MEKRLCRGPLTFPVKYLPGIFQEISAPFPFFSCHMKHFTDTLISANIDKKRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106652 - protein, 63 aa, Glycine max
  Coding DNA Sequence Number=SeqID_14967
MTPVNRKAGTGERTREPPGGNAWGAEPMEKRLCRGPLTSLLSIFLASTKFQEIPAPVGDKPLF

SEQ ID NO: 106653 - protein, 309 aa, Glycine max
  Coding DNA Sequence Number=SeqID_14968
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIIQGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 106654 - protein, 401 aa, Glycine max
  Coding DNA Sequence Number=SeqID_14969
  Homolog annotation: Hit_ID=A7MLG8; Match level="QueryCoverage=99%, HitCoverage=54%, E-value=1e-123, Identity=51%"; Hit description =Putative uncharacterized protein
MLDLPWEITPERITISDGRWNAVYAGYPLSGRVALSVGDWQKGTEEMEISGRLNVLTHGEAGKGNAVLNIGPGKLSMDHSDMPLSLTGEAKLDDMIFYAVLPAKLSGPLTTPELAFHPGALLRSRGRVIDSLNIDEIRLPLAGVKVTQQGVDGRLQAILRAHEQEMGDFILHLDGQADNFMPDRGRWSWRYWGDGHFTPMQARWDVKGAGEWRDSAIILNSLSDRVLKATWDGERLRGQAWWPKQALSVFQPLIPPDWKMTLREGDMYAQVAFSAAAGQGFEAGGHGVLKGGSAWMPDNQINGVDFVLPFRFSGGSWQLGTRRPVSLRIGEIVNQFTAKNLSADLQGTWPWSEQDPLELSNVNVDILGGKLSMQQLRMPQHQPALLRLQNISSSELISAIK

SEQ ID NO: 106655 - protein, 44 aa, Glycine max
  Coding DNA Sequence Number=SeqID_14970
MVKVGTSYVPINVSFSPKVGPGLPGCPSECFMWQEKKLTGQSNM

SEQ ID NO: 106656 - protein, 138 aa, Glycine max
  Coding DNA Sequence Number=SeqID_14971
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MKFKDYVSYMKVQHDEDPFPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106657 - protein, 193 aa, Glycine max
  Coding DNA Sequence Number=SeqID_14972
LDWLSKLKIIDEESFEAPEEGEEARALKTELGKARLDKEKFKLVATDVRKECAGYEKKMQLPQEPLNKKPRGLARKSMAVTNFVELYGAATVSSSFEGKRDTNHEHIACKYQEELNLATAHEHKVADDYARVYAEKEARGRVIDSLHQEATMWMDRFALTLNGSQELPRLLAKAKAMADTYSAPEEIHGLLSY

SEQ ID NO: 106658 - protein, 100 aa, Glycine max
  Coding DNA Sequence Number=SeqID_14973
MIGDIVAMRRVITLVVSEPIEPFRPCNGMIWQVIRKYKGWKGVMAGQNDHAIADALRALAQAIGNQNRGEAAATGEYQGLDRFQRNNPHAFNEGYNPDGA

SEQ ID NO: 106659 - protein, 90 aa, Glycine max
  Coding DNA Sequence Number=SeqID_14974
MMGDQEETQEQMKVDMSALKELMASMMEAMLGMRQLMEKNMATAAAVSSAAKADPTLLATTHHPPANTIGQGRSTLEQHSNPHLGYNRVA

SEQ ID NO: 106660 - protein, 181 aa, Glycine max
  Coding DNA Sequence Number=SeqID_14975
  Homolog annotation: Hit_ID=UPI00006A2D9E; Match level="QueryCoverage =78%, HitCoverage=85%, E-value=2e-12, Identity=17%"; Hit description =UPI00006A2D9E related cluster
MRGIVREPQYPHLQRTTRPRHKRTTRHRLQRAARTCLQGTALLEFRGLHVLAFRGLHVLTFRGLHALTFRGLHVLAFRGLHALRGLHAHTFKGLHVLVFRGLHVLTFRGLHVLAIRRLHVLTFKGRHAIAFRGLHILAFRGLHVLTFRGLHALIFRGLHILAFRGLHALRGLHALTFRGLH

SEQ ID NO: 106661 - protein, 261 aa, Glycine max
  Coding DNA Sequence Number=SeqID_14976
  Gene Ontology: Mol. function=protein serine/threonine kinase activity; Cellular component=cellulose and pectin-containing cell wall; Biological process=protein amino acid phosphorylation
  Homolog annotation: Hit_ID=A5APY4; Match level="QueryCoverage=96%, HitCoverage=23%, E-value=9e-40, Identity=37%"; Hit description =Putative uncharacterized protein
  Pfam annotation: Domain name=PAN_2; Domain location=172-241; Score =1.9; E_value=0.00088; Accession=PF08276.2; Description=PAN-like domain
MAILLDTGNFVLQQLHPNGTNTLLWQSFDYPSTLIPTMKLGVNHKTGHQWVLVSSLTDLVLNPGAFSLEWEPKGQELVIRRRGKVCWQSGKLRNNRFEYIPEEAQRMLKYTIVSNGDEDSFSFNSTNDKLTPRWSFSRSGRLSCNEGYVKADLCYGYNNTGGCQRWQDLPKCRNPGDLFVKKTLFPDYENVTFEMNPAFGYSDCEASCWSNCSCDGFSALWVNETGCTFYHWNSSKNFVDTSVAGVELYMLENTGNITPHN

SEQ ID NO: 106662 - protein, 355 aa, Glycine max
  Coding DNA Sequence Number=SeqID_14977
  Gene Ontology: Mol. function=transporter activity; Cellular component= integral to membrane; Biological process=transport
  Homolog annotation: Hit_ID=A8AEE5; Match level="QueryCoverage=100%, HitCoverage=34%, E-value=1e-161, Identity=81%"; Hit description =Multidrug resistance protein mdtC
  Subcellular localization annotation: CTP_CleavageSite=44; ConfidenceScore=5.05e-01
MKPLQAALQGSREVGFTVLSMSLSLVAVFLPLLLMGGLPGRLLREFAVTLSVAIGISLAVSLTLTPMMCGWLLKSGKPHEPTRKRGFGRLLVTIQGGYGKSLKWVLKHSRLTGLVLLGTIALSVWLYIAIPKTFFPEQDTGVLMGGIQADQSISFQAMRGKLQDFMKIIREDPAVDNVTGFTGGSRVNSGMMFITLKPRDQRHETAQQIIDRLRKKLAKEPGANLFLMAVQDIRVGGRQSNASYQYTLLSDDLSALREWEPKIRKALAALPELADVNSDQQDNGAEMDLVYDRDTMSRLGVSVQDANSLLNNAFGQRQISTIYQPLNQYKVVMEVDPLYTQDVSALELMFVISND

SEQ ID NO: 106663 - protein, 312 aa, Glycine max
  Coding DNA Sequence Number=SeqID_14978
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRCSQSIPSRVQIQPIAHYVHWTMSLTNSATIKYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 106664 - protein, 75 aa, Glycine max
  Coding DNA Sequence Number=SeqID_14979
MVFSRFSQEGTSTWVVVTENKRGYISYGSVQVEGTSTWLFKENKGGYIPCGSLLVKAFTRLKRNLKDRRSLGDWM

SEQ ID NO: 106665 - protein, 170 aa, Glycine max
  Coding DNA Sequence Number=SeqID_14980
MPLWWEFNSWVKEPRVFHCRPMDNFLQHSPMAGLKDTNRRWKIWWIAATTSIWKLRNDIIFNNHPFVISKLVDNTIFLSWSWMRGWEKDINEILPPVASCSTSEIAIKGDKEKDLPLEVILPYSSNSNIKKKSRVNVPFGQYDLKVASEEVGQRISGPNHSATKVYVRRK

SEQ ID NO: 106666 - protein, 102 aa, Glycine max
  Coding DNA Sequence Number=SeqID_14981
MACTQFRLSKLPHVWHLLSMSGFTRDSPQISASLHQLDLAPYASGPYNAQWNAPGLLHDKHTLRSSRIFGEMEVDAPWLGLWLPLNYQVDMGASQHRTPELG

SEQ ID NO: 106667 - protein, 182 aa, Glycine max
  Coding DNA Sequence Number=SeqID_14982
MDNEEGVQEQMKADLSALKDQMASITEAMLKLQKTIEDNAMAATFNTAREVEPVLQPAINLGRDRNTTVFGRRYSPQAYPYGLPPDFTPCTAPDDLSQAPTFEGQLPPHVDYPLQEDDEGDAHLGPLLPLKDPAPHELPQPNIVRHVPSPPAPVKEFIPFAKDKGKIDLLEVRLRAVEGLGN

SEQ ID NO: 106668 - protein, 271 aa, Glycine max
  Coding DNA Sequence Number=SeqID_14983
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIQFAERPAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106669 - protein, 149 aa, Glycine max
  Coding DNA Sequence Number=SeqID_14984
  Gene Ontology: Mol. function=heme transporter activity; Cellular component=mitochondrion; Biological process=respiratory chain complex IV assembly
  Homolog annotation: Hit_ID=Q0GR47; Match level="QueryCoverage=61%, HitCoverage=14%, E-value=5e-45, Identity=93%"; Hit description =Cytochrome c biogenesis FN
MREGISPSWTGDGVLPSADSRGRRGVLTRPPNPAGQGRAGHRFESCHLSCGSSCGYRMMGITKQKFGNEYEMSIYELFHYSLFPGLFVAFTYNKKQPPAFGAAPAFWCILLSFLGLSFRHIPNNLSNYNVLTANAPFFYQISGTWSNHE

SEQ ID NO: 106670 - protein, 140 aa, Glycine max
  Coding DNA Sequence Number=SeqID_14985
  Gene Ontology: Mol. function=structural molecule activity; Cellular component=cytoplasm; Biological process=keratinization
  Homolog annotation: Hit_ID=Q86AI8; Match level="QueryCoverage=97%, HitCoverage=37%, E-value=2e-17, Identity=40%"; Hit description =Similar to Homo sapiens (Human). Mucin 2
MTGPLNESISCFLIRVNPWVLVLSPLEDYTSLPLEGYTPSPSEGYTPSPSEDYTPLPSEGCMPSPSEGCTLLPLEGYMPSPSEGYTSTPSEGYTPSPSEGYTPSPSEHYTPSPSEGCTSLLSEGSTSVPLENSRSSALNS

SEQ ID NO: 106671 - protein, 111 aa, Glycine max
  Coding DNA Sequence Number=SeqID_14986
MGDFINILSFPENTETFSSLTSYPELRRSEFLIGGYVGARASLLSTAPLFATMTQELVARRDALRLSAPRHSVTPSMIDEQRPMWSFAPFPEMSASSGGDFFKSHKLSRTT

SEQ ID NO: 106672 - protein, 63 aa, Glycine max
  Coding DNA Sequence Number=SeqID_14987
MAEVSTEAIASLAQYYDQPLRNWIAGSESKMGWLGYQGNVWKQRRESWQVKANGPRSWTSWHF

SEQ ID NO: 106673 - protein, 258 aa, Glycine max
  Coding DNA Sequence Number=SeqID_14988
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLATPDIHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106674 - protein, 136 aa, Glycine max
  Coding DNA Sequence Number=SeqID_14989
MTPVNRKAGTGERTREPPGGNAGIFIVLSGFATTDLSVRFRDALVRGAEPMDEKTEKAAPSHFKMLCVIEFLPRGVSHSSRACRCDRAVGAHWHDRFPDGEWEQPERNAINVWCYASLAPALHLPLMSGGAFANYG

SEQ ID NO: 106675 - protein, 252 aa, Glycine max
  Coding DNA Sequence Number=SeqID_14990
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=42; ConfidenceScore=5.13e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLPQNSLQHQVVFIGTGEYQQQQLRVAFTIPSSVLVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106676 - protein, 62 aa, Glycine max
  Coding DNA Sequence Number=SeqID_14991
MGETLVLERTPTTSGVIAKRPAPIALPMGAQPEWGMGGALKRRIKRGGGGGYTQRDRYTCQR

SEQ ID NO: 106677 - protein, 106 aa, Glycine max
  Coding DNA Sequence Number=SeqID_14992
  Subcellular localization annotation: CTP_CleavageSite=53; ConfidenceScore=5.09e-01
MYPLLFSLNNLVDVYSTKTDPQEIYPLLFSVTTTQVDVPSSCTTKDVPSNVLRQSSQAGMGRIKRILRLCHFEFFDKGEGRHKRIQAVSPSFFWKREKRDTKRIQA

SEQ ID NO: 106678 - protein, 41 aa, Glycine max
  Coding DNA Sequence Number=SeqID_14993
MEFLELKQGNMTVAKYVAKFEELVRMKTLETGQPIIGVQAQ

SEQ ID NO: 106679 - protein, 261 aa, Glycine max
  Coding DNA Sequence Number=SeqID_14994
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPRYQQGHQDLFILRSDLPSQWLLFLSAVPPVQLLTGWCVTAKAPPDISAGKCSGRVPFAIQAAQLLGRAIGAGLFAITPAGERGMCCKAIKLGDQSGELGRKLGFRNLSLLYQWPEKLGGLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106680 - protein, 211 aa, Glycine max
  Coding DNA Sequence Number=SeqID_14995
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=24%, HitCoverage=50%, E-value=1e-23, Identity=100%"; Hit description=LacZ protein
  Subcellular localization annotation: CTP_CleavageSite=51; ConfidenceScore=5.05e-01
MTMITPSSKLTLTKGNKSCALLFAIQSRRLMILSPDVKVGWGKPSLLSPLIADAVARHGASRNVYIGNLDSRYMSESALSVVFSHFGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106681 - protein, 195 aa, Glycine max
  Coding DNA Sequence Number=SeqID_14996
MTTLAQTWSILSFPNLVPTSDTYDVRLDRAKLIYGIIMKMDVNAGYLISHQISIIAQHDSSKLGFLALIIALCKARGVTSDSRTLESLSPAINVAYIKKNCWNLDDPTVTFRGPRKTRGKRSEAPTTSAAPETTAPSSSTPPTPPSSIIPPTPSTSTPAQFPAQILAALASAFTFTPKMLHSMLQSLHREQAIIM

SEQ ID NO: 106682 - protein, 267 aa, Glycine max
  Coding DNA Sequence Number=SeqID_14997
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDRITKSRCNRNRTDRRTYTTVSSQDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106683 - protein, 66 aa, Glycine max
  Coding DNA Sequence Number=SeqID_14998
MNICNFGHNTLSMREMAPRKLASKRSRKDKAAEGTSSAPEYDSHRFRSAVHQQRFEAIKGWSFLRE

SEQ ID NO: 106684 - protein, 517 aa, Glycine max
  Coding DNA Sequence Number=SeqID_14999
  Gene Ontology: Mol. function=homocysteine S-methyltransferase activity; Cellular component=intracellular; Biological process=folic acid and derivative biosynthetic process
  Homolog annotation: Hit_ID=P37586; Match level="QueryCoverage=98%, HitCoverage=41%, E-value=0.0, Identity=89%"; Hit description =Methionine synthase
  Pfam annotation: Domain name=B12-binding; Domain location=265-387; Score=90.3; E_value=6.2e-24; Accession=PF02310.10; Description=B12 binding domain
  Pfam annotation: Domain name=B12-binding_2; Domain location=175-258; Score=158.6; E_value=1.7e-44; Accession=PF02607.8; Description=B12 binding domain
  Pfam annotation: Domain name=Pterin_bind; Domain location=1-89; Score= -66.1; E_value=0.02; Accession=PF00809.13; Description=Pterin binding enzyme
  Pfam module annotation: Pfam domain module=B12-binding::B12-binding _2::Pterin_bind; Domain location=265-387::175-258::1-89
DGVRRSGQADTRARKIEICRRAYHILTEEVGFPPEDIIFDPNIFAIATGIEEHNNYAMDFIGACEDIKRELPHAMISGGVSNVSFSFRGNEPVREAIHAVFLYYAIRNGMDMGIVNAGQLAIYDDLPAELRDAVEDVILNRRDDGTERLLALAEKYRGNKGEGEQDKQQAEWRSWDVVKRLEYSLVKGITEFIEQDTEEARQAAARPIEVIEGPLMSGMNVVGDLFGEGKMFLPQVVKSARVMKQAVAYLEPFIQASKEAGRSNGKIVLATVKGDVHDIGKNIVGVVLQCNNYEIIDLGVMVPGDKILKTAREENADIIGLSGLITPSLDEMVNVAKEMERQGFTLPLLIGGATTSKAHTAVKIEQNYSGPTVYVQNASRTVGVVSSLLSPTLKEAFVARTRKEYETVRIQHARKKPRTPPVTLQAARDNHYVIDWQRYTPPVAHRTGVSAVEASIDTLRNYIDWTPFFMTWSLAGKYPRILEDEVVGEEATRLFADANAMLDNLSAQGTLRPRGVV

SEQ ID NO: 106685 - protein, 648 aa, Glycine max
  Coding DNA Sequence Number=SeqID_15000
  Gene Ontology: Mol. function=catalytic activity; Cellular component =plasma membrane
  Homolog annotation: Hit_ID=P32689; Match level="QueryCoverage=99%, HitCoverage=93%, E-value=0.0, Identity=72%"; Hit description =Uncharacterized lipoprotein yjbH precursor
  Pfam annotation: Domain name=DUF940; Domain location=1-648; Score =1338.8; E_value=0; Accession=PF06082.2; Description=Bacterial putative lipoprotein (DUF940)
MAKEGEFSLNFRDNDQYRYYSASLQLFPWLETTVRYTDVRTRRYSAVEGFSGNQSYKDKAFDLKLRLWQESFWLPEVAVGSRDLGGTGLFDSEYLVASKAWGPFDFSLGLGWGYLGNSGTIKNPFCSYSDSFCSRTGGGSAGSINGSQMFHGPAALFGGIEYQTPWQPLRLKLEYEGNDYQDDFAGRLEQRSKVNVGAIYRLSDWADINASYERGNTFMFGVTVRTNFNSLHQSHLDSAKPAYQPQPQGDLLQPTVVANQLTDLKYNAGLDGPRIQTKGRTLYVSGEQTKYRDTREGVDRANRIIMNNLPAGIDTIEVTESRFNMPQVTTRTDVASLNNELRGYPLGHEQPLQQTREEPIDPGTTEQGYFIRKDRLNYSLSPVLNQSVGGPESFYMYQLGVMGNVDYWLTDHWLIGGSLFGNIANNYDKFNYNGAPADSTLPRVRTHIRDYVENNVYVNDLQANYMRYLGNGFYGQVYGGYLETMYGGVGGELLYRPVDSNWAFGLDANYVKQRDWDNMMQFTDYKAPTGHLTAYWRPWLMQDVLVKASVGEYLAKDKGVTLDVSKRFDSGVMVGFYATKTNVSAEAYGEGDFTKGFYISIPMDLFTVTPTRGRAQVNWVPLTRDGGQMLGRKYQLYDLTADRDARFN

SEQ ID NO: 106686 - protein, 571 aa, Glycine max
  Coding DNA Sequence Number=SeqID_15001
  Gene Ontology: Mol. function=glucose-6-phosphate isomerase activity; Cellular component=cytoplasm; Biological process=gluconeogenesis
  Homolog annotation: Hit_ID=Q6D022; Match level="QueryCoverage=88%, HitCoverage=92%, E-value=0.0, Identity=86%"; Hit description=Glucose- 6-phosphate isomerase
  Pfam annotation: Domain name=PGI; Domain location=117-571; Score =977.2; E_value=6.2e-291; Accession=PF00342.10; Description =Phosphoglucose isomerase
MRGEPADNRRRIYLKRCGWRHKFFPFSCNCGHTETRASRNKCSACRARQDAPGWNDGSYINKSVAMKNINPTQTAAWKALQQHFDQMKSVEIADLFAQDADRFAKFSATFDDQMLVDFSKNRITQETLDKLQALAKETDLAGAIKSMFSGEKINRTEDRAVLHVALRNRSNTPILVDGKDVMPEVNAVLAKMKAFSERIISGEWKGYTGKPITDVVNIGIGGSDLGPFMVTEALRPYKNHLNMHFVSNVDGTHIAETLKPLSPETTLFLVASKTFTTQETMTNAHSARDWFLNTAGDQQHVAKHFAALSTNAKAVGEFGIDTANMFEFWDWVGGRYSLWSAIGLSIILSIGFENFEQLLSGAHAMDQHFANTPAEQNLPVLLALIGIWYNNFFGAETEAILPYDQYMHRFAAYFQQGNMESNGKYVDRDGNPVDYQTGPIIWGEPGTNGQHAFYQLIHQGTKLIPCDFIAPAQTHNALADHHQKLLSNFFAQTEALAFGKAREVVEKEFTDAGKSAESVAHIVPFKVFEGNRPTNSILLREITPFSLGALIALYEHKIFTQGAILNIFTFD

SEQ ID NO: 106687 - protein, 101 aa, Glycine max
  Coding DNA Sequence Number=SeqID_15002
MARAAAGGRLIRRDGGPFDQVVSEQSAQRHQHQADGAVTADKGFDATVEALTNHLMVDRIKNNDGVIFHAQRGGRINPVALPAALAQLRVDFTGYNRRPGR

SEQ ID NO: 106688 - protein, 292 aa, Glycine max
  Coding DNA Sequence Number=SeqID_15003
  Gene Ontology: Mol. function=glucose-1-phosphate adenylyltransferase activity; Cellular component=chloroplast; Biological process =glycogen biosynthetic process
  Homolog annotation: Hit_ID=A7MGF4; Match level="QueryCoverage=100%, HitCoverage=68%, E-value=1e-132, Identity=78%"; Hit description =Glucose-1-phosphate adenylyltransferase
  Pfam annotation: Domain name=NTP_transferase; Domain location=21-292; Score=311.7; E_value=1.4e-90; Accession=PF00483.14; Description =Nucleotidyl transferase
MVKLDRNDPLMLARQLPTQTVALILAGGRGTRLKDLTAKRAKPAVHFGGKFRIIDFALSNCINSGIRRIGVITQYQSHTLTQHIQRGWSLFNEEMNEFVDLLPAQQRASTEHWYRGTADAVTQNLDIIRRYNAQYIVILAGDHIYKMDYSRMLLDHADRGAKCTIACLPVPLHEATAFGVMAVDADNNVIDFVEKPAQPPSMPGDDSKALASMGIYVFNADYLYELLEEDLQIADSSHDFGKDLLPKLVASGEAYAHSFTLSCVQNDENAEPYWRDVGTLEAYWHANIDLAS

SEQ ID NO: 106689 - protein, 71 aa, Glycine max
  Coding DNA Sequence Number=SeqID_15004
  Gene Ontology: Mol. function=transferase activity, transferring glycosyl groups; Biological process=carbohydrate metabolic process
  Homolog annotation: Hit_ID=Q6CZK4; Match level="QueryCoverage=100%, HitCoverage=8%, E-value=9e-30, Identity=85%"; Hit description =Glycogen phosphorylase
MNAPFTYASPTLTVDALKHSIAYKLMFTIGKDPSIANKHEWLNAALLAVRDRMVERWLRSSRAQLSQDVRQ

SEQ ID NO: 106690 - protein, 597 aa, Glycine max
  Coding DNA Sequence Number=SeqID_15005
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=A7MHA0; Match level="QueryCoverage=100%, HitCoverage=79%, E-value=1e-164, Identity=56%"; Hit description =Putative uncharacterized protein
  Pfam annotation: Domain name=E1-E2_ATPase; Domain location=68-289; Score=279.2; E_value=8.2e-81; Accession=PF00122.11; Description=E1 -E2 ATPase
  Pfam annotation: Domain name=FeoB_N; Domain location=172-283; Score= -30.8; E_value=0.024; Accession=PF02421.9; Description=Ferrous iron transport protein B
  Pfam annotation: Domain name=GTP_cyclohydro2; Domain location=352 -470; Score=-85.1; E_value=0.0027; Accession=PF00925.11; Description =GTP cyclohydrolase II
  Pfam annotation: Domain name=Hydrolase; Domain location=293-514; Score=106.5; E_value=8.4e-29; Accession=PF00702.17; Description =haloacid dehalogenase-like hydrolase
  Pfam annotation: Domain name=Hydrolase_3; Domain location=296-532; Score=-69.3; E_value=0.018; Accession=PF08282.3; Description =haloacid dehalogenase-like hydrolase
  Pfam module annotation: Pfam domain module=E1-E2_ATPase::FeoB_N::GTP _cyclohydro2::Hydrolase::Hydrolase_3; Domain location=68-289::172 -283::352-470::293-514::296-532
  Subcellular localization annotation: CTP_CleavageSite=30; ConfidenceScore=5.04e-01
MIASWLLSQLTPLWGDRLFVLTTLVGLVPVARSAWQAIRSGSPFSIETLMTLAAAGALVIGAHAEAAMVLLLFQLGERLEAYAAARARRGVTALMALRPDIATRVNGTQREQVALAALQPGDVIEVAAGGRLPADAELLHASASFDESALTGESLPVAHQPGDAVMAGATSVDRLVTLRVTSQPGHSAIDRILQLIEEAESHRAPVERFIDRFSRLYTPAIMLLALLVMVLPPLLGLGAWLPWIYKGLTLLLIGCPCALVISTPAAITSGLAAAARQGALIKGGAALERLSRVQALAFDKTGTLTAGKPQVTDVKPFGADTQQQLLSLAAAIEQGSGHPLARAIVAEAQHQQQVIPPAQHQQTLAGSGIRAQIDGVMHQLLAPRDVAALSDAQQQQIAQLEAQGKTVVVLLREAQPLGLLALQDLLREEARSALAALQALGIRSVMLTGDNPRAAAAIAAELGISYRASLLPADKVAAVRELGEQQPLAMVGDGINDAPAMKAATLGIAMGSGTDVALEAADAALTQNNLAILPRTVQLARRTRAIIRQNIALALGLKAIFLVTTLLGFTGLWLAVLADSGATALVTANALRLLRQR

SEQ ID NO: 106691 - protein, 238 aa, Glycine max
  Coding DNA Sequence Number=SeqID_15006
HASHGRHRRADHKGQRDHAVGVDAQQAGHFQVFSAGTAGAAHARITNEQGQRQHREEGDDPDNQLHGGERGGKAVALTQRPLAGDQAGQRQIARALRQADVVLQKDRHTNRRDQRDQAFGGAHRLIRHALDAPAIGAGDNHRHHEPGGNHQPRGVDTHHHQGGDHDKGDIAADHVYLAVSEVDHADDAVNHGVTDGDQRVGAPEGDPVEHLLNEIEKLLGHSEDLHVNGKSPVRSAPG

SEQ ID NO: 106692 - protein, 373 aa, Glycine max
  Coding DNA Sequence Number=SeqID_15007
  Gene Ontology: Mol. function=receptor activity; Cellular component =outer membrane-bounded periplasmic space; Biological process=amino acid transport
  Homolog annotation: Hit_ID=Q8D1J0; Match level="QueryCoverage=100%, HitCoverage=98%, E-value=1e-161, Identity=74%"; Hit description=High- affinity leucine-specificleucine-specific-binding periplasmic protein of ...
  Homolog annotation: Hit description=high-affinity branched-chain amino acid ABC transporter transport system; periplasmic binding protein
  Pfam annotation: Domain name=ANF_receptor; Domain location=43-365; Score=217.4; E_value=3.4e-62; Accession=PF01094.19; Description =Receptor family ligand binding region
MSKGRALLAGCVALAMSHAVLAKDIKIAIVGAATGPVAQYGDMQFTGAAQAIKDINAKGGVNGDKLVGVEYDDACDPKQAVAVANKVVNDGIKYVIGHLCSSSTQPASDIYNDEGILMITPAATAPELTARGYADVMRTTGLDSDQGPTAANYILDQIKPKRIAVVHDKQQYGQGLAESVQKTLKAKGGNVVLFEGITAGDKDFSTLIARLKKENVDFVYYGGYYPELGQILRQAKTAGLKAGFMGPEGVGNASLSNIAGDASEGLYVTLPKRYDQLPDNKAIVDAIKANSASNRKDPTGPFVWTTYAAIQSLVAGIERSKSDEPDAIAKNLKEGAPVPTVMGNLSWDQKGDLKGFEFGVFKWHKDGSSTAVK

SEQ ID NO: 106693 - protein, 903 aa, Glycine max
  Coding DNA Sequence Number=SeqID_15008
  Gene Ontology: Mol. function=hydrolase activity, acting on acid anhydrides, catalyzing transmembrane movement of substances; Cellular component=ATP-binding cassette (ABC) transporter complex; Biological process=...
  Gene Ontology: Biological process=glycerol-3-phosphate transport
  Homolog annotation: Hit_ID=Q8X6U5; Match level="QueryCoverage=30%, HitCoverage=76%, E-value=1e-101, Identity=72%"; Hit description=sn -glycerol-3-phosphate import ATP-binding protein ugpC
  Pfam annotation: Domain name=ABC_tran; Domain location=1-164; Score =92.4; E_value=1.4e-24; Accession=PF00005.18; Description=ABC transporter
  Pfam annotation: Domain name=GDPD; Domain location=310-537; Score =206.5; E_value=6.6e-59; Accession=PF03009.8; Description =Glycerophosphoryl diester phosphodiesterase family
  Pfam annotation: Domain name=G_glu_transpept; Domain location=685 -903; Score=-43.0; E_value=8.1e-14; Accession=PF01019.12; Description= Gamma-glutamyltranspeptidase
  Pfam annotation: Domain name=TOBE_2; Domain location=231-286; Score =5.6; E_value=0.052; Accession=PF08402.1; Description=TOBE domain
  Pfam module annotation: Pfam domain module=ABC_tran::GDPD::G_glu _transpept::TOBE_2; Domain location=1-164::310-537::685-903::231-286
MVAGLERVTSGDIYIDDRRVTDMEPKDRGIAMVFPELRALPAHDGGRKHGLRPENPRHGPRNQITQRVMDAARSLELDHLLQRRPRELSGGQRQRVAMGRAIVREPAVFLFDEPLSNLDARLRVQMRLELQQLHRRLKTTSLYVTHDQVEAMTLAQRVMVMNKGVVEQVGTPVEVYERPASQFVASFIGAPAMNLLPGQINSDGSRFTLDALNSLPLGAGKARWANRPLTLGIRPEHIQLSSREAGGVPLVVDTLEILGADNLAHGHIGNTRLVPVATTAARCVTLLRFYPWKASGMSVKNWPYPHIVAHRGGGKLAPENTLAAIDVGAHYGHTMIEFDAKLSQDKQIFLLHDDTLDRTSNGWGVAGDLPWQQLAQLDAGSWFSREFDGEPLALLSEVAARCRQHQMMANIEIKPSSGTEVETGRDVALAARTLWQGQTAPLMSSFSYAALEAAMQAAPELPRGLLLDEWHDDWQALTAALDCVSIHLNHRLLDARRTAALKAAGLRILVYTVNQPARARELLSWGVDAICTDRIDAIGPDFPCAASPDFAAADPDATAAAVAAAGPACASACAAGSGYSRHVRHAAQRHQCRDNNQPFFHGVPPSVRPASLQTLAAINNKCKQLKGWWQDEDKERCAPVRLGAVNEFYRGAGGAGGAGQRPAGIVWRRQRHLSPGESTARDGCGGNAVDAAIAVGFALAVTHPQAGNLGGGGFMLLRTAAGRTTAIDFREMAPARASRDMFLDKQGNADSKLSLTSHLASGTPGTVAGFALAAQKYGTLPLSTLLAPAIKLARDGIIVNDALADDLATYGKENLINHDNSRAIFYKADGQPYQKGDRLVQKNLAHSLQLIAQQGPDAFYKGKIADEIAAEMAQHGGLIGKADLAAYRAVERKPVSGSYRGYE

SEQ ID NO: 106694 - protein, 689 aa, Glycine max
  Coding DNA Sequence Number=SeqID_15009
  Gene Ontology: Mol. function=transcription regulator activity; Cellular component=cytoplasm; Biological process=thiamin biosynthetic process
  Homolog annotation: Hit_ID=Q6DAM0; Match level="QueryCoverage=24%, HitCoverage=25%, E-value=4e-68, Identity=73%"; Hit description =Thiamine biosynthesis protein thiC
  Pfam annotation: Domain name=Rsd_AlgQ; Domain location=276-422; Score= 171.4; E_value=2.4e-48; Accession=PF04353.4; Description=Regulator of RNA polymerase sigma(70) subunit, RsdAlgQ
  Subcellular localization annotation: CTP_CleavageSite=55; ConfidenceScore=5.55e-01
GAQITIVLQFTHNGLSHAKAGSVAFSRRAGATQRNRIFNQPARHGARRRQQGQVVVTIPASIQQLFTIMLQLAAIVLRHERHHQRVRKRPRLRGHVTHIFYPHVALFHHLAGHSLLQRFADFDKTGQHGVDAVAMARMVCQQDLLTATNRHNDTGGDLRIVALAAVAAQAGKFALAVLHFMAAIAAPAMRTVELSQLHAAPGELKQTDIFVNQLAHRGHIVRTRFAYQPDVFALPLANHSAAAAELTIHQPASTLEISRCILIVVLSVKWHAEILMLSGGNELVDSWLRARRQLLVTYYELIGMKPNKEALTALDEQALDAFCHRLVDYLSTGHFSVYERIISEMSGDSPMIAAAQIYPALEGNTERLMQLYDSHLQQAINDDNCVDFQQALSEVGEALESRFTLEDKLIQLAWDNQLARPPVANDSTIALSKVAYRVKRKLVGVPLGAETVNSGSAEPDQSGARTVSVTPSGLRTSSFPLFSGNLLCLMLKPHVVNNARRRKNLSIRSREPPSLTHKRIWISGSRADIRVPMREIQLSPTHTGGSKDHPQYAENEPVPVYDTAGAYGDPHATINVHQGLAKLRAGWIAERNDSETISALSSSYSQQRLADDGLDHLRFEHLPQPRRAKAGRRVTQLHYARQGIITPEMEFIALRENMGRERIRSATLLQQHAGHGFGAQLPENISAEF

SEQ ID NO: 106695 - protein, 515 aa, Glycine max
  Coding DNA Sequence Number=SeqID_15010
  Gene Ontology: Mol. function=phosphoribosylaminoimidazolecarboxamide formyltransferase activity; Cellular component=integral to membrane; Biological process=purine nucleotide biosynthetic process
  Homolog annotation: Hit_ID=P26978; Match level="QueryCoverage=95%, HitCoverage=93%, E-value=0.0, Identity=89%"; Hit description =Bifunctional purine biosynthesis protein purH [Includes: ...
  Homolog annotation: Hit description=Phosphoribosylaminoimidazolecarbox amide formyltransferase (EC 2.1.2.3) (AICAR transformylase); IMP cyclohydrolase (EC 3.5.4.10) (Inosinicase) (IMP synthetase) (ATIC)]
  Pfam annotation: Domain name=AICARFT_IMPCHas; Domain location=158 -482; Score=726.0; E_value=2.6e-215; Accession=PF01808.9; Description= AICARFTIMPCHase bienzyme
  Pfam annotation: Domain name=MGS; Domain location=40-153; Score =222.8; E_value=8.1e-64; Accession=PF02142.13; Description=MGS-like domain
  Pfam module annotation: Pfam domain module=AICARFT_IMPCHas::MGS; Domain location=158-482::40-153
MPRDVKDAPSGALPEPRDKTTMQQRRPVRRALLSVSDKAGILEFAQALSHRGVELLSTGGTARLLADAGLPVTEVSDYTGFPEMMDGRVKTLHPKVHGGILGRRGTDDAIMAEHAINPIDMVVVNLYPFAQTVAKADCSLEDAVENIDIGGPTMVRSAAKNHKDVAIVVKSSDYDAIIAELDANENSLTLETRFDLAIKAFEHTAAYDSMIANYFGSLVPAYHGESTAPAGRFPRTLNLNFIKKQDMRYGENSHQDAAFYIEEHVSEASVATAQQLQGKALSYNNIADTDAALECVKEFSEPACVIVKHANPCGVAAGDSILAAYERAYKTDPTSAFGGIIAFNRELDEATAQAIISRQFVEVIIAPSASEAALRVTAAKQNVRVLVCGQWQSRVAGLDFKRVNGGLLVQDRDLGMVDASQLRVVSQRQPTEQELRDALFCWKVAKFVKSNAIVYARDNMTIGIGAGQMSRVYSAKIAGIKAADEGLEVKGSAMASDAFFPFRDGIDAAAAVGIT

SEQ ID NO: 106696 - protein, 169 aa, Glycine max
  Coding DNA Sequence Number=SeqID_15011
  Gene Ontology: Mol. function=isocitrate lyase activity; Cellular component=cytoplasm; Biological process=carboxylic acid metabolic process
  Homolog annotation: Hit_ID=P0A9G7; Match level="QueryCoverage=98%, HitCoverage=38%, E-value=8e-82, Identity=84%"; Hit description =Isocitrate lyase
  Pfam annotation: Domain name=ICL; Domain location=1-169; Score=-83.7; E_value=9.1e-11; Accession=PF00463.12; Description=Isocitrate lyase family
MPGIEQAIARGLAYAPYADVLWCETSTPDLALAQRFAEAIHAQYPGKLLAYNCSPSFNWKKNLDDRTIARFQQALSEMGYRFQFITLAGIHSMWFNMFDLAHAYAQGEGMRHYVEKVQQPEFAARERGYTFSAHQQEVGTGYFDRITTVIQGGSSSVTALTGSTEAAQF

SEQ ID NO: 106697 - protein, 277 aa, Glycine max
  Coding DNA Sequence Number=SeqID_15012
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMLASDCRDANFFGLPRPILSLRWLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106698 - protein, 212 aa, Glycine max
  Coding DNA Sequence Number=SeqID_15013
MRGAPTKESLSPFLVRDLGAQSLKVIQRVHKAWRSPLKKDKEIRGIRNGVIGGYHGWLRVHTRGLDWLSKLKVINEENFEAPEEDEEVQALKLELGKARLAKEKFKSAATHIRKECIELQEENAATARALEQETKRARKEEYGREKFRGALWGSNSELKLRREERDRSRVHGMILKEELAACARSKRSLAQHLEATEQSMLAIIGQYKEELN

SEQ ID NO: 106699 - protein, 213 aa, Glycine max
  Coding DNA Sequence Number=SeqID_15014
  Homolog annotation: Hit_ID=UPI00006A2D9E; Match level="QueryCoverage =42%, HitCoverage=47%, E-value=9e-07, Identity=15%"; Hit description =UPI00006A2D9E related cluster
GLHVITFTELHVLAFKGQHVLAFRGLHILVFRGLHALAFRGLHVLVFRGLHALAFRGLHALAFRGLHVLAFNGLYTLVFRGLRVLTFSGLHICTLREFKFMGHPPDPGGGSTVRAQPEEEAIAQLLCIPGQDFTHATAKRRVRIMRPNMTTLTQIWMTLLLRNLLPSDHNVDLPLDHAHKTPSGPGEVEQGPGVFSSDYGPLSVLPGACPPSK

SEQ ID NO: 106700 - protein, 296 aa, Glycine max
  Coding DNA Sequence Number=SeqID_15015
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDKENDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 106701 - protein, 84 aa, Glycine max
  Coding DNA Sequence Number=SeqID_15016
MVIRTFRQPGTNEPVDAQRLTSSSAPFVIQGQRVGWQAEISYGRPHLLSTKANEFDGFYSCRPATFKPVNTRDSSLLGGDDQVR

SEQ ID NO: 106702 - protein, 233 aa, Glycine max
  Coding DNA Sequence Number=SeqID_15017
MRSWVRGQWIPFDADAIGQLLGYPLVLEEGQECEYGQRRNRSDGFDEEAIAQLLCIPGQDFARTAAGRRMRIMRTNMTTLTQIWMTLLLSNILPTDHNSDLPLPKCQLVYAILTRMSIHVAQLIADAIYIFAGMAPTRHPLDPDKSNRALGFPALITGLCQSFGVPVTPIKVIRPPITRAFIEKYCTQRQVQGGAPQAADAPPPHQAGPAGLFDTEQYLRHLVRQQAANHRAH

SEQ ID NO: 106703 - protein, 126 aa, Glycine max
  Coding DNA Sequence Number=SeqID_15018
  Subcellular localization annotation: CTP_CleavageSite=72; ConfidenceScore=5.22e-01
MPISPCKRIAPTKTPSGPEKVKQGPGVFSSGYGPLSVLQGARTPPARSRHHRDRAFKTPCGPEEVQQGLGVASSKYGSLSVLGSVCRPQQSHQTPLPIELSSRSTAPPGRRRAKHHSSIGMAGSGQ

SEQ ID NO: 106704 - protein, 306 aa, Glycine max
  Coding DNA Sequence Number=SeqID_15019
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSISPTETTTTCHHRQPRCATTVADRHHCTVQPLLPFFPLSSSFYFLPPIQLKSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106705 - protein, 74 aa, Glycine max
  Coding DNA Sequence Number=SeqID_15020
MIAVMNRCFDDNKDDDKGDDKKLKGQSKNEFKMFKIESRTLQDSRGKLNSRIIVKIQGSSFKNQDSRFKNQEKT

SEQ ID NO: 106706 - protein, 160 aa, Glycine max
  Coding DNA Sequence Number=SeqID_15021
GTSYVDANPFSVLSRNVDHVQQKLIYSISVTSGIFRAKCLGEPTFDFVVRVNFELHGVLFLSAVLPVQYEIGWCVQFAQSYRAGTSALASVSGVRRELTLTPAALMRCRSGRALSPFRETCRQLLNDGNARAIEAAFAITPAGERGMCARRLSWVQGVSQ

SEQ ID NO: 106707 - protein, 95 aa, Glycine max
  Coding DNA Sequence Number=SeqID_15022
MPYFGVIEEIWELNYVKFIVYVFKCKWFDSNIGVRTDETSLCSSKGFDLGGYSGERWRPFKSDLTSMGGYDFLEEKLMEDKKKEMIGGSSPIQEH

SEQ ID NO: 106708 - protein, 53 aa, Glycine max
  Coding DNA Sequence Number=SeqID_15023
MPISACRCIGITPTRRPVDPNKSNRALGFPALVTGLYSPTGCPFPWQGHVIMA

SEQ ID NO: 106709 - protein, 105 aa, Glycine max
  Coding DNA Sequence Number=SeqID_15024
  Homolog annotation: Hit_ID=Q9I2R1; Match level="QueryCoverage=100%, HitCoverage=35%, E-value=2e-54, Identity=99%"; Hit description =Putative uncharacterized protein
MADVAGADFLGSDAPGGFRRFAVEAQQRLDAASGHHFIVGERQRHDGRAYGGEGAADGLAIREGVLRMQAPASPLFDHPARQVADHAQAAPGKIAEQRRQQGRDE

SEQ ID NO: 106710 - protein, 134 aa, Glycine max
  Coding DNA Sequence Number=SeqID_15025
  Gene Ontology: Biological process=transposition, DNA-mediated
  Homolog annotation: Hit_ID=Q1J7G7; Match level="QueryCoverage=28%, HitCoverage=67%, E-value=7e-11, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTFPANLLPSAVRQFSILHFFRSPMNLLPSAVHVSSTNEFGAPRIYFLA

SEQ ID NO: 106711 - protein, 139 aa, Glycine max
  Coding DNA Sequence Number=SeqID_15026
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
  Subcellular localization annotation: CTP_CleavageSite=33; ConfidenceScore=5.22e-01
MALNSLSPLSINSLQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106712 - protein, 254 aa, Glycine max
  Coding DNA Sequence Number=SeqID_15027
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPEFDQTTKMKFSIAVLSSILAVCSVTVANPVDPSSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106713 - protein, 218 aa, Glycine max
  Coding DNA Sequence Number=SeqID_15028
  Gene Ontology: Biological process=transposition, DNA-mediated
  Homolog annotation: Hit_ID=Q1J7G7; Match level="QueryCoverage=18%, HitCoverage=71%, E-value=1e-11, Identity=72%"; Hit description =Transposase
DLPSQVLQWLLFLSAVPPVQLLTGWCVTAKAPPDISAGKCSGRVPFAIQAAQLLGRAIGAGLFAITPAGERGMCCKAIKLGNARVFPEFDMLIGILKLQRQLIPELGASVTVGLCVHVGSTAVDSTDHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 106714 - protein, 275 aa, Glycine max
  Coding DNA Sequence Number=SeqID_15029
  Homolog annotation: Hit_ID=Q6UUU1; Match level="QueryCoverage=21%, HitCoverage=40%, E-value=4e-18, Identity=78%"; Hit description =Putative uncharacterized protein
LAQRLPGINRDTRIYLFCEVISVTGIYSAQSASAVPPVQLLTGWCVTAKAPPDISAGKCSGRVPFAIQAAQLLGRAIGAGLFAITPAGERGMCCKAIKLGNARVFPEFDIRKDKLKVTRDNQKIGKNPHTLSVSDCWECKQRPHGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106715 - protein, 284 aa, Glycine max
  Coding DNA Sequence Number=SeqID_15030
  Gene Ontology: Mol. function=protein binding; Cellular component=cell projection; Biological process=actin filament organization
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPEFDVTRHLIKLLLLRGYAFNRTADFETVRRIKEQLCYVSYDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106716 - protein, 327 aa, Glycine max
  Coding DNA Sequence Number=SeqID_15031
  Homolog annotation: Hit_ID=Q6UUU1; Match level="QueryCoverage=18%, HitCoverage=40%, E-value=5e-18, Identity=78%"; Hit description =Putative uncharacterized protein
MVKVGTSYVPINVSFSPKSWPRASRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIHIFFLACNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 106717 - protein, 68 aa, Glycine max
  Coding DNA Sequence Number=SeqID_15032
VSSSEEDPEEDPEELPPEPTVDDLDLPEDDEDPLPDVDSPKDIMSASEADSIEESGPGGTANSEDSSS

SEQ ID NO: 106718 - protein, 100 aa, Glycine max
  Coding DNA Sequence Number=SeqID_15033
QVEGTSTLLFKENKGGYIPCGSLLVKDFTRLKEISRIAGCLGTGSSLACLFIGKWALGAMEARPGELSLSHEAMSSPRRASYLTLKSFVARASQRLAWAS

SEQ ID NO: 106719 - protein, 99 aa, Glycine max
  Coding DNA Sequence Number=SeqID_15034
MGVEHYLQHLVRQQAANHRGQVQIHECLYQFSLSQQGQGSTHFVCLTPEQFGAEVAWPGDWPDAQAGEEPAGSPGEVDESHIDEDMTDLLGFLGGSGAA

SEQ ID NO: 106720 - protein, 250 aa, Glycine max
  Coding DNA Sequence Number=SeqID_15035
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTFIGYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106721 - protein, 176 aa, Glycine max
  Coding DNA Sequence Number=SeqID_15036
  Homolog annotation: Hit_ID=A0LZU9; Match level="QueryCoverage=86%, HitCoverage=56%, E-value=3e-21, Identity=37%"; Hit description =Secreted protein
FNSGGTTSNDGIIIGTEMLKNLDGVTGLIAHELIHFQQNIMGNDMLLKYTLLEGGADFVSELISGENINVKAFQYGEAHADPLKKEFVALLKGNNATDWLYETSKKDDRPNDLGYWMGYKISEAYFNKQTDKHKAIHDILNIKDPLLFLKESGFLDQYIKEYTKKGHKKFEDFFKA

SEQ ID NO: 106722 - protein, 16 aa, Glycine max
  Coding DNA Sequence Number=SeqID_15037
MLPLRDKKVAPRNSKP

SEQ ID NO: 106723 - protein, 80 aa, Glycine max
  Coding DNA Sequence Number=SeqID_15038
MANDGNKKDSNSSYSLHHSDHPGMVPSAHVQPLVNGLTELQLQQILFIMHDNGASQSATPKANNVNFSSGFDDGDDDWFG

SEQ ID NO: 106724 - protein, 263 aa, Glycine max
  Coding DNA Sequence Number=SeqID_15039
  Gene Ontology: Mol. function=receptor activity; Cellular component =outer membrane-bounded periplasmic space; Biological process=amino acid transport
  Homolog annotation: Hit_ID=A8GGR1; Match level="QueryCoverage=100%, HitCoverage=70%, E-value=1e-123, Identity=85%"; Hit description =Extracellular ligand-binding receptor precursor
  Pfam annotation: Domain name=ANF_receptor; Domain location=1-257; Score=35.3; E_value=2.5e-08; Accession=PF01094.19; Description =Receptor family ligand binding region
MPASEVYDEAGIIAITPGSTNPQITERGMKTMFRMCGRDDQQGVIATNYMLDTLKAKRIAVIHDKDTYGQGLADAAKAAMNKRGVKEVLYEGLSRGEKDFNALVTKIASVKPDVVYFGGCHPEAGPLVRQMREQGVTAKFFSGDCVVTEELVTAAGGPQYTNGVLMTFGNDPRQIPEGKAVIAKFRASGFEPEGYTLYSYASIQAIAAAFNATGGKDSAKAAEWLKSHDVDTRDGQKSLGSEGRPEGLGLRVYQWMTGKYHQL

SEQ ID NO: 106725 - protein, 130 aa, Glycine max
  Coding DNA Sequence Number=SeqID_15040
  Gene Ontology: Mol. function=lipid binding; Cellular component=plasma membrane; Biological process=endocytosis
  Homolog annotation: Hit_ID=A7P4G8; Match level="QueryCoverage=91%, HitCoverage=26%, E-value=6e-47, Identity=65%"; Hit description =Chromosome chr4 scaffold_6, whole genome shotgun sequence
  Pfam annotation: Domain name=ENTH; Domain location=22-117; Score =101.8; E_value=2.1e-27; Accession=PF01417.11; Description=ENTH domain
MGLEICFCENRKREVNLKVLKVPEIEPKVLDATDNEPWGPHGTVLAEISQATEKFTKCQMVMNVLWTRLGETGKDWRYVYKELSSFEYVEPSGKDVRLNVRTNAENIVSLLNDKDKIHEVRNKAAANRDK

SEQ ID NO: 106726 - protein, 202 aa, Glycine max
  Coding DNA Sequence Number=SeqID_15041
MTGRLLAGSLTFDCRIMHYIIVRILLPRSFNLAQASEEDLILMWAFHTGHQIDWAHLVRYRMHKALRANAPLPYPQLVTFFLRHFQIPLDDEPFVQVKRSFAIDAGAITSLGYRKDRNGQWQKKDTLPPEDERTPSPPPQRDDSSALMTEVLTELWGLHTYVGERFDSLDGRFEGMDTRITQLKEDVTYLHRCFDLPPPSKS

SEQ ID NO: 106727 - protein, 130 aa, Glycine max
  Coding DNA Sequence Number=SeqID_15042
LLEPSRYFCSISRAQEGSGESHIGGPSNTTTLYFCIDSSFATATISGAFITHVVEHSPRLVLDHPGIVVDRDNTPPAHFDARGIPSELAATAKEPTTIIVEESPEVAIAEEEPTVATTVDGLTSVPIRPK

SEQ ID NO: 106728 - protein, 73 aa, Glycine max
  Coding DNA Sequence Number=SeqID_15043
EATWLAWASWARLGELGGNHLPYFAINRGGSEEEKAEALPKRFRNVFHEEFRKGFDRSSTFFIRSSSFFDLQR

SEQ ID NO: 106729 - protein, 191 aa, Glycine max
  Coding DNA Sequence Number=SeqID_15044
MGDQEETQEQMKADMSALREQMASMMEAMLGMRQLMEKNMATAAAVSSAAKADPTLLATAHHPPPNTVGRGSSTLGHNSNPHLGYNRVAYPYGLPPNYTPPVMQDDVGHVSSPILEGEPPRQLDEVHEDHQEYAQGDVKFYPPNPRRGAGTQHFASAQPHSTTNILVHKKTNPDGRRKKETRSPRGEIESC

SEQ ID NO: 106730 - protein, 131 aa, Glycine max
  Coding DNA Sequence Number=SeqID_15045
  Homolog annotation: Hit_ID=Q602K5; Match level="QueryCoverage=51%, HitCoverage=100%, E-value=6e-21, Identity=71%"; Hit description =Putative uncharacterized protein
  Pfam annotation: Domain name=DUF1458; Domain location=73-131; Score =131.8; E_value=2e-36; Accession=PF07311.3; Description=Protein of unknown function (DUF1458)
VTTMDGWDVIEPAEPGGKPGKVRLRDSIELTPGNVRVYNENEIHSPRRDGPAKLIRIEGNPNQSLPGRVWQPLVGSSTVSSDDAIKNAIERAAKTLNHLNWFEVVETRGHIADGKVAHFQVTLKVGFRIEE

SEQ ID NO: 106731 - protein, 63 aa, Glycine max
  Coding DNA Sequence Number=SeqID_15046
MTTSSRNISRPSCIICPMPLSAASSSAATRMVHEREKAILSPVNTGGVIAGIISLRYSVVLGE

SEQ ID NO: 106732 - protein, 285 aa, Glycine max
  Coding DNA Sequence Number=SeqID_15047
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMVFADCLFMPSSNVKQFLAGCGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106733 - protein, 81 aa, Glycine max
  Coding DNA Sequence Number=SeqID_15048
MGKVEEVQEQMKADMEAMKEQMATMMEAMKEQMATMMEAMMSMKKIMEANAVAIAATSAIAKVNPMPPFGLNQMNHPTLDM

SEQ ID NO: 106734 - protein, 295 aa, Glycine max
  Coding DNA Sequence Number=SeqID_15049
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFRQKLAQGFPWLLFLSAVPPVQLLTGWCVTAKAPPDISAGKCSGRVPSAIQAAQLLGRAIGAGLFAITPAGERGMCCKAIKLGNARVFPVTTLANWSSTAVAAALELVDPPGCRNSISTKWVSCGIMAVDSVDSALLTSQDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106735 - protein, 279 aa, Glycine max
  Coding DNA Sequence Number=SeqID_15050
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMQSIIDAINSSIFDENWQNIFDPIDPSTSDKDWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106736 - protein, 110 aa, Glycine max
  Coding DNA Sequence Number=SeqID_15051
  Homolog annotation: Hit_ID=A5AHS1; Match level="QueryCoverage=59%, HitCoverage=6%, E-value=2e-13, Identity=44%"; Hit description =Putative uncharacterized protein
MPGRKIPHSPAPSALLPIGGCLSADAMPPVPSSDSLEKVLNRCTETNLVLNFEKCHFMVEQGLYRHFIRDFSKAPDWIAPFELMCATSNYTLGVVLAQKISLLQLTSFPP

SEQ ID NO: 106737 - protein, 108 aa, Glycine max
  Coding DNA Sequence Number=SeqID_15052
MLIIIDQYKEKVNLAASHGQMLRDKQAKVSALRVKREAREEVMELLHKEGMKWMDRFALTLNESQELPKLLAKAKTVVDTYSAPDEVHSLFNYCQHMVELMTHIIRNR

SEQ ID NO: 106738 - protein, 336 aa, Glycine max
  Coding DNA Sequence Number=SeqID_15053
  Gene Ontology: Biological process=transposition, DNA-mediated
  Homolog annotation: Hit_ID=Q6UUU1; Match level="QueryCoverage=17%, HitCoverage=40%, E-value=5e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMYTLLSLYSSLAVFFGDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWA

SEQ ID NO: 106739 - protein, 276 aa, Glycine max
  Coding DNA Sequence Number=SeqID_15054
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSITKKALALAAAVGMSLGLSPLTVATASAATVNKTIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106740 - protein, 73 aa, Glycine max
  Coding DNA Sequence Number=SeqID_15055
MSSRRGQVPVVTMAKGGELDTAEPEEIAQDECLGNKAEKGVVKRSQKADQRLSYSTDSDYSTLDASDAFFGRA

SEQ ID NO: 106741 - protein, 154 aa, Glycine max
  Coding DNA Sequence Number=SeqID_15056
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=7e-25, Identity=55%"; Hit description =Putative uncharacterized protein
  Subcellular localization annotation: CTP_CleavageSite=25; ConfidenceScore=5.29e-01
MTMITPSSKLTLTKGNKSWYRAPPRVEVKRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106742 - protein, 40 aa, Glycine max
  Coding DNA Sequence Number=SeqID_15057
MASIMTRIIKFPVINNGALKKCTLTGWSVAALASSSSGGG

SEQ ID NO: 106743 - protein, 140 aa, Glycine max
  Coding DNA Sequence Number=SeqID_15058
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
  Subcellular localization annotation: CTP_CleavageSite=34; ConfidenceScore=5.12e-01
MVDVFSFQLQLNLSSISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106744 - protein, 67 aa, Glycine max
  Coding DNA Sequence Number=SeqID_15059
MYEYPRRTRTLTCKHSFQNSYRYSCFVGKKEMAPKKLSMKRSRRDATGEGPSAAPEFDSHRFRSVEH

SEQ ID NO: 106745 - protein, 84 aa, Glycine max
  Coding DNA Sequence Number=SeqID_15060
  Homolog annotation: Hit_ID=A5AWG3; Match level="QueryCoverage=100%, HitCoverage=16%, E-value=2e-07, Identity=37%"; Hit description =Putative uncharacterized protein
MNIEESIHVTFDESNAILSRKNMLDDIAESLEQIHIHGQDSKEKGKGSNEDPLEEAKSNNELPKEWKVSKDHPLDSIIGDISKG

SEQ ID NO: 106746 - protein, 144 aa, Glycine max
  Coding DNA Sequence Number=SeqID_15061
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MGSRACKFTCRIIIYWVSSRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106747 - protein, 212 aa, Glycine max
  Coding DNA Sequence Number=SeqID_15062
  Gene Ontology: Biological process=transposition, DNA-mediated
  Homolog annotation: Hit_ID=Q6UUU1; Match level="QueryCoverage=28%, HitCoverage=40%, E-value=2e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTFLVRLKDAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106748 - protein, 156 aa, Glycine max
  Coding DNA Sequence Number=SeqID_15063
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=81%, HitCoverage=96%, E-value=2e-25, Identity=51%"; Hit description =Putative uncharacterized protein
  Subcellular localization annotation: CTP_CleavageSite=39; ConfidenceScore=5.23e-01
MTMITPSSKLTLTKGNKSWFFPIKHFPLSNPGNKIDQLRRMLLAADSSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 106749 - protein, 76 aa, Glycine max
  Coding DNA Sequence Number=SeqID_15064
MAAEWRRKRERRRHFKEKMSLEEAHHHRRPWIRAWRKKEMNEGRGRKEHEILCSKRALKSEPTNPRSIPRFSTKCA

SEQ ID NO: 106750 - protein, 72 aa, Glycine max
  Coding DNA Sequence Number=SeqID_15065
MLLQSDRWDFENNKFGLPLSENGMLSAIPIEGNCAEGPKAALSPIPIEGNCAELPKETCVGSTSMNEREPFE

SEQ ID NO: 106751 - protein, 178 aa, Glycine max
  Coding DNA Sequence Number=SeqID_15066
  Subcellular localization annotation: CTP_CleavageSite=65; ConfidenceScore=5.06e-01
MSSLVIITPTFLCRSVSWCMPPTRHPLDPNKSNRALGFPALITGLCQLFGVPVTPSKVIRPSITRAFIEKYCTPRQAQGDAPQAVDASPPPHQADPAGSLGMERYLQHLLSLSQQGQGFAPFACPTPDQFRAEVAWPRDWPEAQAGEVPAGSLGDAEEARMDEEMTDLLDFLGGSGAT

SEQ ID NO: 106752 - protein, 294 aa, Glycine max
  Coding DNA Sequence Number=SeqID_15067
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIRNILSLRCFKLAWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106753 - protein, 150 aa, Glycine max
  Coding DNA Sequence Number=SeqID_15068
  Gene Ontology: Mol. function=helicase activity; Biological process =viral genome replication
  Homolog annotation: Hit_ID=Q2R1R7; Match level="QueryCoverage=94%, HitCoverage=8%, E-value=8e-18, Identity=34%"; Hit description=AT hook motif-containing protein, putative
MGFLQDDREYVEAIKEAKGWGTTNYLRKLVVLILLTGAMTKPKEVWNQCWHWLADDIAYQYSKSTINSEVQINDDTLRNLTLIEIEQLLHINQISLIDYPTMPYPQDINLTSYLQNNLVLSELDYNHDATRSEFEHLFASMTGNLPIHIL

SEQ ID NO: 106754 - protein, 155 aa, Glycine max
  Coding DNA Sequence Number=SeqID_15069
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=5e-25, Identity=55%"; Hit description =Putative uncharacterized protein
MTMITPSSKLTLTKGNKSCFDDQYIWYKKDPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106755 - protein, 262 aa, Glycine max
  Coding DNA Sequence Number=SeqID_15070
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=71%, E-value=4e-24, Identity=69%"; Hit description=LacZ protein
MTPVNRKAGTGERTREPPGGNAGIFIVLSGFATTDLSVRFRDACQGGGAYGKTALPRPSHFPVKYLPGIFQEISAPFPFFSCHMKHFTDTLISANIETAMTMITPSSKLTLTKGNKSWYRAPPRVLLCLHLSTYSTATSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106756 - protein, 74 aa, Glycine max
  Coding DNA Sequence Number=SeqID_15071
KLEDASEDRGSSSGVVTASKSCKKFLILSALRLLQVALISKSMGIKSLAVDLLCIQEKQNNNYPFQKNNKMCNN

SEQ ID NO: 106757 - protein, 152 aa, Glycine max
  Coding DNA Sequence Number=SeqID_15072
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MVWLDGQGLRRRMTGKLVTKKSGEEGCGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106758 - protein, 258 aa, Glycine max
  Coding DNA Sequence Number=SeqID_15073
  Homolog annotation: Hit_ID=Q6WAY6; Match level="QueryCoverage=96%, HitCoverage=40%, E-value=2e-08, Identity=24%"; Hit description =Putative uncharacterized protein
MGTRGCISYNLVLAIRQLGYPMREAPLEDELAPVISRGFNKTNMETLQKVHKAWEVLRKKDKELRGSNNGPISGCRKWLKVHMHGLDWLPSLRTTKRKEVEAPEEDKEVQALWAELEQAQTVKEKFESAALKIRKENTELRDVNVATTKALERETKRACREELGRNKFRGALWGSNSELKLRRVERDQSRVDSLILRDELKACSRSKRSLSQRLCETETNMLANITKYQEELNLAAVHEHRVADEYAQLYAKKEARGK

SEQ ID NO: 106759 - protein, 146 aa, Glycine max
  Coding DNA Sequence Number=SeqID_15074
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=75%, E-value=2e-24, Identity=68%"; Hit description=LacZ protein
  Subcellular localization annotation: CTP_CleavageSite=13; ConfidenceScore=5.12e-01
MESHCHPGWSTVVQSRLTVTFASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106760 - protein, 57 aa, Glycine max
  Coding DNA Sequence Number=SeqID_15075
MTKSKGKDPLEGLGGPMTRARARKAKEALQQVLSILFEYKPKFQGEQSKVVNGNKLF

SEQ ID NO: 106761 - protein, 67 aa, Glycine max
  Coding DNA Sequence Number=SeqID_15076
AIVFGGTQRQIMVILRRVSTKRNEFDSIWMMLVVGGAYSNQAHLGLPGSSPEGGAFRRKQPSSPGQA

SEQ ID NO: 106762 - protein, 168 aa, Glycine max
  Coding DNA Sequence Number=SeqID_15077
  Gene Ontology: Mol. function=transporter activity; Cellular component= outer membrane-bounded periplasmic space; Biological process=transport
  Homolog annotation: Hit_ID=A6T9C6; Match level="QueryCoverage=100%, HitCoverage=64%, E-value=8e-84, Identity=94%"; Hit description =Cysteine transport protein
  Pfam annotation: Domain name=SBP_bac_3; Domain location=1-168; Score =11.3; E_value=1e-08; Accession=PF00497.11; Description=Bacterial extracellular solute-binding proteins, family 3
MARYLAKQMKLKLQLVPVTSANRVPYLQTDKVDLVISSLGKNPEREKVIDFSRAYAPFFLGVFGPKGAELKDAAGLSGKTIGVTRGAVEDMVLTSLAPKDANVKRYEDNNTTLSAYLSGQVQYVATGNLVVAAISRQNADKAPVPSFMLKDSPCFIGLKKNEPALKAK

SEQ ID NO: 106763 - protein, 217 aa, Glycine max
  Coding DNA Sequence Number=SeqID_15078
  Gene Ontology: Mol. function=nucleoside-triphosphatase activity; Cellular component=plasma membrane; Biological process=amino acid transport
  Homolog annotation: Hit_ID=A2YG41; Match level="QueryCoverage=37%, HitCoverage=13%, E-value=1e-22, Identity=68%"; Hit description =Putative uncharacterized protein
MTMLCVTHEMGFARTVADRVIFMDRGEIVEMAPPEEFFANPKSERTRAFLSQVFYCDKGHGRKQKSPEQMFRAFVFDAWQFPTLAWGDPTLPSALRRFTSEFGMGSESNWGPHPYQGCALPTEPYQHTKFDAWQFPTLAWGGPTLPSALRRFTSEFGMGSGGTTALLPPGKFCFRPRLSRSDCVAPLAPLSHILLYAPSRRLACRLVTAQNPLDVIR

SEQ ID NO: 106764 - protein, 64 aa, Glycine max
  Coding DNA Sequence Number=SeqID_15079
MLKKLAYTPCKNTFDQNLEKFRQLSPAIATWIDHISRKNGPWAYDKEGCRYGHMTTNLSECVNK

SEQ ID NO: 106765 - protein, 108 aa, Glycine max
  Coding DNA Sequence Number=SeqID_15080
RVPFAIQAAQLLGRAIGAGLFAITPAGERGMCCKAIKLGIRSVRCRPAGPAGAFRPGLQPDPPGAGATGTGDQAYRYRRPRGGARYQLLFPLVRVNFELGVIMVIAVS

SEQ ID NO: 106766 - protein, 292 aa, Glycine max
  Coding DNA Sequence Number=SeqID_15081
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIMPCMPAVFFVLICTHCGSANNGIIHFGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 106767 - protein, 211 aa, Glycine max
  Coding DNA Sequence Number=SeqID_15082
  Gene Ontology: Cellular component=cell outer membrane; Biological process=membrane organization and biogenesis
  Homolog annotation: Hit_ID=Q1GZC1; Match level="QueryCoverage=97%, HitCoverage=25%, E-value=5e-65, Identity=56%"; Hit description=LPS -assembly protein precursor
MTLALTSRLIDSDTGIERLSATLGQRFYFEDEKVTLPTTTSSTRKSSDILAGFTARLSSRLNLDTFWQYDPDRGNMQRNNYLLRYNPEPGKSFSFGYRYTANTLEQFDTSAQWPLGTGWYGIGRLNYSIRDGNAVQFLGGLEYDAGCWQARAVMQRVQTATANANYAMFFQLELGGLTSIGANPLNVIKRNIPSYMRTYDIPSTYRDQNTQ

SEQ ID NO: 106768 - protein, 117 aa, Glycine max
  Coding DNA Sequence Number=SeqID_15083
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=87%, HitCoverage=10%, E-value=7e-09, Identity=38%"; Hit description =Gag/pol polyprotein, 3'-partial, putative
  Pfam annotation: Domain name=G-patch; Domain location=35-79; Score =28.7; E_value=2.1e-05; Accession=PF01585.14; Description=G-patch domain
MEAAEESLETTFQSFEVVSIASIDSLSRPPHLSDAAMMVARVMLGHGYEPGMGLGKNNGGRTSLVSTRGNRGNFGLGYKPTQANIRKISQKGRTKARARGRDNKPKRLCRATSAGTS

SEQ ID NO: 106769 - protein, 241 aa, Glycine max
  Coding DNA Sequence Number=SeqID_15084
MTYKITLKGNRNFRATERKREKFADNASAEIWEGERKVEEMLLNWGKANDKIEGKVLPNSGGNCKRLKETSWFPGFLQFPHGCPKGWNGIPPTIRKYGMWDNASVVTLPEPGQYWIDDDDKGMTQENAMGCDRWRRTASMVEPDVSDLRVKGKSKSGEASIGASLIASTYETTIESRQTEKTTKLDGGCPRWPLPHGTNLGKDKVAKSTPSSNVGCSIHGAIGSEIPSALVPTFTFIQLAS

SEQ ID NO: 106770 - protein, 554 aa, Glycine max
  Coding DNA Sequence Number=SeqID_15085
  Gene Ontology: Mol. function=sugar:hydrogen symporter activity; Cellular component=integral to membrane; Biological process =carbohydrate transport
  Homolog annotation: Hit_ID=Q1XF10; Match level="QueryCoverage=86%, HitCoverage=98%, E-value=0.0, Identity=72%"; Hit description =Putative polyol transporter 1
  Pfam annotation: Domain name=MFS_1; Domain location=24-429; Score =123.7; E_value=5.2e-34; Accession=PF07690.7; Description=Major Facilitator Superfamily
  Pfam annotation: Domain name=Sugar_tr; Domain location=20-478; Score =410.5; E_value=2.6e-120; Accession=PF00083.15; Description=Sugar (and other) transporter
  Pfam annotation: Domain name=Voltage_CLC; Domain location=18-387; Score=-176.8; E_value=0.036; Accession=PF00654.11; Description =Voltage gated chloride channel
  Pfam annotation: Domain name=Zip; Domain location=84-363; Score= -105.1; E_value=0.068; Accession=PF02535.13; Description=ZIP Zinc transporter
  Pfam module annotation: Pfam domain module=MFS_1::Sugar_tr::Voltage _CLC::Zip; Domain location=24-429::20-478::18-387::84-363
MEIERGNNNEHKGSRYAVACAVVTSMISIIFGYDTGVMSGALIFIKEELGISDTQQEVLAGILNICALFGSLVAGRTADYIGRRYTITLASILFMVGSVLMGYGPNYAILMTGRCVAGIGVGFALLIAPVYAAEISSTKSRGFVTSLPELCIGIGILLGYIVNYLFGKLILRLGWRLMLGIAAVPSLALALGILAMPESPRWLVMQGHLGKAKKVLLQVSDTEEEAELRLKDIKSAAGIDENCTEEIVKLPQKDNGEAVWKELIFRPSYSVRWMLIAAVGIHFFEHATGIEAVMLYSHRIFKKAGVTSKDKLLLTTIGVGLTKVICLIIATFFIDKVGRRPLLLVSVGGMVCSLGVLGFSLTMVDTSHEELLWALILSIVATYIYVAFFNLGLGPITWVYSSEIFPLKLRAQGASIGVAVNRLTNAAISMSFISIYNAITIGGAFFMFAGISVIAWAFFYFFMPETKGVALEEMEMLFSKNKGNNKRRGERKGVNETPRRGGSVVARSARHPLAQRMLNAFYFSYARLTPVAHSVHMTTLELNASLNACASWPA

SEQ ID NO: 106771 - protein, 516 aa, Glycine max
  Coding DNA Sequence Number=SeqID_15086
  Gene Ontology: Mol. function=protein binding; Cellular component =nucleus; Biological process=regulation of transcription
  Homolog annotation: Hit_ID=A7PUZ1; Match level="QueryCoverage=99%, HitCoverage=99%, E-value=1e-128, Identity=50%"; Hit description =Chromosome chr4 scaffold_32, whole genome shotgun sequence
  Pfam annotation: Domain name=GRAS; Domain location=133-431; Score =245.1; E_value=1.6e-70; Accession=PF03514.5; Description=GRAS family transcription factor
  Subcellular localization annotation: CTP_CleavageSite=51; ConfidenceScore=5.63e-01
MRVPVPSSPQANPKPTNNVVRTIALPNLNTTTTTTTTSLCYEPTSVLDLCRSPSPSPGTEKPTNDHAVLDLDDHALHNLDWDSIMKDLGLHDDSATPVLKTFLHPDDDNNNPSCDDFTPFDHALEFTSLSDIYSNQNLAFDFNHLPHDFNHHLNGFDFIEELIRAADCFDTKQLHVAQVILERLNQRLRSPVGKPLQRAAFYFKEALQSLLSGSNRTPRISSLVEIVHSIRTFKAFSGISPIPMFSIFTTNQIVLDHAACSFMHVIDFDIGLGIQYASLMKEIAEKAAESPVLRITAVVPEEYAVESTLVHDNLAQFALELRIRVQVEFVALRTFENLSFKSVKFVDGENTTVLLSPAIFGHLGNAAAFLADVRRISPSMVVFVDGEGWAETATASAASFRRGVVSSLEYYSMMLESLDASTVGGGGEWVRRIEMMQLGPKILAAVESAWRKLPPWREAFYGAGMRPVQLSQFADFQAECLLAKSQIRGFHVARRQNELVLFWHDRAMVATSAWRC

SEQ ID NO: 106772 - protein, 547 aa, Glycine max
  Coding DNA Sequence Number=SeqID_15087
  Gene Ontology: Mol. function=hydrolase activity; Cellular component =nucleus; Biological process=metabolic process
  Homolog annotation: Hit_ID=A7PN30; Match level="QueryCoverage=82%, HitCoverage=94%, E-value=1e-103, Identity=38%"; Hit description =Chromosome chr14 scaffold_21, whole genome shotgun sequence
  Pfam annotation: Domain name=PPR; Domain location=117-151; Score =44.4; E_value=4e-10; Accession=PF01535.11; Description=PPR repeat
  Pfam annotation: Domain name=PPR; Domain location=187-221; Score =11.7; E_value=0.32; Accession=PF01535.11; Description=PPR repeat
  Pfam annotation: Domain name=PPR; Domain location=314-348; Score =12.4; E_value=0.26; Accession=PF01535.11; Description=PPR repeat
  Pfam annotation: Domain name=PPR; Domain location=349-383; Score =22.6; E_value=0.0014; Accession=PF01535.11; Description=PPR repeat
  Pfam module annotation: Pfam domain module=PPR::PPR::PPR::PPR; Domain location=117-151::187-221::314-348::349-383
  Subcellular localization annotation: CTP_CleavageSite=33; ConfidenceScore=5.19e-01
MVMFVPLQHIVNRYCQNFQLLNLFLKPKSCTPSSSSLPSLFSWNAMMRLYVQMGHPLDACGDLSLIDVGVGIHGQTFKFGYDSDTFVQNTLLAMYMNAGEKEAAQLVFDLMLERTVISWNTMINGYFWNNCVEDAVKVYGRMMDVGVEPNCATVVSVLPACGLLKNVELGRDVHALVQEKGFWGDIVVWSALPDMYVKCGQMKEAWLLAKGMDEKDVCEGVKPNSVSIASLLSACGSLVYLNYGKCLHAWAIRQKLESEVIVETALIDMYAKCNHGNLSYKVFMGTSKKRTAPWNALLSGFIQNKLAREAIELFKQIATIAAYGKHGHGKMAVKLFNQLVQSGVKPNHATFTSVLHACSHAGLVDEGFSLFNFMLKQHQVIPHVDHYTCIVDLLGRTGRLNDAYNPIRTMPITPNHAVWGALLGACVIHENVELGEVAARWTFELEPENTGNYVLLAKLYATVGRWGDAEKIRDMVNEVGLRKLPAHSLVEVRDMILPFPMVVWLLLIPYTGHAATYSPIFLQDGNDCILTMRERNRAELGRYYLFL

SEQ ID NO: 106773 - protein, 512 aa, Glycine max
  Coding DNA Sequence Number=SeqID_15088
  Gene Ontology: Mol. function=sugar:hydrogen symporter activity; Cellular component=membrane; Biological process=carbohydrate transport
  Homolog annotation: Hit_ID=Q1XF08; Match level="QueryCoverage=94%, HitCoverage=97%, E-value=1e-162, Identity=61%"; Hit description =Putative polyol transporter protein 3
  Pfam annotation: Domain name=MFS_1; Domain location=38-444; Score =129.4; E_value=1e-35; Accession=PF07690.7; Description=Major Facilitator Superfamily
  Pfam annotation: Domain name=Sugar_tr; Domain location=34-492; Score =335.1; E_value=1.3e-97; Accession=PF00083.15; Description=Sugar (and other) transporter
  Pfam annotation: Domain name=Voltage_CLC; Domain location=36-403; Score=-176.2; E_value=0.033; Accession=PF00654.11; Description =Voltage gated chloride channel
  Pfam module annotation: Pfam domain module=MFS_1::Sugar_tr::Voltage _CLC; Domain location=38-444::34-492::36-403
MSAKDTNGQCQLPKEDGNGENGDSQKLNKYACACVTAATIISAIFGYVTGVMAGALLFIKEELQISDLQVGLLAGILNVCALPACMVAGRTSDYLGRRYTIILASVIFLLGSLLMGYGPSYSILIIGRCIVGIGVGFALIIAPVYSAEISSPSYRGFLISLPDVSLNFGLLLGYVSNYFLGKLSLKLGWRTMLVVPAVPSLVLVILMFKLVESPRWLIMQGRVGEARKVLLLVSNTKEEAEKRLKEIKGAAGIDEKCTEDIVHVPKQIRSGAGALKELLCKPSLPVRNILVAAIGVHVFQQVCGIESILLYSPRVFEKTGIMDKSMLLLATVGMGISQAVFTFISAFLLDRVGRRILLLISAGGVVVTLLGLGFCMTMVENSKEKQLWAMGFTIVFTYIFVAFVAIGIGPVTWVYSSEIFPLRLRAQGLAIGVTVNRIANVVVVTSFISIYKKITLGGTFFMYVGITALAWWFYYSLPETKGRSLEDMETIFGKNSKSEIQVKPELWISCMK

SEQ ID NO: 106774 - protein, 338 aa, Glycine max
  Coding DNA Sequence Number=SeqID_15089
  Gene Ontology: Mol. function=hydrolase activity, hydrolyzing O -glycosyl compounds; Cellular component=cytoplasm; Biological process= carbohydrate metabolic process
  Homolog annotation: Hit_ID=A7PNE3; Match level="QueryCoverage=76%, HitCoverage=98%, E-value=6e-93, Identity=66%"; Hit description =Chromosome chr1 scaffold_22, whole genome shotgun sequence
  Pfam annotation: Domain name=DUF689; Domain location=83-329; Score =244.8; E_value=1.8e-70; Accession=PF05093.4; Description=Protein of unknown function (DUF689)
  Pfam annotation: Domain name=Methyltransf_11; Domain location=75-166; Score=6.3; E_value=0.021; Accession=PF08241.3; Description =Methyltransferase domain
  Pfam module annotation: Pfam domain module=DUF689::Methyltransf_11; Domain location=83-329::75-166
MDIQTNNHSIPTTNSFYPLSMKELCLEVRVKASFGDNGLNLFQFQHGTKGCEEVWKSLQFSLGTNDQTLDEHFCMEMSRDGAVLACTDGAVLPVSQVFDAIRELGNGGLEQWDPLVLTSASLLSKLPVDSSSVDFVILIWLSIDCPVDQLIQEILRVLKVDGTILIRKSSQSAVGSFDKIISSLENKLLLAGFTEPQVLQSAGIKAKKPSWKIGSSFALKKVIRSSPKMQIDFDSDLIDEDSLLTEEDLKKPQLPPGDCEIGSTRKACKNCTCGRAEEEEKVLKLGLTTEQIDNPQSACGNCGLGDAFRCSTCPYKGLPAFKLGEKVALSGNFLAADI

SEQ ID NO: 106775 - protein, 172 aa, Glycine max
  Coding DNA Sequence Number=SeqID_15090
MCASSSRWRAFMSNSKVEASQVKAQAKKSLALEPVEKWRQGSHLGWRRDRNRDTEHCSSKEEEQRKTWIMKEPQGWVPNATMELMLLVVSLKAQAHCSHAKSSHGAKDFSEASTLESDMEALHLDGEAHMERIQKRCEEKIVSYQRKHDWTVAVLKFLLWTLKRSQGSIRLP

SEQ ID NO: 106776 - protein, 508 aa, Glycine max
  Coding DNA Sequence Number=SeqID_15091
  Gene Ontology: Mol. function=oxidoreductase activity; Cellular component=integral to membrane; Biological process=electron transport
  Homolog annotation: Hit_ID=A4PBE7; Match level="QueryCoverage=80%, HitCoverage=84%, E-value=0.0, Identity=85%"; Hit description =Cytochrome P450 enzyme
  Pfam annotation: Domain name=p450; Domain location=38-450; Score =34.4; E_value=3.3e-15; Accession=PF00067.13; Description=Cytochrome P450
MSDSLLTFHSLSTILALLPIFIFILIKRKQSKPRLNLPPGNMGWPFLGETIGYLKPYSATTIGEFMEQHIARYGTIYKSKLFGEPAIVSADAGLNRFILQNEGKLFECSYPRSIGGILGKWSMLVLVGDMHRDMRVISLNFLSHARLRTHLLKEVEKQSLLVLNTWNQNSTFSAQDEAKKFTFNLMAKHIMSMDPGDIETEHLKKEYVTFMKGVVSAPLNLPGTAYRKALKSRSIILKFIEGKMEERVRRIQEGNESLEEDDLLNWVLKNSNLSTEQILDLILSLLFAGHETSSVAIALAIYFLPGCPQAIQQLKEEHREIARAKKQAGEVELTWDDYKRMEFTHCVVNETLRLGNVVRFLHRKAVKDVNYKGYDIPCGWKVLPVIAAVHLDPSLFDQPQHFNPWRWQKNVGHARYRYASFLVMVRNHCPEWRIIKGCGLHAQWRIKWVHSHASQTVASENLHRLRVVTSFTNRKVIRGESVVVRVGVVPATKYVFEKQLNLTLMDFQ

SEQ ID NO: 106777 - protein, 108 aa, Glycine max
  Coding DNA Sequence Number=SeqID_15092
MEFNRSFRLSRSHHILLSSESVISECAKIAGYERLSQSLRLSGEYDFSDKQKNHKRSTVGLLGKVFSFRRVSTPHGEPNKVAETVVKKEKKRSSWLPDPDRRWPIQGW

SEQ ID NO: 106778 - protein, 305 aa, Glycine max
  Coding DNA Sequence Number=SeqID_15093
  Gene Ontology: Mol. function=nucleotide binding; Cellular component =intracellular
  Homolog annotation: Hit_ID=A8MR89; Match level="QueryCoverage=100%, HitCoverage=100%, E-value=1e-29, Identity=66%"; Hit description =Uncharacterized protein At3g50845.1
  Pfam annotation: Domain name=DUF59; Domain location=32-112; Score =13.3; E_value=4.7e-05; Accession=PF01883.10; Description=Domain of unknown function DUF59
MTLGLINANPVVHAKKERIARSDDPHADDAILDLALTNFVRDIRDPEHPYSLEQLSVLSEESITVDDKLGRILITFTPTVQHCSMATVIGLCLRVKLKHYFPPHFKSQRISSHHKVPMSFPGIKDSRVSLLVLICGVQWIMDLDSLQAVVVVTAIIANKITAGGSPLGILLPPLNQNWNFTLSVTCVHSVMTYKEAPTFPYEEHPAVSGQLVPSCNSGRSSILAVADQIAVIADEIMAIYGFLADDYLIHYSNISLQVDIKVSPGSHADEESVNKQLNDKERVAAALENPNLRQLVDECLYSNEL

SEQ ID NO: 106779 - protein, 232 aa, Glycine max
  Coding DNA Sequence Number=SeqID_15094
MSKYQSAPAVHVVVNANGGIYIVSSRERERIKRAHVTSGNSLPWICLFRSRGFSVSNPISVSLPLCLCHCHPPKENGIVSHSLLLSRSFSFPPQPRSNPNITNHTLLYTGKIYFQQNNDHSSNDSHSVSRYRASNPSNLQPTTTTATTSSFLAAVPCESRESKTKAKLVIIVTSCPESTPIAFAYATTVEVVVVEEKIPHILIDFWITTKGGERKLFKWILSNHQSKAILLS

SEQ ID NO: 106780 - protein, 397 aa, Glycine max
  Coding DNA Sequence Number=SeqID_15095
  Homolog annotation: Hit_ID=A7PUR9; Match level="QueryCoverage=57%, HitCoverage=96%, E-value=4e-60, Identity=53%"; Hit description =Chromosome chr4 scaffold_32, whole genome shotgun sequence
MPTFTAMALDRLIEPGASKPADKSAPTSMPVPNSQKLERGTSAPTKKSKVHQPPLKAALCITPEVTPLPDAPSSFPPSPYIINHKCRGPHLLKSSSEANALSEVNICCDENDNDKSLDAVDTSTAGDLQVTSTKPELVKEEKVNGVYEGQFDWSNDVDLQMDTEKLEVVEENAATELSMKFSSPGTEFYDAWEELSSEGMSQNSTYNIEAELCEIRLSLLVEVEKRKQAEESINNMRSQWESIRPGLYQAGIVFPAYLTAAVEDEQLISDPVEDLCQQVYIARFISNTIGKGIARAELDTEMEAQLEAKNFEIARLLERLHCYDTMNKEMSQRNQEAVEMAPRERQRSSRRQRWIWGSITTVIALSTAALAWSYLPTGKGSSSADNDLVPEHDDPAK

SEQ ID NO: 106781 - protein, 434 aa, Glycine max
  Coding DNA Sequence Number=SeqID_15096
  Gene Ontology: Mol. function=hydrolase activity, hydrolyzing O -glycosyl compounds; Cellular component=extracellular region; Biological process=carbohydrate metabolic process
  Homolog annotation: Hit_ID=A9PH08; Match level="QueryCoverage=94%, HitCoverage=93%, E-value=1e-178, Identity=74%"; Hit description =Putative uncharacterized protein
  Pfam annotation: Domain name=Cellulase; Domain location=39-373; Score= -77.5; E_value=0.032; Accession=PF00150.9; Description=Cellulase (glycosyl hydrolase family 5)
MKHFALVFLLAILVPQECFHVSVEARDDFVRTRGIHFMQNGYPYYANGFNAYWLMYTASDPSQRFKVSNAFREAASHGLTVARTWAFSDGGYRPLQYFPGFYNEQMFTGLDFVVSEARKYGIKLILSLVNNYENFGGKKQYVNWARSHGQYLTSDDDFFRSPVVKGYYMNHVRVLIYVHLPQTVLNRYNRFTGMHYKDDPTIMAWELMNEPRCTSDPSGRTIQAWITEMASFVKSIDRNHLLEAGLEGFYGQSTPQRKRLNPGFDIGTDFIGNNRIPAIDFATVHCYPDQWVSSSNIQYQLSFLNNWLSAHFIDAQYRIKKPILVAEFGKSFKSSSSYERDEVFNSVYYKIYASAKRGGAASGALFWQLLTEGMESFQDGYGIILGQSSSTANLIARQSRKLYLIRKIFARVANMRRWQRARARGGNGGRYIGN

SEQ ID NO: 106782 - protein, 183 aa, Glycine max
  Coding DNA Sequence Number=SeqID_15097
  Gene Ontology: Mol. function=metal ion binding; Biological process =metal ion transport
  Homolog annotation: Hit_ID=A5AVF3; Match level="QueryCoverage=38%, HitCoverage=50%, E-value=1e-18, Identity=65%"; Hit description =Putative uncharacterized protein
  Pfam annotation: Domain name=HMA; Domain location=57-117; Score=30.7; E_value=5.3e-06; Accession=PF00403.17; Description=Heavy-metal -associated domain
MIMQVATNISRQNQHKKKPRVRITCTNKTKDKYSSSFAGEGKQNQVSDYFSMVKKTVLKVDISCLKCKRKLLKIVSSIQGVDKIEADEGKGTLTVTGDADPYEIIVRIRKAGKHAEVVSVGPPQAPQKKDEKKPEEKKKPEAEKKDEKPKESSIHMPYYYPPYQPVVLYMNRYEEPNPSCTIL

SEQ ID NO: 106783 - protein, 705 aa, Glycine max
  Coding DNA Sequence Number=SeqID_15098
  Gene Ontology: Mol. function=nucleoside-triphosphatase activity; Cellular component=plasma membrane; Biological process=cell division
  Homolog annotation: Hit_ID=A7QBQ4; Match level="QueryCoverage=69%, HitCoverage=99%, E-value=1e-144, Identity=52%"; Hit description =Chromosome chr1 scaffold_75, whole genome shotgun sequence
  Pfam annotation: Domain name=AAA; Domain location=245-425; Score =60.2; E_value=6.8e-15; Accession=PF00004.20; Description=ATPase family associated with various cellular activities (AAA)
  Pfam annotation: Domain name=AAA_5; Domain location=245-386; Score= -15.8; E_value=0.046; Accession=PF07728.5; Description=ATPase family associated with various
  Pfam module annotation: Pfam domain module=AAA::AAA_5; Domain location=245-425::245-386
MPSPSSIFSAYASMTASIMLLRSMANELVPQPIRGYLYNTFGYLIRPRSQTLTLIIEESTGIARNQVYDSAEAYLSTRVSPENERLKISKSAKEKKLTVRLEKGEKVVDCFNGACFKWRFICAESEKNNPNDHSNNSISVRSEKRSFELSFPKKYKEMVLDSYLPFILDKAREMKDEERVLKMHTLNTSYCYSGVKWDSINLEHPSTFETLAMEPELKNAVIEDLDRFVKRKEFYKRVGRAWKRGYLLYGPPGTGKSSLIAAMANYLKFDVFDLELGSIVRDSDLRKLLLATANRSILVIEDIDCSVDLPERRHGDHGRKQADVQAHRASDGRMQLTLSGLLNFIDGLWSSCGDERIIIFTTNHKERLDPALLRPGRMDMHIHMSYCSYQGFKILASNYLETSSDHPLFGEVEGLIEDIQITPAQVAEELMKNEDPEATLEGFVKLLKRKKMEGDVCENSTPDKAEPTRQQSKRRKVGCKQKRGKSNSDTLGLNVELKQVIVDDLERFLRRKELYKKVGNPWKRASPNRKIKPPSSNELFVAAQEYLSAKITRLLNTCLDKRINFKFLDTRVVDCLRSQEPTRQDLRPHASGGQHCEVPHHGRVRRRANSAVAGSGKVTGLNQQHRPVHHRQRTKPMRLTRQGLGIWERILISFLAGTGAVAAVGAFGGVVFRGAGDDKFGRSDSGEELVDVQGDSLDSVVAASA

SEQ ID NO: 106784 - protein, 1045 aa, Glycine max
  Coding DNA Sequence Number=SeqID_15099
  Gene Ontology: Mol. function=transporter activity; Cellular component= intracellular; Biological process=transport
  Homolog annotation: Hit_ID=Q94FN0; Match level="QueryCoverage=46%, HitCoverage=97%, E-value=0.0, Identity=74%"; Hit description =Phosphatidylinositol transfer-like protein IV
  Pfam annotation: Domain name=AAA; Domain location=246-442; Score =46.1; E_value=1.2e-10; Accession=PF00004.20; Description=ATPase family associated with various cellular activities (AAA)
  Pfam annotation: Domain name=AAA_5; Domain location=246-387; Score= -13.1; E_value=0.028; Accession=PF07728.5; Description=ATPase family associated with various
  Pfam annotation: Domain name=CRAL_TRIO; Domain location=611-797; Score=149.2; E_value=1.2e-41; Accession=PF00650.11; Description =CRALTRIO domain
  Pfam annotation: Domain name=CRAL_TRIO_N; Domain location=525-594; Score=46.8; E_value=7.7e-11; Accession=PF03765.6; Description =CRALTRIO, N-terminus
  Pfam module annotation: Pfam domain module=AAA::AAA_5::CRAL _TRIO::CRAL_TRIO_N; Domain location=246-442::246-387::611-797::525-594
  Subcellular localization annotation: CTP_CleavageSite=45; ConfidenceScore=5.45e-01
MGFYTQNLFSSFTSASSWFEVYAAFSTFTMLLRTAFIQLIPQQFRSFIVSKLESFFSKYQANSEIRLKINKFWDKNSGDRNELFDAAQEYLPTRIIHTYKSLKVGKLQGEKHIELAVYGSEDVVDEFEGTKFTWKLDEEGSKQDSNNHNKKYSFELTFNEKHREKALDLYIPHVIKTYEVMKAERRIVRIYSWLDDDWNDSELSHPATFDSLALSPELKKDIIDDLERFLRRKEHYKKVGKPWKRGYLLYGPPGTGKSSLIAAMANYLKFDVYDLELTSVYSNSDLMQSMKEASNRSIVVIEDIDCNEELHARSIGLSDDQDSDADNEAAKVKTSRFSLSGLLNYMDGLWSSGGEERIIIFTTNHKEKIDPALLRPGRMDMYIHLSYLKGKAFRVLASNYLDIEGDHPLFEEIDELLEKLQVTPAVVAEQLMRNEDPDDALEALVTFLKEMDKDSNCDLELRGTMLDSLSSNPARPEEAINSNDTMSGTMSPKGSFKKKAINASNMLRNSLTRKGRRSSKVMSVEIEDVHDAEELKIVDEFRQALILDELLPAKHDDYHMMLRFLKARKFDIEKTKQMWSEMLKWRKEFGADTITEDFEFKELDEVLQYYPQGHHGVDKDGRPVYIERLGQVDATKMMQVTTMDRYIKYHVKEFERTFDVKFAACSIAAKKHIDQSTTILDVQGVGLKSFSKHARELVTRLQKIDGDNYPETLNRMFIINAGSGFRILWNTVKSFLDPKTTAKINVLGNKYDTKLLEIIDASELPEFLGGTCTCADQGGCMRSDKGPWKDAEVMRMVQNGDHKCSKKSASQGEEEKENSEEHKTSKLEANHTPQLSPVVEEEVPATKTSQPLSPMADKSAVKKVDEKASKPKDLAPTADKTAASTVCAQWLLINLPATAFSRAEFSTVMKRMAELEEKIVTINNKPTAMPPEKEQMLNATITRADDLEKQLLATKKALEDSLVKQEELSAYLDKKKKKKKKRFVCIPSKSVDAQTRGPDINGKLAFSFCLSGDFPNAPLTSMFNMRTSKYSKRSEEKHLLKIYEL

SEQ ID NO: 106785 - protein, 475 aa, Glycine max
  Coding DNA Sequence Number=SeqID_15100
  Gene Ontology: Mol. function=nucleoside-triphosphatase activity; Cellular component=plasma membrane; Biological process=cell division
  Homolog annotation: Hit_ID=A2WSC7; Match level="QueryCoverage=91%, HitCoverage=87%, E-value=1e-107, Identity=45%"; Hit description =Putative uncharacterized protein
  Pfam annotation: Domain name=AAA; Domain location=256-452; Score =50.7; E_value=5e-12; Accession=PF00004.20; Description=ATPase family associated with various cellular activities (AAA)
  Pfam annotation: Domain name=AAA_5; Domain location=256-398; Score= -17.9; E_value=0.065; Accession=PF07728.5; Description=ATPase family associated with various
  Pfam module annotation: Pfam domain module=AAA::AAA_5; Domain location=256-452::256-398
  Subcellular localization annotation: CTP_CleavageSite=16; ConfidenceScore=5.31e-01
MRTSLGSFSSPFTSFRSASSWFEVYAAFSTFMMLLRTAINDLIPHQVRTFIVTKIKALFSDRQNINQVSLQINEIWDGQINQLFQAAQEYLPAQISHSYKSLKVGKLPKHKNIAVAVDGTQEVVDLFQGIKLSWKLVEKSPKSDSDHRDHHPKSSGVGYERKSFTLSFDEKHRDVVMNKYINHVLSTYQDMQTEQKTIKIHSIGGRCWQKSDLTHPASFDSLALEPEQKQAIIDDLNRFLRRKELYKKVGKPWKRGYLLYGPPGTGKSSLIAAIANYLKFDVYDLELSSMFSNSELMRVMRETTNRSIIVIEDIDCNKEVHARPTTKPFSDSDSDFDRKRVKVKPYRFTLSGLLNNMDGLWSSGGEERIIIFTTNHRERIDPALLRPGRMDMHIHLSFLKGKAFRVLASNYLGIEDHSLFEEIDGLLEKLEVTPAVVAEQLMRNEDPEVALEGLVEFLKEKDKESLLRFMNETAD

SEQ ID NO: 106786 - protein, 41 aa, Glycine max
  Coding DNA Sequence Number=SeqID_15101
MEQRIQVHNYFSIHKRPHPLRKGHWRCGKDKGIQFVVMSPI

SEQ ID NO: 106787 - protein, 1187 aa, Glycine max
  Coding DNA Sequence Number=SeqID_15102
  Gene Ontology: Mol. function=metal ion binding; Cellular component =nucleus; Biological process=regulation of translational fidelity
  Homolog annotation: Hit_ID=A7QE27; Match level="QueryCoverage=36%, HitCoverage=64%, E-value=1e-104, Identity=48%"; Hit description =Chromosome chr4 scaffold_83, whole genome shotgun sequence
  Pfam annotation: Domain name=DUF726; Domain location=696-1057; Score =159.2; E_value=1.1e-44; Accession=PF05277.3; Description=Protein of unknown function (DUF726)
  Pfam annotation: Domain name=GYF; Domain location=236-291; Score =30.1; E_value=8e-06; Accession=PF02213.7; Description=GYF domain
  Pfam module annotation: Pfam domain module=DUF726::GYF; Domain location=696-1057::236-291
MEPQLQPKLDPAPEVVSGGGGDSEKSHVSDVTEVRDVDMAQANGACCPSVLKRKRGRPAKGNRVPKGIIPPSRQKQEEEDVCFICFDGGSLVLCDRREGDALKRIIPRVLSETRPFFAQRPNGIAGCTKKADFVSIRENKGLCGMCKKTIMLIENCAQGDKAAVDFDDKSSWEYLFKVYWTYLKEKLSLTFDEILQAKNPYKGVARLEASGVAVDVSSLLLSPKMELPINNFVNDKPWHYQDPTGKVQGPFSLLQLYKWDAFGYFPPDLRIWSVDETQDNSIFLTDVLSGKCTNNVSLPNNSQQLSLGTNSTLENKDNGQDGGENENNLSRNENSANHQIVERCEEQKVSDTCTQSNGKDESVRSNGWNSQSPGLTIQADGNNNEGQSGNSERREESPKCEISCHDVPHVYASLPSTVFSEKLNENPSDKLTEVHKIEVKSEDNGNFDLNKISEGRSNSGQSCQKQSDSEENSGLSSGQNWRCPDVTNPVCNISTWLSIFGEPNDLDESVSDLLAEVEAMESLGGLESPTSIMKCGEELTDGSITDCLSFADALSPMLDAGKGDALSSSGDLHLPSQTTTPDDPLKQADVHHHPQKISGEHSTKSSEVETHIRDLLEVIWMRFQLRKVTVLYELLSACLSDLGENNKKFSRRRKGYDAQQRVTLRLLATWLDIKWAKMVEQEASKEEIQSNEDKWAKWKRGGIIGAPALTGGTLMAITGGLAAPAIAAGLGALAPTLGTLIPVIGANEFAAAASAAGTVAGSVAVAASFGAAGAGLSGSKMARRVGDVDEFELKAVGKNHNQGRLGIMIMVSGFVFEDDDFIRPWEVLDDNLERYALQWESKNLFSLSTAIQDWLSSRIATELMKQGATMTVLHALLTALAWPAALLAATEFIDSTWTIAIDRASPGAAVKLCLGDLLVMGSNPETASLHMQGSDKAGKLLAEVLLGGLQGNRPVTLVGSIEFLAETENSAELVERVVLLGLPIAIKDENWEAARKMVAGRFVNAYSRNDWMLGVACFPCQCRPFAPLPFFLPPNFTCRPNAAFRQHDTRRRKLRFFRSGVLERRKRLLVCSGSTVSIFSTATGSLVSSLEGHTAVVVVPSSTGLSYCWTASVDGTICHWDFSVPECVKIIDLCLPIFSMTANVIAYVSVQDINAPDNHPKPLYGQIRKCNFVLSFGTVVGYEEDEA

SEQ ID NO: 106788 - protein, 357 aa, Glycine max
  Coding DNA Sequence Number=SeqID_15103
  Gene Ontology: Mol. function=DNA binding; Cellular component=nucleus; Biological process=regulation of transcription
  Homolog annotation: Hit_ID=A7QE08; Match level="QueryCoverage=100%, HitCoverage=99%, E-value=1e-132, Identity=69%"; Hit description =Chromosome chr4 scaffold_83, whole genome shotgun sequence
  Pfam annotation: Domain name=NAM; Domain location=5-134; Score=315.2; E_value=1.2e-91; Accession=PF02365.6; Description=No apical meristem (NAM) protein
MESCVPPGFRFHPTDEELVGYYLRKKVASQKIDLDVIREIDLYRIEPWDLQERCRIGYEEQNEWYFFSHKDKKYPTGTRTNRATMAGFWKATGRDKAVYERAKLIGMRKTLVFYKGRAPNGQKSDWIMHEYRLESDENGPPQASILVQFEVLRSNFALDGRPAFKKKTTGQTKTINIEGWESSYFYDEASGATSTLVDPIELISRQSQSFLAQNFMCKQELEADNLTCMHQDPFVQLPQLESPSLPLVKKPSTVSLVSDNNNEGEDNQNRLLFNNNNTKKVTTDWRALDKFVASQLSQEVNTHETNVGVLSSSFEPHDDNHDMALLLLQSSRDEGNRLSPFLNTSSDCDNGICVFEK

SEQ ID NO: 106789 - protein, 3267 aa, Glycine max
  Coding DNA Sequence Number=SeqID_15104
  Gene Ontology: Mol. function=phosphotransferase activity, alcohol group as acceptor; Cellular component=NuA4 histone acetyltransferase complex; Biological process=inositol lipid-mediated signaling
  Homolog annotation: Hit_ID=A7QDY4; Match level="QueryCoverage=100%, HitCoverage=85%, E-value=0.0, Identity=75%"; Hit description =Chromosome chr4 scaffold_83, whole genome shotgun sequence
  Pfam annotation: Domain name=FAT; Domain location=2178-2521; Score =120.1; E_value=6.6e-33; Accession=PF02259.14; Description=FAT domain
  Pfam annotation: Domain name=FATC; Domain location=3235-3267; Score =25.0; E_value=0.00027; Accession=PF02260.11; Description=FATC domain
  Pfam annotation: Domain name=PI3_PI4_kinase; Domain location=2920 -3180; Score=75.4; E_value=1.8e-19; Accession=PF00454.18; Description= Phosphatidylinositol 3- and 4-kinase
  Pfam module annotation: Pfam domain module=FAT::FATC::PI3_PI4_kinase; Domain location=2178-2521::3235-3267::2920-3180
  Subcellular localization annotation: CTP_CleavageSite=33; ConfidenceScore=5.21e-01
MKTIIWSITHAHSPRPQALVSPSSNLSPPQGVRGMREDEVCKASGVLKSGVHCLALFKEKDEEREMLHLFSQILAIMEPRDLMDMFSLCMPELFECMISNTQLVHIFSTLLAAQKVYRPFADVLVNFLVSSKLDVLKQPDSPAAKLVLHLFRFIFGAVAKAPSDFERILQPHAPVIMEFCMKNATEVERPLGYMQLLRTMFKALSGCKYELLLRDLVPMLQPCLNMLLAMLEGPTAEDMRDLLLELCLTLPARLSSLLPYLSRLMKPLVLCLTGSDELVSLGLRTLEFWVDSLNPDFLEPIMASVMSEVILALWSHLRPAPYPWGAKALQLLGKLGGRNRRFLKEPLALECKENPEHGLRLILTFEPATPFLVPLDRCINLAVEAVMNKNCGMDAFYRKQALKFLRVCLSSQLNLPGNVADEGSTSKQLSALLVSTVDQSSRRSELMEVKADLGVKTKTQLMAEKSVFKILLMTVIAANGGADLTDPTDDFVVNICRHFAVIFHIDSSSSNVSAAALGGSSLSNSVHVGSRLKSNACSNLKELDPLIFLDALVDVLADENRLHAKAALGALNVFAETLVFLARSKHTDFIMSRGPGTPMIVSSPSMNPVYSPPPSVRVPVFEQLLPRLLHCCYGLTWQAQMGGIMGLGALVGKVTVETLCLFQVRIVRGLIYVLKKLPIYASKEQEETSQVLTQVLRVVNNADEANSEARKQSFQGVVDFLAQELFNQNASIIVRKNVQSCLALLASRTGSEVSELLEPLYQPFLQPLIVRSLKLKTVDQQVGTVTALNFCLALRPPLLKLTPELVNFLQEALQIAESDDNAWVAKFINPKVMTSLTKLRTACIELLCTTMAWADFKTPNHSELRAKIISMFFKSLTCRTPEIVAVAKEGLRQHLKRWLEPEKLAQSQKSWKAGEEPKIAAAIIELFHLLPPAASKFLDELVTLTIDLEGALPPGQPLRDELAKSPQKILASAFSEFPIKSDVTVAPASTSTPSLLGEESVVAPSTDASNPPAPPPNATSDAYFQGLALIKTLVKLIPVTCKNIPIAKRTGAEPSASMGSGFSTVGVQLFTDIFALLMLVKESKWLVKCFLNYLRHDKNEVNVLFDILTIFLFHSRIDYTFLKEFYIIEVAEGYPPSMKKALLLHFLSLFQSKQLDHDHLVIVMQMLILPMLAHAFQNGQSWEVVDPSIIKTIVDKLLDPPEEVSAEYDEPLRIELLQLATLLLKYLQNDLVHHRKELIKFGWNHLKREDTASKQWAFVNVCHFLEAYQAPEKIILQALDILMPALPRRLPLGDSRMPIWIRYTKKILVEEGHSIPNLIHIFQLIVRHSDLFYSCRAQFVPQMVNSLSRLGLPYNTTAENRRLAIELAGLVVNWERQRQNEMKVVTDSDAPSQINDVFNPSSADSKRSVDGSTFPEDASKRVKPEPGLQSLCGVMSPGGPSSITNIETPGSASQPDEEFKPNAAMEEMIINFLIRVRLTSNLSRDDKYDAEAKVALVIEPKDKEASAMYKQALELLSQALEVWPNANVKFNYLEKLLSSIQPSQAKDPSTALAQGLDVMNKVLEKQPHLFIRNNINQISQILEPCFKHKLLDAGKSFCSLLKMIFVAFPQEATTTPADVKLLHQKLDDLIQKHVTTVTAPQTSSDDNNASSISFLLLVIKTLTERLQRDMGSSAGSHSRQGQRTDPDSAVTSSRQGADVGAVISNLKSILKLITDRVMVVSECKRSVSQILNALLSERGIDASVLLCILDVVKGWIEDDFCKQGTSVTPSSFLTPKEIVSFLHKLSQVDKQNFTPVALNEWDRKYLELLYGICADSNKYPLPLRQEVFQKVERLFMLGLRARDPEVRMKFFSLYHESLRKTLFTRLQFIIQIQDWGALSDVFWLKQGLDLLLAILVEDKPITLAPNSARVQPLLVSSSILELSGMPHKVNDVSEGSEDAPLTFETLVLKHAQFLNSMSKLQVADLLIPLRELAHTDANVAYHLWVLVFPIVWVTLLKEEQVTLAKPMINLLSKDYHKRQQASRPNVVQALLEGLQLSHPQPRMPSELIKYIGKTYNAWHIALALLESHVMLFPNDSKCSESLAELYRLLNEEDMRCGLWKKRSVTAETRAGLSLVQHGYWHRAQSLFYQAMVKATQGTYNNTVPKAEMCLWEEQWLYCASQLSQWDALADFGKSVENYEILLDSLWKLPDWTYMKEHVIPKAQVEETPKLRLIQAYFALHDKNTNGVGDAENMVGKGVDLALEQWWQLPEMSVHSRIPLLQQFQQIVEVQESARILMDISNGNKLSGNSVVGVQGNLYADLKDILETWRLRTPNEWDNMSVWYDLLQWRNEMYNSVIDAFKDFGTTNSALHHLGYRDKAWTVNRLAHIARKQSLFDVCVTILEKLYGHSTMEVQEAFVKITEQAKAYLENKGELTNGINLINSTNLEYFPAKHKAEIFRLKGDFLLKLNDSESANLNYSNAISLFKNLPKGWISWGNYCDMAYRETQDEIWLEYAVSCLLQGIKFGVSNSRSHLARVLYLLSFDTPNEPVGRSFDKYYEQVPHWVWLSWIPQLLLSLQRTEAPHCKLVLLKIATLYPQALYYWLRTYLLERRDVANKSELGRIAMAQQRTQQSISGTSVGSLGGLTDGNARVQGQAGSNLPSDIQAHQGSQPAGGIGSHDGGNSHGQEPERSTSAESSMHNGNDQPLQQGSGNEGGQNTLRRPGALGFVASAANAFDAAKDIMEALRGKHANLASELEILLTEIGSRFVTLPEERLLAVVNALLHRCYKYPTATTAEVPQSLKKELSGVCRACFSADAVNKHVDFVREYKQDFERDLDPESITTFPSTLSQLTERLKHWKNVLQSNVEDRFPAVLKLEEESKVLRDFHVIDVEVPGQYFTDQEIAPDHTVKLDRVAADIPIVRRHGSSFRRLTLIGSDGSQRHFIVQTSLTPNARSDERILQLFRVMNQMFEKHKESRRRHICIHTPIIIPVWSQVRMVEDDLMYSTFLEVYENHCARNDREADLPITYFKEQLNQAISGQISPEAVVDLRLQAYNEITKNLVNDNIFSQYMYKTLPSGNHSWAFKKQFAIQLALSSFMSFMLQIGGRSPNKILFAKNTGKIFQTDFHPAYDANGLIEFNEPVPFRLTRNMQAFFSHGVEGLIVSSMCAAAQAVASPKQSQHLWHHLAMFFRDELLSWSWRRPLGMPMAPMAAGGTMSPVDFKQKVITNVEHVITRVKGIAPQNFSEEEENVMDPPQPVQRGVTELVEAALNPRNLCMMDPTWHPWF

SEQ ID NO: 106790 - protein, 283 aa, Glycine max
  Coding DNA Sequence Number=SeqID_15105
  Gene Ontology: Mol. function=structural constituent of ribosome; Cellular component=ribonucleoprotein complex; Biological process =translation
  Homolog annotation: Hit_ID=P46286; Match level="QueryCoverage=79%, HitCoverage=87%, E-value=1e-124, Identity=92%"; Hit description=60S ribosomal protein L8-1
  Pfam annotation: Domain name=Ribosomal_L2; Domain location=33-112; Score=70.5; E_value=5.6e-18; Accession=PF00181.14; Description =Ribosomal Proteins L2, RNA binding domain
  Pfam annotation: Domain name=Ribosomal_L2_C; Domain location=118-253; Score=206.8; E_value=5.2e-59; Accession=PF03947.9; Description =Ribosomal Proteins L2, C-terminal domain
  Pfam module annotation: Pfam domain module=Ribosomal_L2::Ribosomal_L2_ C; Domain location=33-112::118-253
MGCVGLAPEVFDLDCEEKIDRQTRKGAGVKRKGAGSVFKSHTHHRKGPARFRSLDFGERNGYLKGVVTDIIHDPGRGAPLAKVAFRHPFRYKKQMELFVAAEGLYTGQFIYCGKKATLVVGNVLPLRSIPEGAVICNVEHHVGDRGVFARASGDYAIVISHNPDNDTSRIKLPSGSKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKTT

SEQ ID NO: 106791 - protein, 94 aa, Glycine max
  Coding DNA Sequence Number=SeqID_15106
MPYMTSSGLNSLTEPAANDGHKDCPSRNSLILTLFYTIENVKTIIKAPRSVVVRKPVLLVMQKIGRNDVRQAVVSGHNWEDARDKEGELGAYLE

SEQ ID NO: 106792 - protein, 28 aa, Glycine max
  Coding DNA Sequence Number=SeqID_15107
MASSAQFSTTLVVLCLFQFLAVPGYATG

SEQ ID NO: 106793 - protein, 1244 aa, Glycine max
  Coding DNA Sequence Number=SeqID_15108
  Gene Ontology: Mol. function=transferase activity, transferring phosphorus-containing groups; Cellular component=membrane; Biological process=two-component signal transduction system (phosphorelay)
  Homolog annotation: Hit_ID=A7QDV4; Match level="QueryCoverage=98%, HitCoverage=99%, E-value=0.0, Identity=66%"; Hit description =Chromosome chr4 scaffold_83, whole genome shotgun sequence
  Pfam annotation: Domain name=Cache_1; Domain location=288-367; Score=- 5.0; E_value=0.048; Accession=PF02743.9; Description=Cache domain
  Pfam annotation: Domain name=HATPase_c; Domain location=615-763; Score=121.9; E_value=1.9e-33; Accession=PF02518.17; Description =Histidine kinase-, DNA gyrase B-, and HSP90-like ATPase
  Pfam annotation: Domain name=HisKA; Domain location=502-568; Score =79.6; E_value=9.9e-21; Accession=PF00512.16; Description=His Kinase A (phosphoacceptor) domain
  Pfam annotation: Domain name=Response_reg; Domain location=1094-1237; Score=100.0; E_value=7.1e-27; Accession=PF00072.15; Description =Response regulator receiver domain
  Pfam module annotation: Pfam domain module=Cache_1::HATPase _c::HisKA::Response_reg; Domain location=288-367::615-763::502 -568::1094-1237
MAENKDEIYSECSPGSNSPMGSKCRYLFHRLCGCDTSWNKNSTPKSRRIFHRDVEKEEFQYASSHCLSSYYSVFVVRLAIMVMLAILIGLLTILTWHFTKIYTAKSLRSLAYGLRYELLQRPVLRMWNILNSTSEITTAQVKLSQYVIRRHSNPATQAEQVELYEAMRAVTWALFASRKALNSITINYKNGFVQAFHRDLKDNNTFYIYSDLSNYSMGASNSNEVNSISKHRAWDDKGLHGNYSSIWYREPLDPVSGEKIGKAMKIAPEDLINIAGLSQVPDGVASWHVAVSKFTDSPLLSAALPVWDSSNKTIMAVVGVTTALYSVGQLMRELVEMHSGHMYLTSQEGYLLATSTSAPLLETSTKPPKLKMAVDCEDNVIRLGAEWLQRTYGNNFPPSHEIHVENVKLGHQRYYIDSFFLNLKRLPLVGVIIIPRKYIMGQVDERAYKTLVILISASLCILVIGCVCILILTNGVSKEMNLRAELINQLEARRKAEASSNYKSQFLANMSHELRTPMAAVIGLLDILISDDCLTNEQYSTVTQIRKCSTALLRLLNNILDLSKVESGKLVLEDAEFDLGRELEGLVDMFSVQCMNHNVETVLDLSDDMPKVVRGDSARVVQIFANLINNSIKFTPSGHIILRGWCENQNSYVGSPLDQKKSRSLQKCIERPNANHAKRTSVKDNKVILWFEVDDTGCGIDPSKWDSVFESFEQADPSTTRLHGGTGLGLCIVRNLVNKMGGDIRVVKKEGSGTLMRLCLLLSAPMDVTEQQCAVDLTDNGLVVLLALHGNMGRLITSKWLQKNGVCTMEASDWNGLTQILRELFHAGSSVHNTDFEAHYPAKEELKSKLLNIRDMRNPGFVIVVDIGLLDLSTDIWKEQFNFLHRYFGRAKFVWMLNHDTSNTIKMELRRKGHILMVNKPLYKAKMIHILEAVINERNLELQKKNMIAPRTTMKEGDLHEFLEIDSTHFDGASSDDSDISEISGSNPVSANGDKPVEKLENSHPSSPHHMNNCLVRLTNENECLEEHNLRKEESSSPSSSSATEDNQPKSLSTKESSSISTEDQDEDSECGDTNRVTSSSKAVVDGKKSLEGLKILLAEDTPVLQRVATIMLEKMGADVVAVGDGQQAVDALNCMFTAEDCRRESLQKERNTRSQTEISTCRPYDLILMDCQMPKMDGYEATKAIRKSEVGTSRHIPIVALTAHAMSCDEAKCLEVGMDAYLTKPIDFKMMVSTILSLTKRTS

SEQ ID NO: 106794 - protein, 396 aa, Glycine max
  Coding DNA Sequence Number=SeqID_15109
  Gene Ontology: Mol. function=pectate lyase activity; Cellular component=extracellular region; Biological process=cell wall modification
  Homolog annotation: Hit_ID=A2YTH5; Match level="QueryCoverage=88%, HitCoverage=92%, E-value=1e-114, Identity=57%"; Hit description =Putative uncharacterized protein
  Pfam annotation: Domain name=Pec_lyase_C; Domain location=84-269; Score=255.0; E_value=1.6e-73; Accession=PF00544.10; Description =Pectate lyase
MNVIDRCWRLNPEWRRHRPQLATCSVGYTGKMTNNIGKDLIHYIVIDPSDDPINPKRGTLRYGASVIQGKVWITFQRDMHIKLERPLLISSFTAIDGRGVNVHIANNACLMIFKATNIIIHGIRVHHCKPQAPGVVMGPEGKVIPLGHVDGDAIRLVTASKIWIDHNTLYNCQDGLLDVTRGSTDVTISNNWFRDQDKVMLLGHDDGYVRDQNMKVTVVYNHFGPNCNQRMPRIRHGYAHVANNLYLGWVQYAIGGSMGPSLKSEANLFIAPTIGSKEVTWRKSNHNNGDTWEFHSVKDAFENGASFTVTKGGRVPKPNYSNEQYFKVVDVNFVRSLTRSSGILGCSKTSNFRKRCNGYNLRKEKYSSSMNIYTFSHTLQVKISLQPNRLEDTHDL

SEQ ID NO: 106795 - protein, 200 aa, Glycine max
  Coding DNA Sequence Number=SeqID_15110
  Gene Ontology: Mol. function=hydrolase activity, acting on ester bonds; Cellular component=nucleus; Biological process=lipid metabolic process
  Homolog annotation: Hit_ID=A7NSR6; Match level="QueryCoverage=99%, HitCoverage=55%, E-value=1e-66, Identity=58%"; Hit description =Chromosome chr18 scaffold_1, whole genome shotgun sequence
  Pfam annotation: Domain name=Lipase_GDSL; Domain location=1-191; Score=39.8; E_value=9.8e-09; Accession=PF00657.13; Description=GDSL -like LipaseAcylhydrolase
MATIISKSIYVLCTGSNDIANTYSLSPVRRAHYDVPEYTDLMASQATNFLQELYGLGARRIGVIGLPVLGCVPSQRTIQGGILRSCSDFENQAAMLFNSKLSSQTDALNKNFPEARFVYLDIYNPLLNMIQNPSTYGFKVTNEGCCGTGIIEAGILCNPFTLQICSNTANYIFWDSFHPTEEAYNVLCSLVLDNKIKDFF

SEQ ID NO: 106796 - protein, 97 aa, Glycine max
  Coding DNA Sequence Number=SeqID_15111
  Homolog annotation: Hit_ID=A7R114; Match level="QueryCoverage=61%, HitCoverage=25%, E-value=2e-14, Identity=63%"; Hit description =Chromosome chr4 scaffold_333, whole genome shotgun sequence
MEEKDWNDDSLTMTTVSQHCFRDDSEAPSFYISIIENMKDEYGLFLWPCSVVLAEYVWQHKHRFSGANVVEVLELPCLTWLQQNSVPVSLLPMTPPD

SEQ ID NO: 106797 - protein, 508 aa, Glycine max
  Coding DNA Sequence Number=SeqID_15112
  Gene Ontology: Mol. function=aspartic-type endopeptidase activity; Cellular component=anchored to membrane; Biological process =proteolysis
  Homolog annotation: Hit_ID=Q8VYV9; Match level="QueryCoverage=94%, HitCoverage=94%, E-value=1e-148, Identity=55%"; Hit description =Putative chloroplast nucleoid DNA-binding protein
  Pfam annotation: Domain name=Asp; Domain location=103-443; Score= -84.2; E_value=1.3e-08; Accession=PF00026.14; Description=Eukaryotic aspartyl protease
MACHSWLCNISLLLLLLSLASQSCHALNSFGFDIHHRFSDPVKEILGVHDLPDKGTRLYYVVMAHRDRIFRGRRLAAAVHHSPLTFVPANETYQIGAFGFLHFANVSVGTPPLSFLVALDTGSDLFWLPCNCTKCVRGVESNGEKIAFNIYDLKGSSTSQTVLCNSNLCELQRQCPSSDSICPYEVNYLSNGTSTTGFLVEDVLHLITDDDETKDADTRITFGCGQVQTGAFLDGAAPNGLFGLGMGNESVPSILAKEGLTSNSFSMCFGSDGLGRITFGDNSSLVQGKTPFNLRALHPTYNITVTQIIVGGNAADLEFHAIFDSGTSFTHLNDPAYKQITNSFNSAIKLQRYSSSSSDELPFEYCYDLSSNKTVELPINLTMKGGDNYLVTDPIVTISGEGVNLLCLGVLKSNNVNIIGQNFMTGYRIVFDRENMILGWRESNCYVDELSTLAINRSNSPAISPAIAVNPEETSNQSNDPELSPNLSFKIKPTSAFMMALLVLLTIL

SEQ ID NO: 106798 - protein, 142 aa, Glycine max
  Coding DNA Sequence Number=SeqID_15113
MGVIGPRLNVHGPPSLEPLAKGPWRNPCCYIKLTTSFAFVRKGLGQGLDLGLGPDQDLLKNKGQDPSREVVEANLVGARASNFNVLNELNIVVVVVAISYDYDNDGDAGGGVNDRGGISVGVGDNGGDSDGVSDSDNEKCHS

SEQ ID NO: 106799 - protein, 548 aa, Glycine max
  Coding DNA Sequence Number=SeqID_15114
  Gene Ontology: Mol. function=histone-lysine N-methyltransferase activity; Cellular component=chloroplast; Biological process =chromatin modification
  Homolog annotation: Hit_ID=A7R1S0; Match level="QueryCoverage=68%, HitCoverage=88%, E-value=2e-96, Identity=50%"; Hit description =Chromosome chr4 scaffold_373, whole genome shotgun sequence
  Pfam annotation: Domain name=Ank; Domain location=259-291; Score =14.3; E_value=0.28; Accession=PF00023.21; Description=Ankyrin repeat
  Pfam annotation: Domain name=Ank; Domain location=292-323; Score =13.9; E_value=0.32; Accession=PF00023.21; Description=Ankyrin repeat
  Pfam annotation: Domain name=Ank; Domain location=324-356; Score =28.4; E_value=2.6e-05; Accession=PF00023.21; Description=Ankyrin repeat
  Pfam annotation: Domain name=Ank; Domain location=357-389; Score =41.6; E_value=2.8e-09; Accession=PF00023.21; Description=Ankyrin repeat
  Pfam module annotation: Pfam domain module=Ank::Ank::Ank::Ank; Domain location=259-291::292-323::324-356::357-389
  Subcellular localization annotation: CTP_CleavageSite=46; ConfidenceScore=5.44e-01
MEATTMFRFFSAVMVNPKPHKLFSSLSIFPSATAPRHFQSLKFPTKQNAHSENRDIGDRVVFDDGIFESGAVFQNDSNLTTNTPKRRPSPRTKVTRITRENLVPDKWREVQSETKITINERRKKKKNIRGLVPLRDANKIEVEKKLSRYKDVNWDEYKSSKKAKLRQISPLVLKNPSTFPVKENLPEPHFNGERVEPKNPRGVLHGKGLEDVIQFFNSGSYNPSYNTSLEGRRKLFAITKEEVLLLNKRMPDLAIATSGKWLPLHTLAAGGELYLLDSLLKHNVDINAVDKDGLTALHKAIGKKRVITNYLLKNSANPFVRDKEGATLMHYAVQTASIETIELLLLYNVDINLQDNDGWTPLHLAVQTQRPNLVRLLLLKGADKTLRNKFPNICANQVVKAASRESLTCMTNGVVSSTQTFGSIAVSFLVVPRAEHGGFLIHVRCDLASFSFQIYLFLTPHGGIMVKPICLLMLIKRQLHYARGEEICCPFTIFKISTDTNSSQIVDKFHGQGIRHALLETLMSNGSVNRPSMNLIGTKCNRNLYLCH

SEQ ID NO: 106800 - protein, 54 aa, Glycine max
  Coding DNA Sequence Number=SeqID_15115
MNYCLREEQQRKETWRLGGMAHHHDGVMRSGAPPLCQPWVVATADDRGQTESLL

SEQ ID NO: 106801 - protein, 267 aa, Glycine max
  Coding DNA Sequence Number=SeqID_15116
  Gene Ontology: Mol. function=metal ion binding; Cellular component =integral to membrane; Biological process=ubiquitin cycle
  Homolog annotation: Hit_ID=A5B286; Match level="QueryCoverage=67%, HitCoverage=77%, E-value=2e-68, Identity=67%"; Hit description =Putative uncharacterized protein
  Pfam annotation: Domain name=zf-C3HC4; Domain location=78-118; Score =33.9; E_value=5.9e-07; Accession=PF00097.16; Description=Zinc finger, C3HC4 type (RING finger)
MVVGFGCMWGTVIVGFKGRVWWCWVDGQGCASEGRGADYHKKKGVRQMTSGFGESTRASAPSPSCSGNSSNDAGDFECNICFDLAQDPVITLCGHLFCWPCLYRWLHHHSHSQECPVCKALVQEEKLVPLYGRGKTQTDPRTKLYPGMEIPHRPSGQRPQTMPPPPPPEVNPFGSYGFGLMGGFIPMATARFGNFTLSTAFGGFIPSLLNIHFHGFQDATVYGTTSGNRSSAAAGGQCFEESAYVDWVSRPSYGNCMLEKVATLALY

SEQ ID NO: 106802 - protein, 410 aa, Glycine max
  Coding DNA Sequence Number=SeqID_15117
  Gene Ontology: Mol. function=serine O-acetyltransferase activity; Cellular component=cytoplasm; Biological process=cysteine biosynthetic process from serine
  Homolog annotation: Hit_ID=Q8W2B8; Match level="QueryCoverage=70%, HitCoverage=84%, E-value=1e-119, Identity=71%"; Hit description =Serine acetyltransferase 4
  Pfam annotation: Domain name=Hexapep; Domain location=298-315; Score =14.9; E_value=0.3; Accession=PF00132.15; Description=Bacterial transferase hexapeptide (three rep
  Pfam annotation: Domain name=Hexapep; Domain location=324-341; Score =7.9; E_value=16; Accession=PF00132.15; Description=Bacterial transferase hexapeptide (three rep
  Pfam annotation: Domain name=Hexapep; Domain location=342-359; Score =7.6; E_value=18; Accession=PF00132.15; Description=Bacterial transferase hexapeptide (three rep
  Pfam annotation: Domain name=SATase_N; Domain location=148-244; Score= 163.2; E_value=7e-46; Accession=PF06426.5; Description=Serine acetyltransferase, N-terminal
  Pfam module annotation: Pfam domain module=Hexapep::Hexapep::Hexapep:: SATase_N; Domain location=298-315::324-341::342-359::148-244
  Subcellular localization annotation: CTP_CleavageSite=67; ConfidenceScore=5.33e-01
MRPTTTSVGTGRKATLAFSLIGGNCKAAQSKARGPLSTQTPPSVIYAFAPLVFPTTVTPSPSPISTHAMACLSRYHHHHHPRGATWLSSPDEMLQHCPLSAHHRRLRDDDAEPIYLPSLSSAYRIFPVYAMGAPDPTPEPELDGPDPIWNAAEKEPILSSFLYASILAHDCLEQALAFVAANRLQNPTLLATQLMDIFCNVILHDKAIQRSIRLDVQAFKDRDPACLSYCSALLYMKGYHALQVHRVAHTLWHQGRKVLALALQSRVSEVFGVDIHPAAKIGEGILLDHGTGVVIGETAIVGNRVSLMHGVTLGGTGKEIGDRHPKVGEGALIGASATILGNIKIGEGAMIAAGSLVLKDVPPHCIAAGIPAKVISGLQEHDPSLTMKHDATKDFFTHVATNFRDEKPNG

SEQ ID NO: 106803 - protein, 142 aa, Glycine max
  Coding DNA Sequence Number=SeqID_15118
  Gene Ontology: Mol. function=catalytic activity; Biological process =metabolic process
  Homolog annotation: Hit_ID=A7R5D6; Match level="QueryCoverage=52%, HitCoverage=39%, E-value=3e-12, Identity=48%"; Hit description =Chromosome undetermined scaffold_946, whole genome shotgun sequence
MSEDLVPLSPISFLEGAATNYGDKISIIYHHNVRFSWRQTHERCVKLASALVNLGISHNDMSCLVVQLVLGLTSAYRGVGTLIQQSDHQPPFYQAQSMLTLEEAGSTMVAVSQPFMTQISLIQTNNNVGSRLDITRIMKKKN

SEQ ID NO: 106804 - protein, 394 aa, Glycine max
  Coding DNA Sequence Number=SeqID_15119
  Gene Ontology: Mol. function=protein binding; Cellular component =IkappaB kinase complex; Biological process=activation of NF-kappaB transcription factor
  Homolog annotation: Hit_ID=A7R129; Match level="QueryCoverage=96%, HitCoverage=69%, E-value=1e-153, Identity=71%"; Hit description =Chromosome undetermined scaffold_334, whole genome shotgun sequence
MEDLRRSLQPKENAIEALQQSIAEKEQMLEDMRGLLQAAEEKRQAALAELSAKHQKNIESLEAQINDALSDRSKATESISSLQVLVAEKESRIAEMEAASTGEAARLRAAVESVKGELSHIKEEHENERESWETASQALKAKLEIAESNCIRAEVEVAKIRSQLESEVSTQTRILNMRDAELLAAKEEISSLEKEFSSYKVRAHALLQKKDAELAAAKDSEQLKDLEETLKEVENEVLSITEERDRVLQDLQSAMANHEKELAERDTALENVKQQIRSLEIKLDSANAKHLKEKEEWGLSLQNVQETWRIRCEAMKAENEATATKDMQKELEELKQRCKKLKEEHASFHDLADRMIEEKDYEISRLLDENKNLRQSLQSRPSVCFYLLFQYHES

SEQ ID NO: 106805 - protein, 91 aa, Glycine max
  Coding DNA Sequence Number=SeqID_15120
  Homolog annotation: Hit_ID=A7R405; Match level="QueryCoverage=85%, HitCoverage=95%, E-value=4e-18, Identity=57%"; Hit description =Chromosome undetermined scaffold_598, whole genome shotgun sequence
MMEKEDSVQKLYTRMRLWEFPDQYVIEPTDGSSGSSLSVSRVDGSMKLIDKVPECSTLRVPKIYTIFGVVGMLKLLAGQQSLCHRDLMIDL

SEQ ID NO: 106806 - protein, 155 aa, Glycine max
  Coding DNA Sequence Number=SeqID_15121
MDLRTKGFEGSEIPEMEPRLLQHGGLVTGRGGSILDLEDQARQLCPITLVVLAHRVVRDLRHVAVVHVLDGAPAAQRRFRPPGSVGDQDEGEEKETVHWKNAVNGLVLNILVWASALAKPTTFDGVEVGSQKANSVAIPPGIIRIRGCTCIVPAM

SEQ ID NO: 106807 - protein, 496 aa, Glycine max
  Coding DNA Sequence Number=SeqID_15122
  Gene Ontology: Mol. function=transferase activity, transferring glycosyl groups; Cellular component=integral to membrane; Biological process=lignin metabolic process
  Homolog annotation: Hit_ID=A5BR04; Match level="QueryCoverage=95%, HitCoverage=95%, E-value=1e-127, Identity=49%"; Hit description =Putative uncharacterized protein
  Pfam annotation: Domain name=UDPGT; Domain location=7-471; Score= -55.0; E_value=7.8e-08; Accession=PF00201.9; Description=UDP -glucoronosyl and UDP-glucosyl transferase
MVTSKAHAALVASPGMGHLIPMLELGKRLLTHHSFHVTIFIVTTDSATTTSHILQQTSNLNIVLVPPIDVSHKLPPNPPLAARIMLTMIDSIPFLRSSILSTNLPPPSALIVDMFGLAAFPIARDLGMLTYVYFATSAWFSAVSVYVPAMDKKMIERHAEHHEPLVIPGCEAVRFEDTLEPFLSPIGEMYEGYLAAAKEIVTADGILMNTWQDLEPAATKAVREDGILGRFTKGAVYPVGPLVRTVEKKAEDAVLSWMDVQPAETVVYVSFGSGGTMSEVQMREVALGLELSQQRFVWVVRPPCEGDTSGSFFEVSKNGSGDVVLDYLPKGFVKRTEGVGVVVPMWAPQAEILGHPATGCFVTHCGWNSVLESVLNGVPMVAWPLYAEQKMNAFMLSEELGVAVRVAGEGGGGVVGREEIAELVRRVMVDKEGVGMRKKVKELKVSGEKALSKFGSSHHWLCQMNKDCQVHAQASEADYLGTATTTTDVLSDVVCS

SEQ ID NO: 106808 - protein, 936 aa, Glycine max
  Coding DNA Sequence Number=SeqID_15123
  Gene Ontology: Mol. function=extracellular-glutamate-gated ion channel activity; Cellular component=integral to membrane; Biological process=G-protein coupled receptor protein signaling pathway
  Homolog annotation: Hit_ID=A7PKV6; Match level="QueryCoverage=96%, HitCoverage=96%, E-value=0.0, Identity=60%"; Hit description =Chromosome chr7 scaffold_20, whole genome shotgun sequence
  Pfam annotation: Domain name=ANF_receptor; Domain location=47-410; Score=292.8; E_value=6.9e-85; Accession=PF01094.19; Description =Receptor family ligand binding region
  Pfam annotation: Domain name=Lig_chan; Domain location=606-856; Score= 249.9; E_value=5.4e-72; Accession=PF00060.17; Description=Ligand -gated ion channel
  Pfam annotation: Domain name=SBP_bac_3; Domain location=510-829; Score=-40.8; E_value=2.8e-05; Accession=PF00497.11; Description =Bacterial extracellular solute-binding proteins, family 3
  Pfam module annotation: Pfam domain module=ANF_receptor::Lig _chan::SBP_bac_3; Domain location=47-410::606-856::510-829
MILAWLLVLMALSNGFFSNGDGMHNSTIPDFVNIGALFSFNTSVGRSIKIAIKAAIEDINSDPTILGKTKLNLSLQEDSKYRGFLSISEVLQVMARRTVAIIGPHSSVTAHVITHIANELQVPLLSFSALDPTLSSLQFPFFIRTCHSDLYQMTAIADIVNYHDWKDVIAVYLDDDNGRNGIGALGDKLAERRCRISYKAPLSPDASMEEISNVLVQVALAESRVIVVHANTQFGPKLFSVAKNLGMMGTGYVWIATAFLSALLDINSPLSSDSLDDIQGVLTPRMYTPDSQLQRRFASRWKNLTSGNTANAHLGLSFLPIYAYDTVYVLAHALDAFFKQGNQITFSTDSKLSSIHGDNLNLEALKIFNEGNLLRSNIYEVNMTGVSGPFKYTSDRNLVNPAYEIINVIGTGTRRIGYWSNYSGLSVVPPETLYSKPANLSRENQKLFAPIWPGNTGERPRGWVFPNNGRLLKIGVPKGVSYKEFVSQIEGTDTFEGFCIDVFLAAVSLLSYAVPYKFVPYGEGKNNPSMTELVRLITTGVSIMDNFFVEFESFMEFDGAVGDIAITTERTRMVDFTQPYIESGLVVVAPVRKEESNALAFLAPFTPKMWCVTAIFFILVGAVVWILEHRVNDEFRGPPKKQVVTVLWFSFSTMFFSHRENTVSALGRFVLIIWLFVVLIINSSYTASLTSILTVQQLYSPIKGIESLVIGKEPIGYTQGSFARNYLVHEIGINESRLVPLTTTEEAAKALRKGPENGGVAAYIDERAYTDIFLSSRCDLTVVGQEFTRNGWGFAFPRDSPLAVDLSTAILQMIDNGDLQRIHDKWLLSSACLSQGAKLEVERLQLKSFWGLYIWRQYHKHYVSEELDSSDGQSLGSKSSRLKTFLSFADEKEETVKSRSKRRKMERISYRSSEGSSSISSNKGYAPRRSECASEV

SEQ ID NO: 106809 - protein, 205 aa, Glycine max
  Coding DNA Sequence Number=SeqID_15124
  Subcellular localization annotation: CTP_CleavageSite=57; ConfidenceScore=5.17e-01
MENQQKHYSLLLLTDDARVQNSKLRGQRHRGSRGGASAGGGSAGVRLRGDSRGAPLRAHLRGGAGGGGAVRVAPARLGCRKLSSASLGEQGPEEEGAAVASEVRVRGQQPEQVVSDVGMRDLPRRVRRRRRDPRAAAVRPRLPRALHRHVAWVPLLLPFLSTGFGGGQVSEVWAISGHRCRSFQNAGDRTRIEVQRRQQCRELQQ

SEQ ID NO: 106810 - protein, 276 aa, Glycine max
  Coding DNA Sequence Number=SeqID_15125
  Gene Ontology: Mol. function=binding; Cellular component=integral to membrane; Biological process=transport
  Homolog annotation: Hit_ID=A7PKU4; Match level="QueryCoverage=99%, HitCoverage=84%, E-value=6e-56, Identity=47%"; Hit description =Chromosome chr7 scaffold_20, whole genome shotgun sequence
  Pfam annotation: Domain name=Mito_carr; Domain location=87-224; Score= 14.2; E_value=0.00015; Accession=PF00153.18; Description =Mitochondrial carrier protein
MEGRICEELTPRYYALCAIGGMLSAGTTHLAITPFDVLKVNMQELQYKVGWMVKGEGKGKGNKGHLFFGKVGPASSLAMVLKEDADLVSTSILKSASAEVFANVALCPFEAVKVRVQAQTCFAKGLYDGFPKLYASEGTRGWGLGYLEKSGMLPINKRVGKREIILPSVRELRPLGIGRCKPSKFCKLGTVSRGEIPYLSDKIPVSMVMFSTFEHSVDFLYRNVVKRKKEDCSIGQQLGVTCLAGYAAGSVGSFISNPADNIVSSLYNRKADSLAL

SEQ ID NO: 106811 - protein, 691 aa, Glycine max
  Coding DNA Sequence Number=SeqID_15126
  Gene Ontology: Mol. function=X-Pro aminopeptidase activity; Cellular component=exocyst; Biological process=proteolysis
  Homolog annotation: Hit_ID=A7PV00; Match level="QueryCoverage=96%, HitCoverage=99%, E-value=0.0, Identity=67%"; Hit description =Chromosome chr4 scaffold_32, whole genome shotgun sequence
  Pfam annotation: Domain name=Peptidase_M24; Domain location=419-601; Score=-30.3; E_value=5.3e-07; Accession=PF00557.15; Description =metallopeptidase family M24
MEDTLSALRSLMLSQSPPLDALVVPSEDYHQSEYVSARDKRREFVSGFTGSAASIGLGFKLPPVSAFSCNCFNSTYRVLSIQLIGSRGSLALITKNEALLWTDGRYFLQAEQELSAQWKLMRIGEDPAVDIWMADNLPKEASIGVDPWCISIDTAQRWERAFAEKQQKLVPTSKNLVDEVWINRPQPQINAVIVHPLKFAGRSVADKLKDLRKKLVHEQARGIIFTALDEVAWLYNIRGSDVAYCPVVHAFAIVTSNSAFIYVDKRKVSVEVQAHLVENGIEIREYTAVSSDTTLLATDELDSVSTAKVALAETEVRKIPNETAKHANGEHQAEENSNDLIWADPGSCCYALYAKLNPDTVLLHQSPLALAKALKVNSVELDGLKKAHIRDGAAVVQYLVWLDKKMQDILGASGYFLENDSVKKEKHLQSLKLTEVTVSDQLEGFRASKEHFRGLSFPTISSVGPNAAIIHYSPKAETCAELDPDKIYLFDSGAQVLKGHIALGNARFPNGTNGHSLDILARIPLWKDGLDYRHGTGHGIGSYLNVHEGPHLISFRPQARNVPLQSSMTVTDEPGYYEDGEFGIRLENVLIVKEAGTNFNFGDRGYLSFEHITWAPYQTKLIDLNLLCPEEIDWLNSYHSTCRDILAPYLNEVENAWLKKATEPVGFPGIESICSGRSGMDIAWVLDKKQQ

SEQ ID NO: 106812 - protein, 824 aa, Glycine max
  Coding DNA Sequence Number=SeqID_15127
  Gene Ontology: Mol. function=microtubule motor activity; Cellular component=microtubule associated complex; Biological process =microtubule-based movement
  Homolog annotation: Hit_ID=Q7Y1U0; Match level="QueryCoverage=100%, HitCoverage=67%, E-value=0.0, Identity=70%"; Hit description=Kinesin- like calmodulin binding protein
  Pfam annotation: Domain name=Kinesin; Domain location=460-770; Score =490.4; E_value=2.2e-144; Accession=PF00225.14; Description=Kinesin motor domain
MTRARREWELDILSCYHSLMFSSQAHVTKDDARQQFLHILRTLPYGFSVFFNVRKIDDPIGLLPGRIILGINKRGVHFFRPVPKEYMHSAELRDIMQFGSSNTAVFFKMRVAGVLHIFQFETKQGEEICVALQTHINDVMLRRYSKARSAVGESLNEDTSNDFKPSNLELSEKRLQELSKLVEESQTNADQIKKPVSCMKLCKDMLLDKLREKQKQEEDMLQELEGLQRSLRADKQSLAEVTNDRDKLRSLCEEKDKALQAEILEKRNMEAKMAELSNLVTENTTKKDHTQTNNQVSQKLEDDLKLCKGELRVAEETIKNLRSNKLILEQKLSELEKKSAEEASSLQWKLEQEGKTLNSKVYDLERKLDAFRQELSVAESTVSVKDSELAALKNNLDELEELREMKEDIDRKNEQTAAILKMQAVQLAEMELLYKEEQVLRKRYFNTIEDMKGKIRVYCRLRPLSEKEIASKERDSLTTVDEFTVEHPWKDDKPKQHIYDRVFDGDATQEDYLVQSAVDGYNVCIFAYGQTGSGKTFTIYGAENNLGLTPRGTAELFRILRRDSNKYSFSLKAYMLELYQDTLVDLLLPKNAKRLKLDIKKDSKGMVAVENVTIVPISTVEELNSMIQRGSEQRHTSGTQMNDESSRSHLILSIVIESTNLQSQSTARGKLSFVDLAGSERVKKSGSSGSQLKEAQSINKSLSALGDVISALSSGGQHIPYRNHKLTMLMSDSLGGNAKTLMFVNVSPVESSLDETHNSLMYASRVRSIVNDPSKNVSSKEIARLKKMIAYWKEQAGRRGDDEDLEEIQEERQTKERTDGRHSM

SEQ ID NO: 106813 - protein, 132 aa, Glycine max
  Coding DNA Sequence Number=SeqID_15128
MACTPKPKGDPSVAASIAAAFFKLVIVIEVSYEDDSFRESFTNTDIHRLASKRFIVKYDNLMADEKIMKKLREVIGLHHLCLFPQRRLIVNSNLATSSTTTAVPKEQLVFSKEQLMLYREWLNHDWVPPLYG

SEQ ID NO: 106814 - protein, 155 aa, Glycine max
  Coding DNA Sequence Number=SeqID_15129
  Homolog annotation: Hit_ID=A7PWW0; Match level="QueryCoverage=99%, HitCoverage=31%, E-value=3e-61, Identity=76%"; Hit description =Chromosome chr19 scaffold_35, whole genome shotgun sequence
  Pfam annotation: Domain name=DUF647; Domain location=1-155; Score= -167.9; E_value=0.00054; Accession=PF04884.5; Description=Protein of unknown function, DUF647
MASRFIGIVLGIGLGNCIGSSTPLVLASFTVLTWIHMYCNLKSYQSIQLRTLNPYRASLVFSEYLLSGQAPPVKEVNDEEPLFPAVPILNATFASKAQSFALSSEAKDAAAEIEHRLQLGSKLSEIVNSKEDVLALFGLYKNEGYILSEHMGKYS

SEQ ID NO: 106815 - protein, 76 aa, Glycine max
  Coding DNA Sequence Number=SeqID_15130
MREDHATTRLRMFSELYQLSAFAKCQKEDPRTKVSEHPIQLKWLKEEGGKKSMPFKKKSERSNNSEGKEIAVKAEN

SEQ ID NO: 106816 - protein, 105 aa, Glycine max
  Coding DNA Sequence Number=SeqID_15131
  Gene Ontology: Mol. function=NADH dehydrogenase (ubiquinone) activity
  Homolog annotation: Hit_ID=A7PBC3; Match level="QueryCoverage=61%, HitCoverage=63%, E-value=2e-31, Identity=95%"; Hit description =Chromosome chr16 scaffold_10, whole genome shotgun sequence
GLGDGVECVEEPPPEIFLIEEHDDHQKFQPRYPSNQQPHRQDTSKKSPMELINEVPPIKVESRIVACEGDTDPALGHPIEFICLDLPEPAVCKYCGLRYVQDHHH

SEQ ID NO: 106817 - protein, 620 aa, Glycine max
  Coding DNA Sequence Number=SeqID_15132
  Gene Ontology: Mol. function=nucleoside-triphosphatase activity; Cellular component=cellulose and pectin-containing cell wall; Biological process=protein amino acid phosphorylation
  Homolog annotation: Hit_ID=A7PBC2; Match level="QueryCoverage=91%, HitCoverage=89%, E-value=0.0, Identity=82%"; Hit description =Chromosome chr16 scaffold_10, whole genome shotgun sequence
  Pfam annotation: Domain name=AAA; Domain location=378-586; Score =146.7; E_value=6.3e-41; Accession=PF00004.20; Description=ATPase family associated with various cellular activities (AAA)
  Pfam annotation: Domain name=AAA_3; Domain location=378-515; Score= -20.6; E_value=0.061; Accession=PF07726.2; Description=ATPase family associated with various
  Pfam annotation: Domain name=AAA_5; Domain location=378-506; Score= -10.7; E_value=0.019; Accession=PF07728.5; Description=ATPase family associated with various
  Pfam annotation: Domain name=Mg_chelatase; Domain location=378-512; Score=-143.8; E_value=0.011; Accession=PF01078.12; Description =Magnesium chelatase, subunit ChlI
  Pfam annotation: Domain name=TolA; Domain location=22-371; Score= -144.7; E_value=0.033; Accession=PF06519.2; Description=TolA protein
  Pfam module annotation: Pfam domain module=AAA::AAA_3::AAA_5::Mg _chelatase::TolA; Domain location=378-586::378-515::378-506::378 -512::22-371
MAKTYAAGLLSAIAAATAAASLNQNNAYADGILPPNPSEIEPSPAPPPPKVRNDHPRTTSAGFDPEALERGVKALREISKSPHGKKVFEVIKKQEETKQTELSAKVAEFRQMKAQHETERQRIIYDEQKKLAQHQAQTKSQMAKYEDELARKRMQAENEYHRARNQELVKLQEESSIRQEQARRATEEQIQAQRRQTEREKAEIERETIRVRAMAEAEGRAHEAKLAEDVNRRMLVDRANAEREKWVAAINTTFEHIGGGLRAILTDQNKLVVAVGGVTALAAGVYTTREGARVIWGYIDRILGQPSLIRESSRGKYPWSGMFSRTMSSLSRHTNPGSALKNGNGFGDVILHPSLQKRIQQLSSATANTKAHQAPFRNMLFYGPPGTGKTMAARELARKSGLDYALMTGGDVAPLGPQAVTKIHQLFDWAKKSNKGLLLFIDEADAFLCERNKTYMSEAQRSALNALLSRTGDQSKDIVLALATNRPGDLDSAVTDRIDEVLEFPLPGEEERFKLLKLYLDKYIAQAGSGKSSFVKDLFKGKPQQIEIKGLTDDIIKEAAAKTEGFSGREIAKLMASVQAAVYGSENCVLDPSLFREVVDYKVAEHQQRIKLAAGDKPIA

SEQ ID NO: 106818 - protein, 358 aa, Glycine max
  Coding DNA Sequence Number=SeqID_15133
  Gene Ontology: Mol. function=metalloexopeptidase activity; Cellular component=cytosol; Biological process=proteolysis
  Homolog annotation: Hit_ID=Q93X46; Match level="QueryCoverage=100%, HitCoverage=54%, E-value=4e-84, Identity=47%"; Hit description=Xaa -Pro aminopeptidase 1
LDVLVVPSEDYHRGEYVSARDRRREFVSGFTGSCSIHQFKAGQELSAEWKLMRIGEDPAVDIWMADVSVLLNLPKEASIGVDPWCISIDTAQRWECAFCQKASEAGRSVADKLKDVRKKPVQEQAQDSIFSFFRMVYSYLKEVHNKFFQNGLFVPLLEVFQKCLGIIFTAIDEVSWLYNIRGSDVAYCSIVHAFSIVTSNSAFIYVDMRKVSVEYTAVSSDVTLLATDKLDTVSTAKVDLAETEVRKITSETDKSVNGEHKAEENSNDLIWADPKKCCYALYAKLNPDKVLLQQSPLALAKALKVVSLNSVELDGLKKAHIQDGAAVVQYLVWLDKKVQDNDTKAWFNVQMQDIYGAS

SEQ ID NO: 106819 - protein, 62 aa, Glycine max
  Coding DNA Sequence Number=SeqID_15134
MRESIQSSESKSEKRKEWGSGWKWKGGSGWKGSGGKSVVGASVAAAVAAAAAAAAALAAASA

SEQ ID NO: 106820 - protein, 88 aa, Glycine max
  Coding DNA Sequence Number=SeqID_15135
MKKTQKLRQQDLSGIFGGHPGKGSGDLFGALGGPQQRPTSGGCRSTVAWRYPTVAKDERSKLKWESYQSHMQMAGPKLRQRQPIVRPA

SEQ ID NO: 106821 - protein, 43 aa, Glycine max
  Coding DNA Sequence Number=SeqID_15136
MSYSGNMKRSGWPPLLTATMASLTEPVQPPPPPPVGWVKPYWS

SEQ ID NO: 106822 - protein, 505 aa, Glycine max
  Coding DNA Sequence Number=SeqID_15137
  Gene Ontology: Mol. function=triacylglycerol lipase activity; Cellular component=chloroplast stroma; Biological process=lipid metabolic process
  Homolog annotation: Hit_ID=A7NZN8; Match level="QueryCoverage=86%, HitCoverage=86%, E-value=0.0, Identity=74%"; Hit description =Chromosome chr6 scaffold_3, whole genome shotgun sequence
  Pfam annotation: Domain name=Lipase_3; Domain location=201-358; Score= 219.6; E_value=7.5e-63; Accession=PF01764.16; Description=Lipase (class 3)
  Pfam annotation: Domain name=SET; Domain location=318-446; Score= -16.7; E_value=0.065; Accession=PF00856.19; Description=SET domain
  Pfam module annotation: Pfam domain module=Lipase_3::SET; Domain location=201-358::318-446
  Subcellular localization annotation: CTP_CleavageSite=45; ConfidenceScore=5.44e-01
MASVLPIYHNYVNLPCPLPLSKPSTTFNTPIILFFPKTKPSLTLKCSSSASSLTPELDQEEETFGNFDEPPLSESWKEIQGLNNWDGLIDPTMNPHLRREIIRYGELAQACYDSFDFDPHSKYCGTCKYHPSQLFEKLNMSQTGYMISRYLYATSNVNLPNFFQKSRLSTSVWSPHANWMGYVAVSTDRDQIKRLGRRDIVIAWRGTVTYVEWIYDLKDILRPALFSDDPTIKVESGFYDLYTKKEDSCTYCSFSAREQVLSEVKRLLHYYKNEEISITITGHSLGAALAILSAYDIAELKLNVVEDGRNKIPVTVFSFAGPRVGNLKFKERCEELGVKVLRVVNVQDVVPTVPGIITNEKFQFQRYIEETLSFPWSYAHLGTEMALDHRESPFLKGGMNDLGCAHNLEVHLHLVDGYHGKGKRFCLATKRDIALVNKSCDFLRSEYGVPSHWRQDENKGMVRSRDGRWVLPDRPILEAHPPDMAHHLQQVLNNHLAAQQFETST

SEQ ID NO: 106823 - protein, 115 aa, Glycine max
  Coding DNA Sequence Number=SeqID_15138
  Gene Ontology: Mol. function=peptidase activity
  Homolog annotation: Hit_ID=Q7XBG4; Match level="QueryCoverage=97%, HitCoverage=100%, E-value=5e-15, Identity=38%"; Hit description =Putative uncharacterized protein
  Pfam annotation: Domain name=Tryp_alpha_amyl; Domain location=30-104; Score=25.9; E_value=0.00015; Accession=PF00234.13; Description =Protease inhibitorseed storageLTP f
MASYSTYLSLAILVVAGSLMYNTKEVSAQCGGSLTDLIAQCSQYVQKSGPQIKPSAACCAVLRKFNVQCACKLITKEVASLVSIPKAVFVARTCGFNLPPGMHCGAVKIPPKAMK

SEQ ID NO: 106824 - protein, 160 aa, Glycine max
  Coding DNA Sequence Number=SeqID_15139
  Gene Ontology: Mol. function=structural constituent of cell wall
  Homolog annotation: Hit_ID=A7P866; Match level="QueryCoverage=89%, HitCoverage=27%, E-value=2e-44, Identity=61%"; Hit description =Chromosome chr3 scaffold_8, whole genome shotgun sequence
  Pfam annotation: Domain name=DUF1210; Domain location=50-156; Score =63.4; E_value=7.6e-16; Accession=PF06735.2; Description=Protein of unknown function (DUF1210)
MAFSCAVEKPLHSMNWMILTRRQGAFLCFWLSVLFVVVDFCYGDHSTVEVVGLGECADCKEKNIQTSQAFSGLRVTVDCKAASGNFERRGVGELDEYGNFKVSLPHDTVKDDKLIEECYAQLLSASAAPCPTHDGPLSHKIVIKSITNNEKHILGPAGKL

SEQ ID NO: 106825 - protein, 297 aa, Glycine max
  Coding DNA Sequence Number=SeqID_15140
  Gene Ontology: Mol. function=protein binding; Cellular component =nucleus; Biological process=ribosome biogenesis and assembly
  Homolog annotation: Hit_ID=A7QAF5; Match level="QueryCoverage=99%, HitCoverage=99%, E-value=1e-87, Identity=58%"; Hit description =Chromosome undetermined scaffold_71, whole genome shotgun sequence
  Pfam annotation: Domain name=Nep1; Domain location=111-292; Score =241.0; E_value=2.7e-69; Accession=PF03587.5; Description=Nep1 ribosome biogenesis protein
MTRPFGVKGGRKRKHAEPKYDAHDEEEEEETQPKKTVVEVEHNQEEEEETPAPAPEDDGLSGIPIAPSANNTNKPNVIFILEKASLEVAKVGKTYQLLNSDDHANFLRKNNKNPGDYRPDITHQSLLSILDSPLNKAGRLRSVYIRTEKGVLIEVKPFVRIPRTFKRFAGVMLELLQKLSISAVGKREKLLRTIKNPVTQYLPINSRKIGLSYSSEKLVDMDDYVSTVTSNMDLVFVVVLLVQLLISLPIVSVGAMAHGKIETDYTEDYVAISGYPLSAAYCITRITGALERKWKIL

SEQ ID NO: 106826 - protein, 62 aa, Glycine max
  Coding DNA Sequence Number=SeqID_15141
MAPDTVDEFLIHFLAFRTWFIESTLVNEVGYFFASGYNLCRGNNESEDETVIGQGRRGMDRH

SEQ ID NO: 106827 - protein, 307 aa, Glycine max
  Coding DNA Sequence Number=SeqID_15142
  Gene Ontology: Mol. function=nucleic acid binding; Cellular component= nucleus; Biological process=response to DNA damage stimulus
  Homolog annotation: Hit_ID=A7PNI0; Match level="QueryCoverage=92%, HitCoverage=99%, E-value=8e-60, Identity=46%"; Hit description =Chromosome chr1 scaffold_22, whole genome shotgun sequence
  Pfam annotation: Domain name=Swi3; Domain location=72-156; Score =148.5; E_value=1.8e-41; Accession=PF07962.3; Description=Replication Fork Protection Component S
  Pfam annotation: Domain name=zf-CCHC; Domain location=10-27; Score =34.0; E_value=5.4e-07; Accession=PF00098.14; Description=Zinc knuckle
  Pfam module annotation: Pfam domain module=Swi3::zf-CCHC; Domain location=72-156::10-27
  Subcellular localization annotation: CTP_CleavageSite=57; ConfidenceScore=5.48e-01
MEGTGAGTATGCYKCGKPGHWSRDCPFSAPNPNPNSNTATTPNPNTPNPSSSSFKSRSATEKPKKLPRTKPKLTPELLLSDDGLGYVLRYFPREFKYRGRGHEVRDLGNLLRLYTEWHSRLLPYYSFNQFVHKVEKVAATRRVKTCLRELRERVASGGDPTKLREPPVVHDIPSDEHGFSVSAEDGGATHQEADLFAEFENVNDIQEDMLNDIYDKATEEPSQSMHNVIGTSMASESNATEKTSEENGSSQSGKAEITEEQRARMEANRLKALERRAEITEEQRARMEANRLKALERRAALSQASQL

SEQ ID NO: 106828 - protein, 118 aa, Glycine max
  Coding DNA Sequence Number=SeqID_15143
  Homolog annotation: Hit_ID=A7QHL0; Match level="QueryCoverage=100%, HitCoverage=35%, E-value=2e-42, Identity=71%"; Hit description =Chromosome chr5 scaffold_98, whole genome shotgun sequence
  Pfam annotation: Domain name=WD40; Domain location=41-79; Score=18.3; E_value=0.029; Accession=PF00400.23; Description=WD domain, G-beta repeat
MEINLGKLAFDIDFHPSDNLVAAGLITGHLHLYRYSPDTVPVRLLEVHAHTESCRAARFINSGRALLTGSSDCSILATDVETGSTIARVDNAHESAVNRLINLTESTVVSGDNDGCIK

SEQ ID NO: 106829 - protein, 262 aa, Glycine max
  Coding DNA Sequence Number=SeqID_15144
  Gene Ontology: Biological process=cell wall catabolic process
  Homolog annotation: Hit_ID=A7P2V9; Match level="QueryCoverage=87%, HitCoverage=62%, E-value=4e-36, Identity=40%"; Hit description =Chromosome chr1 scaffold_5, whole genome shotgun sequence
  Pfam annotation: Domain name=LysM; Domain location=33-76; Score=19.1; E_value=0.006; Accession=PF01476.11; Description=LysM domain
MQIQTRSMYDYNHSQMMMSSSASSPPTLGYIQHPISKLDTLAGIAIKYGVEVADIKKMNGLVTDSQMFALKSIGIPLNGKHPPPIITGYDDNTDNSPAADNAKSLRRKSSEQKLSPVMSCLRSHYGTKPTMKKSVSEIFSMVEYEKRASKCSENGSFYKKSPMSPQHHSHHKKSHSLANETLDDIMEVVKARRSDSDRSGTLIRRSYKSEANLQRIPELLLKQDCNNSNGSFSFSARSAKGLAQRQKSGSRIALTAYSNHVV

SEQ ID NO: 106830 - protein, 149 aa, Glycine max
  Coding DNA Sequence Number=SeqID_15145
  Gene Ontology: Mol. function=protein serine/threonine kinase activity; Biological process=protein amino acid phosphorylation
  Homolog annotation: Hit_ID=A7P2X0; Match level="QueryCoverage=32%, HitCoverage=3%, E-value=4e-18, Identity=93%"; Hit description =Chromosome chr1 scaffold_5, whole genome shotgun sequence
MRSKECLDVGFEDLEQMLGDEIGKGAYGRVYKGLDLENGDFVAIKQVSLENIAQEDLNIIMDAEEQTQVAWCRSETDHQSRQGDTVPDANAVAAADREENASFTTSSLAATIVFLSKRIWGSKLKKAQMNYRTRCRKKETSDDPRQKKP

SEQ ID NO: 106831 - protein, 821 aa, Glycine max
  Coding DNA Sequence Number=SeqID_15146
  Gene Ontology: Mol. function=ligase activity, forming aminoacyl-tRNA and related compounds; Cellular component=mitochondrion; Biological process=alanyl-tRNA aminoacylation
  Homolog annotation: Hit_ID=A7PB55; Match level="QueryCoverage=90%, HitCoverage=76%, E-value=0.0, Identity=64%"; Hit description =Chromosome chr16 scaffold_10, whole genome shotgun sequence
  Pfam annotation: Domain name=DHHA1; Domain location=740-814; Score =24.7; E_value=0.00034; Accession=PF02272.10; Description=DHHA1 domain
  Pfam annotation: Domain name=tRNA-synt_2c; Domain location=3-457; Score=217.9; E_value=2.4e-62; Accession=PF01411.10; Description=tRNA synthetases class II (A)
  Pfam annotation: Domain name=tRNA_SAD; Domain location=555-614; Score= 81.8; E_value=2.2e-21; Accession=PF07973.5; Description=Threonyl and Alanyl tRNA synthetase se
  Pfam module annotation: Pfam domain module=DHHA1::tRNA-synt_2c::tRNA _SAD; Domain location=740-814::3-457::555-614
MEEDAAHLFLHCSKILPIWWESMSWVNALGAFPQNPRQHFSQHVTVLADGIRVNRWKCWWLAFICQLLVPIETVLSLIYGITCLEYYNFVIFVPLAHRRDDWAWKPDPSGQCSAKSAYDVLRGDIIKGTDDATGARPYSGKVGPDDADKVDMAYRVVADHIRTLSFAIADGSRPGNDGREYVLRRILRRAVRYGREVLKAKEGFFNGLVSVVVNVMGDVFPELKQQETHIRNIIEEEEESFGRTLIKGIEKFEAAVRQVQGNILSGEATTPPPRFLQEAFVLWDTYGFPLDLTQLMAEEKGLVVDVKGFDSAMEAARERSRSAQTKQAGGAIVMDADATSALHKRGIVPTNDSFKYAWFKDHESVVKAIYTGSEFVDTVNTGDDIGVVLESTSFYAEQGGQFYLLQKKIFDTGSLEGPHALFEVRNVQVYGGFVLHIGNGTGVSVGDKVVCKVDYGRRALIAPNHTCTHMLNFALREVLGDHVDQKGSIVLAEKLRFDFSHGKPIEADNLRRIESIVNEQIKAELDVSAKEATLAEAKGINGLRAVFGEVYPDPVRVVSIGQKVEDLLADPKNEKWLSISSELCGGTHISNTREAKAFALLSEEGIAKGIRRITAVTTDRAYDAMKVADEFEQQVDDAAKLVGTLLEEKVSSLKSNIETLSIPAAKKADIKIKIVRLQDQVRKAQKQVAEENKRKAVMITAEKAELAASNGKTFCISLVDVGLDVAAVREAVTKVMDQKGLSVMVFSTDESTNKAVVCAGVPEKGGKGNLDVADWLSNALGPLKGRCGKGKGGLATGQGTEASHVNEAIDLAEKFASMKLS

SEQ ID NO: 106832 - protein, 619 aa, Glycine max
  Coding DNA Sequence Number=SeqID_15147
  Gene Ontology: Mol. function=nucleoside-triphosphatase activity; Cellular component=protein complex; Biological process=cell division
  Homolog annotation: Hit_ID=A7P2W5; Match level="QueryCoverage=99%, HitCoverage=62%, E-value=0.0, Identity=74%"; Hit description =Chromosome chr1 scaffold_5, whole genome shotgun sequence
  Pfam annotation: Domain name=AAA; Domain location=365-550; Score =259.7; E_value=6.3e-75; Accession=PF00004.20; Description=ATPase family associated with various cellular activities (AAA)
  Pfam annotation: Domain name=AAA_3; Domain location=365-491; Score= -17.9; E_value=0.031; Accession=PF07726.2; Description=ATPase family associated with various
  Pfam annotation: Domain name=AAA_5; Domain location=365-497; Score =0.6; E_value=0.0026; Accession=PF07728.5; Description=ATPase family associated with various
  Pfam module annotation: Pfam domain module=AAA::AAA_3::AAA_5; Domain location=365-550::365-491::365-497
MWIYCRPLTKGQRGEVYEVNGDRVAVILDINEDRVNKGEVENLNDDHTKPPIYWIHVKDIENDLDAQSQDCYIAVEALCEVLHHRQPLIVYFPDSSQWLHKAVPKSNRNEFFHKVEEMFDRLSGPIVFICGQNKVQSGSKEKEEFTMILPNFGRVAKLPLSLKRLTEGIKGDKTSEDDEINKLFSNVLSMHPPKDENLLATFKKQLEEDKKIVTSRSNLNVLRKVLEEHQLSCMDLLHVNTDGIFLTKHKAEKVVGWAKNHYLSSCLLPSVKGERLCLPRESLKIEGPGNYVTEAFSKPQGMNLAKDEFESNFISAVVPPGEIGVKFDDIGALEDVKKALNELVILPMRRPELFSRGNLLRPCKGILLFGPPGTGKTLLAKALATEAGANFISITGSTLTSKWFGDAEKLTKALFSFASKLAPVIVFVDEVDSLLGARGGAFEHEATRRMRNEFMAAWDGLRSKENQRILILGATNRPFDLDDAVIRRLPRRIYVDLPDAENRMKILRIFLAQENLNSDFQFDKLANLTDGYSGSDLKNLCIAAAYRPVQELLEEEKKGASNDTTSILRPLNLDDFIQAKSKVGPSVAYDATSMNELRKWNEMYGEGGSRTKAPFGFGT

SEQ ID NO: 106833 - protein, 195 aa, Glycine max
  Coding DNA Sequence Number=SeqID_15148
  Gene Ontology: Mol. function=binding
  Homolog annotation: Hit_ID=A7QMM0; Match level="QueryCoverage=44%, HitCoverage=9%, E-value=3e-24, Identity=64%"; Hit description =Chromosome chr19 scaffold_126, whole genome shotgun sequence
MGSQERCAIQVTASTQLSEENFNGRSNMSIVKPVEDKVSDLCGKMDKSIEHGRVQQHDALILHLALLVPHWALVAAVYGSPLLPSQFDCCYHKKAIEKEKRKAEALASGIDWLSDDSDDEPQKENREPPLCNLLKDEEHHQLIIDALASLQRYWEALEIINLFLRLAHTSLSTEKKEELRSLGARKSRTLTGLYF

SEQ ID NO: 106834 - protein, 320 aa, Glycine max
  Coding DNA Sequence Number=SeqID_15149
  Homolog annotation: Hit_ID=Q9C5M1; Match level="QueryCoverage=82%, HitCoverage=82%, E-value=4e-37, Identity=36%"; Hit description =Putative uncharacterized protein At3g19800
  Subcellular localization annotation: CTP_CleavageSite=46; ConfidenceScore=5.05e-01
MANAGNLISPRNFNPIIFNPYHYATKLKTLRLLSRFHSYNNNATVTASKRKDDLQSPLIGKNTSRAPRRLITISPGDGKYHGDWTCDYRVSLHDLELQDLIEDDNNSRKDAQVFINLSIQKSVEHGNASMLALVYRWMEESPHPSLENVAPVLLRIADSCRGGIRDYNGSVIVSFAFKLGVCSITQAELWAVVLGIQNSMLELMRILVVFSPGVTHTRNQEANQIDAKFNVWVLIARRDDRKIPLPDIGGDPNVIYVRPGYEVDLDSLVQDAIRLNSVVKDTCSELCEKSEGTIQYITGQGQASVDKRWSRLLELKKENL

SEQ ID NO: 106835 - protein, 190 aa, Glycine max
  Coding DNA Sequence Number=SeqID_15150
  Gene Ontology: Mol. function=heat shock protein binding; Cellular component=cytoplasm; Biological process=response to stress
  Homolog annotation: Hit_ID=A7NWU0; Match level="QueryCoverage=94%, HitCoverage=96%, E-value=5e-57, Identity=62%"; Hit description =Chromosome chr5 scaffold_2, whole genome shotgun sequence
  Pfam annotation: Domain name=DnaJ; Domain location=11-80; Score=80.2; E_value=6.7e-21; Accession=PF00226.22; Description=DnaJ domain
  Pfam annotation: Domain name=zf-CSL; Domain location=97-174; Score =8.2; E_value=0.027; Accession=PF05207.4; Description=CSL zinc finger
  Pfam module annotation: Pfam domain module=DnaJ::zf-CSL; Domain location=11-80::97-174
MLLDKNDTQETHYEVLNVKEDANYEEIRASYRSAVLSLHPDKLLKTSETSSSNQTAEERFLKVQKAWEILSNSSSRSFYDNDLRSSRQDVLAADVAEDLSLQDMMIEDDGEALELFYQCRCGDYFSVDSLELKNMGYSLLREGSGISIMNVDTSPGSVILPCGSCSLKARLLINMDRSVTGKIPGAEIWS

SEQ ID NO: 106836 - protein, 355 aa, Glycine max
  Coding DNA Sequence Number=SeqID_15151
  Gene Ontology: Mol. function=protein binding; Cellular component =nucleus; Biological process=transcription from RNA polymerase II promoter
  Homolog annotation: Hit_ID=A7PNG6; Match level="QueryCoverage=88%, HitCoverage=38%, E-value=9e-98, Identity=58%"; Hit description =Chromosome chr1 scaffold_22, whole genome shotgun sequence
  Pfam annotation: Domain name=FF; Domain location=110-159; Score=41.9; E_value=2.2e-09; Accession=PF01846.10; Description=FF domain
  Pfam annotation: Domain name=FF; Domain location=177-227; Score=15.4; E_value=0.055; Accession=PF01846.10; Description=FF domain
  Pfam annotation: Domain name=FF; Domain location=245-294; Score=41.4; E_value=3.2e-09; Accession=PF01846.10; Description=FF domain
  Pfam module annotation: Pfam domain module=FF::FF::FF; Domain location=110-159::177-227::245-294
  Subcellular localization annotation: CTP_CleavageSite=67; ConfidenceScore=5.17e-01
MVTLNAPAINTGGRDAAALKPSSLQNSPSALDLIKKKLQDSGTPVASSSIPAPSVQTGPESNGSKTVDSTAKGLQVDNNKDKAKDTNGDANVSDTSSDSEDEDNGPSKEECIIQFKEMLKERGVVPFSKWEKELPKIVFDPRFKAIPSYSARRSLFEHYVKTRAEEERKEKRAAQKAAIEGFKRLLDEASEDINYNTDYQTFRKKWRNDPRFEALDRKEQEHLLNERVLPLKKAAEEKAQAMRAAAAASFKSMLKERGDISFNSRWSRVKENLRDDPRYKCVRHEDREVLFNEYISELKAAEHAAERETKAKMEEQVLAAKYLKLKLVYRTSSGKENGSCAKERKEKNRKWKGCD

SEQ ID NO: 106837 - protein, 629 aa, Glycine max
  Coding DNA Sequence Number=SeqID_15152
  Gene Ontology: Mol. function=binding
  Homolog annotation: Hit_ID=A7PNG7; Match level="QueryCoverage=97%, HitCoverage=55%, E-value=1e-176, Identity=54%"; Hit description =Chromosome chr1 scaffold_22, whole genome shotgun sequence
MAEKAAAPPPSKPLTTQEWETLIEGFQNGVHCKWSSLDPLFDPLLSSLHRKDFPLSLKLQLLVFLDEFSLSFFTSHNHLHRLVDALKTVVHAPLEAAAPSASTFKDQFMVSTTSILICASENVVVEAQTENNLVEFLLTVINRPNFGSDRHTRGVACECLRELERWKPGLLSDVVGHLWSLCQNERTHASQYYLLLFTSVIHSIVARKLNVSILTTSVPMVPFNAPNCVTDSGSGSSSDLGSGLNVKELRRALAFLLEWPQVMTPSGMMEFMCMIIPVAVALELQPSMLKVQLFGMIHSFDPILCHVVLSMYLRFLNAFDGQEGEVSRRLLLISRESQHYLVFRLLALHWLLGFNRMIFNKAKPSLELCSTFFPVLFDPLALKALKLDLLAFCSVCARVLRLKGGSHELIDPVRLFEDGLVCVSSFKWLPPGSTETAVAVRTSHKFLIASSSHSDNDPSTTRDLLDSAIFRTLQGLLVNMMLESRRLVPIVVAFVDRLLSCQKHSWLGECLLQKFDKHLLPNVRMDYKLVYCFPIFERIAENQTIPPCALLELLTNFMIFLVEKHGPDTGMKSWSQGSRALGICRTMLMHHHSSRLFLRLSRLLSFTCLYFPDLEVRDNSRYYIMNCCS

SEQ ID NO: 106838 - protein, 147 aa, Glycine max
  Coding DNA Sequence Number=SeqID_15153
VVVTENKRGYISCGSVLVEGTSTKLFKENKGGYIPCGSLLVKDFTSLKRNLKDRRSLGDWMTFVTLEVRARGGAATTFEKSLEATPEPPTLVADTTSPQQAADPSTPEDQTTPVMPPNASPITTLVVHFTDKEDVQTQDTQDQSHDF

SEQ ID NO: 106839 - protein, 174 aa, Glycine max
  Coding DNA Sequence Number=SeqID_15154
MVLHEKTIGVNLEDDDSTFDTCQTLFSTYMHTDYGEEKVDDVQENHNDPDEGELINIMATPLSSPPLESTPSPFMLKRIRKATQLRSLSARPVGVEIPVVHVDLTTEKALADDKDDGDDTVYEKYEHPDRVRTIGVSVKIKQYFGPTSAGSRTSMLIIPEELDRLKQNIKDELT

SEQ ID NO: 106840 - protein, 69 aa, Glycine max
  Coding DNA Sequence Number=SeqID_15155
MKPESWRLACQTIVGNKENSGKMSQRMRHKNIESSSCCSKDSSVEEVIDHAKQDLWILRKKSFICSSSI

SEQ ID NO: 106841 - protein, 48 aa, Glycine max
  Coding DNA Sequence Number=SeqID_15156
MVKGKNGKEIQKELEITNGCRKREVRGRTRGESESNKWREVVEEHHVG

SEQ ID NO: 106842 - protein, 182 aa, Glycine max
  Coding DNA Sequence Number=SeqID_15157
MQEVKLDKLSLLDVWKQGFLGINSFNYPYNYTRQEDCCSQPQCVEAKLHEESRLIQRCFDDNKDDDKGDDKKLKGQSKNELKMFKIESRTLQDSRGKVHLLGLLTENKRGYISCGSVLVEGTSIRFKENTGGYIPCGSLLANRYQDKELLIEEDEDAPPTRYVKAYPRRLFKHELEALKQKI

SEQ ID NO: 106843 - protein, 178 aa, Glycine max
  Coding DNA Sequence Number=SeqID_15158
  Homolog annotation: Hit_ID=Q6WAY4; Match level="QueryCoverage=96%, HitCoverage=31%, E-value=5e-18, Identity=32%"; Hit description =Putative uncharacterized protein
MGSSQAPSFKKRFYQVKIKSLGVASLKELGQLMGQLQRQAFCKAYGKIWDLTMVVVSMEAIASLTQYYDQPLRCFTFGDFQLTPTVEEFEEILGCPLGGRKPYLFSGFYLSLARISKIVKISTHELDRGKQVKNGVVGVPRKCLEAKARVLASQDEWAPFMDILALLIFEVVFFPNVD

SEQ ID NO: 106844 - protein, 178 aa, Glycine max
  Coding DNA Sequence Number=SeqID_15159
MDDTAAHNSDLPLPKCQLVCAILTQMSIHVAQVIADAIYLFAGMAPTRHPLDPEKSNRALGFPTLITGLCQFYGVQVAPSKAAGAPPPPRQANPAGPLSVERYLQHLVRQQAANHRGQGQGSAPFVCPTPEQFGAEVAWPGDWPEAQAWEEPAESPGKTDEPRMDEDMADLIGFLGGS

SEQ ID NO: 106845 - protein, 240 aa, Glycine max
  Coding DNA Sequence Number=SeqID_15160
MASNPSRAQKKAKLDTWFTNENKENDFKMLYTVKNMRIPKFLDLEWFSQQGFNFPDLLEAQGLSKLVQMKGTFYLVLVKVFYTCVYADMEGNMFSTVNGVEMVIEAAVRKAIARLDIGGVCKFEESIDGYSKMQNYRGMLLDLVRNLRNHLGVCGLTIEDRMLMYLITYILTPRSSNHAQMKEAEDEARQEHTNQWSPFESLMISKMDAMLHLHQEHSVDGGNCKLAVIACKDSLCIVKI

SEQ ID NO: 106846 - protein, 378 aa, Glycine max
  Coding DNA Sequence Number=SeqID_15161
  Pfam annotation: Domain name=Transposase_23; Domain location=227-297; Score=3.7; E_value=0.00047; Accession=PF03017.5; Description =TNP1ENSPM transposase
MTPIVKQSVKFRDMPEVGRKHCCAIRKAPQHPRSQRRDCCAIHKAKGGCSKDPSSSWLCILAVLGEKNCFRGENPSRDASVMLPRRFRERIREGFPSFFIVLHLFFIRSSFVLRSSIDAPVSLASPSRRRGLRGQGSLVVKKSEHKGRVVLVWFRTCKGILQDSGTLKRVAWGLDVGTREFLFKRNLGLLGHLSNIALPPEPLVGPLGPRVSTKESYVDPSGNDPETGDSYRCGLYIEVNPTRLVALRRVYEGSTIVHDTPLLPGQVKVGVEEVKDPDAPVLVPTDEVSLVGQAIHTFLAWPTHLVKPLSQQTVVSPEKPPQMLDPKVNDPLYLMTLTIPELFLRPYQVTWDATMFGVFNPDFPLYIKHEDLSKIAHG

SEQ ID NO: 106847 - protein, 27 aa, Glycine max
  Coding DNA Sequence Number=SeqID_15162
MEVRTLLHRHLESFVCTINLKECNIDL

SEQ ID NO: 106848 - protein, 114 aa, Glycine max
  Coding DNA Sequence Number=SeqID_15163
MNDVVVDDPLRELIKSLVDIYEKPVQLVWDVSKFGIPNVDASLFLTCADVNEIISSVQCLNIAILQLSTIVIAWVMDRCIDSLSRSQYSMQRIDVTNVKITLRNGLRNCTERSI

SEQ ID NO: 106849 - protein, 112 aa, Glycine max
  Coding DNA Sequence Number=SeqID_15164
  Subcellular localization annotation: CTP_CleavageSite=17; ConfidenceScore=5.24e-01
MAESSKKRKGSSSSTVAAGHRRHGPSEAPTAPIHPSLSSPRSSTLFSSDDQRIWYLSQFSSRIILDPKYLDIDFFNDETFDCYQVFQNSGFVDFMSLKFPYYPELVKVFTAI

SEQ ID NO: 106850 - protein, 82 aa, Glycine max
  Coding DNA Sequence Number=SeqID_15165
  Subcellular localization annotation: CTP_CleavageSite=59; ConfidenceScore=5.18e-01
MCRKPYIPAGTSTDSDVPSLILSSSSLCGRGGGAAVAVRWCCKYGSNKMNRGKVDFLVVARAEKNKVEGRERKGKEGSWWEL

SEQ ID NO: 106851 - protein, 215 aa, Glycine max
  Coding DNA Sequence Number=SeqID_15166
  Subcellular localization annotation: CTP_CleavageSite=40; ConfidenceScore=5.57e-01
MASAINNSDPPPPPPPTSTPVVDSSIPVNVTGNATEIPVSATPIQTVLPMATPIPQPILTTTPTSATGVTPSPQSSTSFSHSISAKLTNSNYLFWCQQVEPVLKGYLMNESTVSLICSKFEPLSIDEVKTLMLGHEARLDKFYKKNSSVTVNLTQGASSSDSSVQPIQAVQVPKSVVPAPTTTTTTTPYPTRWGRLHGSTSAIMFYQVPYFYPNH

SEQ ID NO: 106852 - protein, 41 aa, Glycine max
  Coding DNA Sequence Number=SeqID_15167
MGKIGEVQNSLTRMSCTEVLSECQLAKRTAFILQAEREDWH

SEQ ID NO: 106853 - protein, 217 aa, Glycine max
  Coding DNA Sequence Number=SeqID_15168
  Subcellular localization annotation: CTP_CleavageSite=47; ConfidenceScore=5.63e-01
MAASLFLPSSPFKLNPPTPNSVTSLLPFPFPFPAPTCEPVLMNVDLVASILSKTGKLKALDSEWIQVIFEAPELKVRIGFQRFPVCFSKNMKSKCDKKKFLQAFSESSVKLASGSPGPPNYFKVKEPARLGEPVTLGVSISSPGRAAIAPSAHFPINRCAREDEEKFQGSVLEGIERIKKEEEEEERRGNEAEALPNHDCDQSLDRSSFGILCATVG

SEQ ID NO: 106854 - protein, 560 aa, Glycine max
  Coding DNA Sequence Number=SeqID_15169
  Gene Ontology: Mol. function=protein binding; Cellular component =integral to membrane; Biological process=multicellular organismal development
  Homolog annotation: Hit_ID=A5BIV8; Match level="QueryCoverage=45%, HitCoverage=36%, E-value=3e-71, Identity=56%"; Hit description =Putative uncharacterized protein
MGDEKGEKKETSPSASASAGNDKKNEKKKKGFISRIWNAIFRSNRDDFEKRLQYISKEENAVVTRMSNRSRSWRRTSRQLILFSVLFEGGCKVLNCSRCRGVSENLDIVKICGRNCRGDVDWFLEELGLKKLFVFGNDAWHSGNAVLKVIAVGYAIMTTRSMDMNWKMRAIRVLPMFLLPALSSATYTAFVSFTRIPPSQLADETTILPLLSFLQPAEETPILILSPLVQLLQLAEETFPLLNPRGFLFPVPLEKAYDEIELKQISEVFQVLGLDSLGGDLSDWDVLSSSWIHLELYKMDQKILESLRAERKAKIDELKEKTNYYITQQLIQRYDTDPAAKAAAATALASKLGADSGLKVYVGDESSGASTGKTKDVEVVQSSGLRNRKQVTSRSTSSGTTTPNYSDQQFVGSGKIDQTQTPEHNQLVVVEHHNPQSSTMNDGGWIARIAALLVGEDPTQSYALVCGNCRMHNGLARKEDFPFITYYCPHCHALNKPKQSDERTSGLNSQNTQSPKADDREEVKNASDSESESVIRSDNPVNTSPEIEEVSEPAISVEKN

SEQ ID NO: 106855 - protein, 1096 aa, Glycine max
  Coding DNA Sequence Number=SeqID_15170
  Gene Ontology: Mol. function=cysteine-type peptidase activity; Cellular component=cytoplasm; Biological process=ubiquitin-dependent protein catabolic process
  Homolog annotation: Hit_ID=A7P551; Match level="QueryCoverage=98%, HitCoverage=100%, E-value=0.0, Identity=57%"; Hit description =Ubiquitin carboxyl-terminal hydrolase
  Pfam annotation: Domain name=UCH; Domain location=63-431; Score=42.7; E_value=4.4e-10; Accession=PF00443.20; Description=Ubiquitin carboxyl- terminal hydrolase
MTRPTTRSKNKRQRQGDDDGGGTSDIWRKIHITGAVTEDDMNQLYMIWKPVCSGCRVNTKDNPNCFCALVPPANGTRKSGLWQKMADFVESLGPDPNMDLRVSDSSPAEPDVLQQQPVLDQLTQLFVHLHASKMAFIDSSPFVKTLELDNGIQQDSHEFLTLLLSLLERCLSHSKIAKARTIVQDLFRGSVSHNPFLVVGQKLRCIGTDMDRGHDSDTDAAAQQNLMCSQCGRDSEASSKMEDFYGLELNIKGLKGLDESLDDYLAIEELHGDNQYFCESCKTRVDATRSIKLCTLPDNTMKKKVTSAFSFPAELDMRHRLSEPSQFELIYDLSAVLIHKGTAVNSGHYIAHIKDVNTGQWWEFDDENVTNLGCHPFGEGTSSTSKSVKTDVLHSNCSEAMLADSNGLDATHAQSLLVETFSSSDAYMLMYHLKHSKNVGEKGGIVYGANLEVEGNAVTAQDSACLPSHFCKEIQNFNASYLDSCEQYKHRKELELSHINERRQEVRSILAEAPTQPLEQPYFWICSDWLRQWADNIIPIALDNTSIQCSHGKVPVSKVTSMKRLSSKAWDKLLSKETIVICGSEGGLEYGGGPTLSHEDCCWDCLIDGAQNVVSADTYRDQRESLKRLARDILDGNCEDGMYYVSRPWLQQWWKRKVVDAPSEADAGPTAAICCPHGQLMPEQAVGAKRLLVPEDFWLFLYKDAISVKPDDPLGCPTFPLDSRRCSQCSDELSEEACLEDSLRLVKQMQRQNHEKLFVGKSMPLSLHCKYFLVPSSWISKWRNYINLAVKNSDKPETLDGVIDSLMCEKHSRLIERPPELVFRRGAIIARESSVSGLTIISENDWKCFCEEWSGIETKGISARIENVNDSENALTGSCREMPICEDQLNTWDKVNNESGNGHIVIKTCPEVCESCVGEKESCELMQKLNYCNQDISVILVRGKEVPKSILEASKGFVEIDRRVSKRSRKTKNGSSISLKVSASTSIYQLKMMIWESFAVVKENQILQKGDRTIDVDNEYATLVDANIFAGDQIIVRDSEIHENRDIADELCDEEMETQHTEAGFRGTLLTSNVSSQEVASDGGHMVVDVGIWRDK

SEQ ID NO: 106856 - protein, 105 aa, Glycine max
  Coding DNA Sequence Number=SeqID_15171
MIIYTTTPAAILLFEQKHRRREWALTGPDEASIEHRSHMSFQFGFLAVRVSVWLHVDKVRMGKEMDKVSDGAMGGEEDELGGLVHCRGHGLNEIRQTHFGFGSNI

SEQ ID NO: 106857 - protein, 144 aa, Glycine max
  Coding DNA Sequence Number=SeqID_15172
  Gene Ontology: Mol. function=binding
  Homolog annotation: Hit_ID=A7NVF7; Match level="QueryCoverage=92%, HitCoverage=11%, E-value=3e-22, Identity=36%"; Hit description =Chromosome chr18 scaffold_1, whole genome shotgun sequence
  Subcellular localization annotation: CTP_CleavageSite=53; ConfidenceScore=5.03e-01
MIKALEKISTNWTKAVTDAGVPVVVLVKLLHSTLSIALNASRVHDRSGASSAEQMMEAVVSRYAIGPLSKYLTRSQSGKLLSALALAFGRSFPECRALIGLLEDRPTEEMKGGGYLCIAKELLLSPNAEVAAQAIHCKNMCQMS

SEQ ID NO: 106858 - protein, 173 aa, Glycine max
  Coding DNA Sequence Number=SeqID_15173
MVRTRGLGRALARVIGRGRPDEHDAIDVPRRHRPTASARRQQMTEDVPHMADDVPQMSEDAPQMIADVDATIAEELGRDGAEGSHADEGFPGEPRDPSVLTSFAEHVAHAIWTGQERHEPKLVSHGRKVALIGRPVPEIEGLVAATGLSPLIGCSVATGDPGLIDVPSFSSIF

SEQ ID NO: 106859 - protein, 127 aa, Glycine max
  Coding DNA Sequence Number=SeqID_15174
MTRDNPSDLQPFDPEIARTFHRLVRHHFIPFDHPEHSITGESVHSVIGDFEHPDFEHYNFEHSDYEHSDFEHSENMAQPPPRERTLREMAAPDFTYESLCIQYPDEDVPYVLKTGLIHLLPKFHGLA

SEQ ID NO: 106860 - protein, 150 aa, Glycine max
  Coding DNA Sequence Number=SeqID_15175
VAGTMRGHVLANLKLGTAHDTNSGGDAVRSMLHDEVVVCDLGVGIRGRNKWWSSRKLIGKEALTPKGVCRLEEWHDKDALMVESTLQVKSIDACLNNVALRGGRRGRKQWSCLTKNLRYCLHQHHHRFRVEVQGKGRVALNHEGEGKGAR

SEQ ID NO: 106861 - protein, 56 aa, Glycine max
  Coding DNA Sequence Number=SeqID_15176
MKKVVIGICYLYLSMQVYRQHEWRDTPVLDTWPDIANGAGEFGVDTCLRWNLVNNR

SEQ ID NO: 106862 - protein, 174 aa, Glycine max
  Coding DNA Sequence Number=SeqID_15177
MVELFLVILEATKRKKENMGSASRVESSNYDYYFKENGTRWHRIIYTTFLQIQELFLSKETLGTEPLPIIMVRTRGLDRALGHVTSRGDHDDSDDAPLRRRPTTSAQRQRVPVTAAHDEPVLPAPNVEADVFSDDPMAPANVEDIGPDIPDDTGAQAAEDEDEGFLGGPSDPSV

SEQ ID NO: 106863 - protein, 118 aa, Glycine max
  Coding DNA Sequence Number=SeqID_15178
MANEMNKDEWMYEIMSEQADMDYENEEACGANEPHVDCSNAFNTSQVFECREDVLRWARFVAHENRFVTVILRSDTNIGVASIDVGKKNLSEETLRLGNVGVPSSFVASQWLEEKAEW

SEQ ID NO: 106864 - protein, 267 aa, Glycine max
  Coding DNA Sequence Number=SeqID_15179
  Homolog annotation: Hit_ID=Q9M089; Match level="QueryCoverage=59%, HitCoverage=81%, E-value=9e-54, Identity=68%"; Hit description =Putative uncharacterized protein AT4g31130
  Pfam annotation: Domain name=DUF1218; Domain location=109-225; Score =137.1; E_value=5e-38; Accession=PF06749.3; Description=Protein of unknown function (DUF1218)
MAATVKQMSLIVSLFGVVSFILGVVAENKKVMFLNFNYDSGDADIRNLNKNFVPHCPEALRYAKVQYDFFLKSVVDSLTCYSALIGDIDSVIPAAGTPVPGLDGVSVTCKYPADPTVALGYLSTAFLVASTVTGYLSLFYPYKGKSIPQGVLFKHTTFTVFFNISLFTTGLAAAMLLWPTITEHIHLTRNVHRNINYECPTAKTGLLGGGAFLSLDSSLLWLIALMLADNAREDFFEEEGEDGDKGEFGTASSDAYYDADSGPKASS

SEQ ID NO: 106865 - protein, 288 aa, Glycine max
  Coding DNA Sequence Number=SeqID_15180
MVNNPSRAQKKAKTLKRKQGECFQVALNRLDTWFTDESKKNDYKMIYDAKNVRIPKYLNLEWFSQQGFNFPNLLEAQGLSKLVQLKGTFYPELDKVFYTCALVDLESNLFFIVNGVEMVIHIEVWKEVVGLDMGGVHKFDETADGYNKMQTYRGMLLDPARNLRNLLTVYGLKSGIKMNWVLLIEDIMLKSHQLVDYKFPYVVLASRFIDYFNIDVSNEIVDFTKTSSEIYQKASQEAWNEKMDAMLHLHQEHSAKVHSSLENITTWLENIKTRLTLSNLLNPDEDEA

SEQ ID NO: 106866 - protein, 66 aa, Glycine max
  Coding DNA Sequence Number=SeqID_15181
MVSLTRPARAGKALLKPYHECVVLQRTSPRNVKCTRDKVGRMAFPVVVRTEEWNTHIDTLKDLFKG

SEQ ID NO: 106867 - protein, 62 aa, Glycine max
  Coding DNA Sequence Number=SeqID_15182
MVRIKGLQQTLGRVLGRSLGRQVSGDEEEAPQRQRSTSLARTYLVEVGLSWEEGGEIWKVYT

SEQ ID NO: 106868 - protein, 257 aa, Glycine max
  Coding DNA Sequence Number=SeqID_15183
  Subcellular localization annotation: CTP_CleavageSite=61; ConfidenceScore=5.12e-01
MLQPYEISIGLKEHSNPVTPKAYTPKSPSGPLPPDSASDSNISSGSLRFLPTAPIEFSNVREMKKGLKPPLVLSSCDSIFSLHEYYLKNPNGGNSFGFLRKIKMLQCEGFSSKLRYDFEIRNVENVLNWVANVVLKFRDDPTVNESEIVVFLRQMRENPPDGLHEVEVHGFVIVLEVDPLPDVLALLDAKLLVDLILDGEAMAIPVEAVGDVVGDHGVVVRDDVLDGADENVVVVREVGGKGRAIVEDVLGLVFGQR

SEQ ID NO: 106869 - protein, 161 aa, Glycine max
  Coding DNA Sequence Number=SeqID_15184
  Homolog annotation: Hit_ID=A5AJI6; Match level="QueryCoverage=83%, HitCoverage=14%, E-value=6e-07, Identity=26%"; Hit description =Putative uncharacterized protein
MSNLHVDEDDDDDDDDDYLVSNSYVEESLDEDDSVNGISDTDDEVTDMIQSVRIVHPAEGAQGIENPFWNDALHYNNINWSYPDEEDICGLEMSSTFNVGQELYVGLEFDIVINMIREDPSIKVSLIQERINSEFAYKVSYKKAWLAKQKAIAIEYGDWDE

SEQ ID NO: 106870 - protein, 167 aa, Glycine max
  Coding DNA Sequence Number=SeqID_15185
  Gene Ontology: Mol. function=endonuclease activity; Cellular component=cytoplasm; Biological process=DNA repair
  Homolog annotation: Hit_ID=A7P541; Match level="QueryCoverage=68%, HitCoverage=43%, E-value=5e-42, Identity=72%"; Hit description =Chromosome chr4 scaffold_6, whole genome shotgun sequence
  Pfam annotation: Domain name=Endonuclease_5; Domain location=38-167; Score=8.4; E_value=1.1e-07; Accession=PF04493.5; Description =Endonuclease V
MEKKSPEPPEEASQSRDSSRDNQTWITAQNILREKLITEDCFAWKLQAGSKEEEALRYVGGVDISFSKDDPSRACGTLVVLDFHTLQVLYQDFSLVTLQVPYVPGFLAFREAPVLLQLLEKMKRSNNPFYPQLLMVDGNGILHPRGKCFTRIFLHPPYKSHAQDFSD

SEQ ID NO: 106871 - protein, 63 aa, Glycine max
  Coding DNA Sequence Number=SeqID_15186
MDFRATFAVFFENDIPCENDDLGPIHRWIVVKFAYHIRNPSSSILTVGNCKNVSELREIPFAP

SEQ ID NO: 106872 - protein, 94 aa, Glycine max
  Coding DNA Sequence Number=SeqID_15187
MAKIMLNVTVASEAILNINNVKDQIYGEVSRSFAMRWKDVLDRYWHLLDKDGNLHTVLYNQDLDRPAIVAGWTTLRNFYRMHDRRSSRVVNPLW

SEQ ID NO: 106873 - protein, 78 aa, Glycine max
  Coding DNA Sequence Number=SeqID_15188
MSFIYELGGVLVGWEHDDVVENGGCEEKWRRFWCDGVLVTQLAKEFFSLCFTSDCAGDGFGEAPSGSDEVASTHSGGA

SEQ ID NO: 106874 - protein, 215 aa, Glycine max
  Coding DNA Sequence Number=SeqID_15189
  Homolog annotation: Hit_ID=Q9FH24; Match level="QueryCoverage=28%, HitCoverage=16%, E-value=4e-13, Identity=57%"; Hit description =Genomic DNA, chromosome 5, TAC clone: K20J1
MDSNFFFYHTYWDVVGIKVWEMIVHSFHSSTINPALVETLIVPIPKVDNPMSLKDFRPIAKTSLVKMVQKELDMFCKATGLMINIQESRMMVSKNISQRKASKFANILGFKSTQNIGFPAMKGGGVSTGEDHDMADRMQCSDHPYRNNPSGIYAFCLQEKLDKLISSSFPLSICAPSSPSFRSDAITSSSPTLPPQHPSLLFFFLLPHQEQRHQL

SEQ ID NO: 106875 - protein, 61 aa, Glycine max
  Coding DNA Sequence Number=SeqID_15190
MGGVGKGMSGQLEFRTKELFSTVTGTKMARKIISSIMRNFGRWKMIGEHSVDCGAHSASDT

SEQ ID NO: 106876 - protein, 45 aa, Glycine max
  Coding DNA Sequence Number=SeqID_15191
MGLSGLKEHSNLVTPKAYTLKSPSGPLPPNSSPTPKIILAHRLYL

SEQ ID NO: 106877 - protein, 186 aa, Glycine max
  Coding DNA Sequence Number=SeqID_15192
  Gene Ontology: Mol. function=nucleotide binding; Cellular component =plasma membrane; Biological process=small GTPase mediated signal transduction
  Homolog annotation: Hit_ID=Q40209; Match level="QueryCoverage=26%, HitCoverage=30%, E-value=1e-13, Identity=71%"; Hit description=RAB5A
MRRCYKEALIPTSTQFRRESVYVTKIPRIEKEKRIRRVPGTCSSFSKIEMELLSLKNAVSTFSLIASPESRHLHRRKVSTFSLIASLESCHRRRRKGETQSLQVVTLTRVKAVFVAPWFCNVTQNVRNSGWSQPDLIMEESTIGAAFFSQVLAVNDATVKFEIWDTSGQERGVTAAIIVYDITSSV

SEQ ID NO: 106878 - protein, 456 aa, Glycine max
  Coding DNA Sequence Number=SeqID_15193
MGVADIFPEYTQTPIKRKVKKEPKEEPQFVVDQTIGTQDQPVDLEFGSMSQQTRDPPPPPSDPKLSNHPKKPKKQPTSDPRTAQKRKIIDSKQSAGKATMIEIDSELVPKEVIVESIQEHGHEAELMSTYVVERLAKIEATMVPEDMDPMEKDVLEEAMLHPIIKASLKDQEDDIVETNCVYHMLVIANDEKMSGIEEDFASHYRAHDICISLTSLDKRLMRPDERQATKWILPSRPPIPKASPSLQGWEQSTYGLELRMKLLAYKEEIRSRQTSFKQIKRLNVHMPFMIGFQFSCFDTHNTQLQILVDKPMQYQKVNYYNGKELLIEDDEDASPTRYVKAHPRRLFKHDHEALKQKTELTNLNWYAIKRFHKLKAHCSGNAFQHDLFMDKGVFCSDRTFSFVVNLPHSRFTFTHHMQPIIKEVDSNVEAEVDLSAMAVEVYDRPSSREYVKLIEA

SEQ ID NO: 106879 - protein, 66 aa, Glycine max
  Coding DNA Sequence Number=SeqID_15194
MVGYTPSRFADLVFAGERIEVSLKRGKSNHPALMNAKTGANEDDENEGETLAMTAIPTRSNFRSAQ

SEQ ID NO: 106880 - protein, 334 aa, Glycine max
  Coding DNA Sequence Number=SeqID_15195
MGHQFKFICVKDVENVLRLEKDLDNILIDIIKIHSKGKQNKEGENKDNRRQQPTYALKRLSGKGKPTRDNNQRTLQQICNGTKNHNGINRVNLEPASNGGRLQNQIWQVKKGNIKEDNFEEWTSLNVKANGIQAQRLQECWVGTLKDTMFCKLHEECYEGNMGEIKLKLWKIGNQQWYLVQEAIRDGDGGCKERSIEEGGNTNEMKAVIDHKGEDEIMQSTPVTLIDGNSGGEKEGVGDIIGIGGPRVHVVQNTDLYSSGMDWANKSQSRVWNTPTHDFARTTLGAMVLSGRLMHMGSISRGNNMVHLTNAKVKARKIMDTCWGLLTMDAKMKW

SEQ ID NO: 106881 - protein, 164 aa, Glycine max
  Coding DNA Sequence Number=SeqID_15196
MSWSFKPTIDMNLTFEETHVCAYVFNPNMDPSGNKILYGVGNNLGTRQNFHSWCPNKPIREEIILFMALKVAYNQLYRTRSVWLPPAFALDVIDGTAVETLVEHYGKDWMPSFSNLKLRKIRIMDLRMDANGGVICESVVWSGKNVAAVLDEKTVRMKVTMTLR

SEQ ID NO: 106882 - protein, 68 aa, Glycine max
  Coding DNA Sequence Number=SeqID_15197
  Subcellular localization annotation: CTP_CleavageSite=46; ConfidenceScore=5.54e-01
MEAQTRTPQMQTRQYGCSHRSAAQFATNTNSGRRRNNNKALVTEAQATLTQGERRRTIWFKRKEKEEE

SEQ ID NO: 106883 - protein, 232 aa, Glycine max
  Coding DNA Sequence Number=SeqID_15198
MVKSEGELGFCGRNLGERVGALEGIKIGSLRVVCRHESRLSLLFVWMYEIVDVCGKRATHVWMMDKDTLGYNERRGSKNLGKLASGYYPTFGGLIWHGELSPHFATFDELRDYAFLSWELGNQCTLYPNKGLISTTNNFQVSMRSRTWHPCELGVVRRGNGYGHVSNVLSYCMELVVIAEVIEDKGDHSDMTSEEIEEYKELLCQLEPSFEYESMKIFLRTCLRYSLVLRVG

SEQ ID NO: 106884 - protein, 100 aa, Glycine max
  Coding DNA Sequence Number=SeqID_15199
  Subcellular localization annotation: CTP_CleavageSite=49; ConfidenceScore=5.43e-01
MTTPPRSPPPPPSTDAASHSPPTLKWTRKATRLRSLDTRPVGAERPLVYVDPVTGKADGPHRKKLRTFLGIVAHDKVDVTYENWKQVPVAQKDLIWEDIQ

SEQ ID NO: 106885 - protein, 232 aa, Glycine max
  Coding DNA Sequence Number=SeqID_15200
  Subcellular localization annotation: CTP_CleavageSite=41; ConfidenceScore=5.41e-01
MVESYKKRKGSSSTTAAAGHRRQGTSRDTTAPIPPSISSPRSSTLFSSDDQRQRYYSQFCNRVILDPKYLDLEFFDGETFDCYQVFQNSALTDFMSLELPYFPELVKVFYNNLKIQDGIIYSEVHNIPIIIDQSLFFSLTKLPNQVVPFEGTLVDDWKFDYSSHDARRMVCNDQADMTDRLLVGSLTFDCLIMHYIIVRILLPRSSNLAQASEEDLILMWAFQTGRQIDWAI

SEQ ID NO: 106886 - protein, 92 aa, Glycine max
  Coding DNA Sequence Number=SeqID_15201
MDQALEANIQLTIDNANLNFNVDNLKESMKKAEEVVEKRKVEYQTLMRGACEKVIQEHKAGFDKAIQQLLKEVFSKKLFKEVFSRKLLKETT

SEQ ID NO: 106887 - protein, 215 aa, Glycine max
  Coding DNA Sequence Number=SeqID_15202
  Homolog annotation: Hit_ID=Q6WAY4; Match level="QueryCoverage=46%, HitCoverage=18%, E-value=2e-08, Identity=31%"; Hit description =Putative uncharacterized protein
MGSNQAPSFKKWFYHVKIKSLEVASLQELGQQMGQLQRQAFHKTYGKIWDLAMIEGSFEAIASLTKYYDQPLRCFTFRDFQLVPTMEEFEGVLGCPLRGRKPYFFSGLYPSMARIAKVVKVLTQELDRVKKSRNEVVRIPRKHWEEKAKALVDQGEWTSFIDVLALLVFGVVLFPNVDCSMAGMCTRSRSLILAKHQIPLFFGIDHTSRHGDGHL

SEQ ID NO: 106888 - protein, 219 aa, Glycine max
  Coding DNA Sequence Number=SeqID_15203
  Homolog annotation: Hit_ID=Q6WAY6; Match level="QueryCoverage=46%, HitCoverage=18%, E-value=3e-12, Identity=38%"; Hit description =Putative uncharacterized protein
MLFLLITTARKVRSLLFWLMPMTHLIEDARRATQGLSVAHPLFIYGWSLTFFVKKVDPSVPYKVTACAPRKGKQIGRSSWLEGRAELSSCEGIPNVPLMGTRGCFNYNPVLAIRQLSYPMRGAPSEESITPFIARGFSDPNAKMLQRVRKAWNAVQRKDKELRGSNNNVIGGYHQWLKARMQGITWLPKLKSPSGEETEVPEESEEVQALKEKLERTQV

SEQ ID NO: 106889 - protein, 98 aa, Glycine max
  Coding DNA Sequence Number=SeqID_15204
MAFACDIVKFELWNEFVHVWLPFGVDVEFDGHRFRSEEHQCRFEEIKGRSFLKERRVQLRDREYAEFQEEIARRQRTQLATPMAKYDLEIVMEFYANA

SEQ ID NO: 106890 - protein, 115 aa, Glycine max
  Coding DNA Sequence Number=SeqID_15205
  Homolog annotation: Hit_ID=A5AF98; Match level="QueryCoverage=85%, HitCoverage=30%, E-value=6e-07, Identity=31%"; Hit description =Putative uncharacterized protein
MAHHTAIPLELEVIPKVKELLDKGLVRKSLNPCAILVSKIGIMRHQIPMIGGMMNVLSGAPLFCKITNAPNIFMICVHRDSLGSDQGLPMDLKRIKVIFEWPTPSSMREFGALMT

SEQ ID NO: 106891 - protein, 104 aa, Glycine max
  Coding DNA Sequence Number=SeqID_15206
MVAVGDGESAWDIRNGFGRKKGEEMAFFLSYTKAKAELLAHSRHIRKDPNGQIMDKCLVKFQTKFREDPTVNQGWAVFLPRQLHVAFSRSFIKRLSPEASSWLL

SEQ ID NO: 106892 - protein, 68 aa, Glycine max
  Coding DNA Sequence Number=SeqID_15207
MRFCVVVTTLVMMVTLIAATTKEIPVMVEVALVVVAMLMVVVVSGCGTIGGGDNDEGGISGCGGGDDD

SEQ ID NO: 106893 - protein, 1699 aa, Glycine max
  Coding DNA Sequence Number=SeqID_15208
  Gene Ontology: Mol. function=nucleic acid binding
  Homolog annotation: Hit_ID=O65537; Match level="QueryCoverage=94%, HitCoverage=98%, E-value=0.0, Identity=37%"; Hit description =Putative uncharacterized protein F4D11.180
GFESPRDSQTLIPQFALVIFDICGTNRLFGGMSVETITAMHGVVGYFGFRFVLDEGRTENSNDTTCPKKSRSLDLKSLYKSKWTENTAKTNLKRIGNSSGGGDEKRKKKKARKEVSLSSLENGDGSRELKLGLSQRFSSSCSSVLNKISFSVGDDDVQIPKRKRSFVGRKKSELGQASKLVEQPGLKIGYGDQVPKLGSDDLGNGVESFKIKHRKEFDEFKENRISDSNSVQHDVSKNSVQHGKENGDCSFHSVVNSGDSSLSKSRRKNRKRKASALDRTKVSKEAEPLVSSCKISDDLQEDEEENLEENAARMLSSRFDPSCTGFSMKGSNGLSVFRSSSQSIVNRGLNSQLGSESASADTAVRVLRPRKQYRNKGNSRKRRHFYEILLGDVDAYWVLNRRIKIFWPLDQSWYYGLVDNYDEGSKLYHIKYDDRDVEWVNLETERFKLLLLRSEVPGNAKGERALTKRSSFDHQKGSKSRKERQRTEANAGDDRCGDSSLDSEPIISWLAQSSNRLRSFQGIKKQKTSVTVPSTMSSFLYDEPVTAKGHLAKSSLRGVENNFSSCCVSQDKSSDDFKDKSSLQCVTRAKDGKQPMVYFRRRRIFKPAPISPHISERNHASISASGSVAFDHMFGGVENVKNPIDNRVEVGGPLFFTYKAGVSNFFWDMESASFKFGFNFPMRLVLSDFFQSENVWLLYTVLLLRFGTVMAKWPRVCLEMLFVDNVVGLRFLSFEGCLNMAAAFVLFVLRVFHQPACQGKYVDLQFPCTSIGFKFSSVHVIKMPLVFEFYNFSEVKNSKWMYLDSKLKGHCLLSKQLQLSECTYDNIQALQNGSRRFSITSISGPSSVKVTQKSRPGINIIGVSKGSTQADTLPYSDAGERKLPPFGLSFAAAPTFFLCLHLKLLMEQSATCIRFCDQTPIFDQEDPGLMTNGCTSTDDCSNRNSEVILRRGMETLSNSAADDGGSCADSDNPSTCNDQILTRNYQNIGLNGAITSISHDFERLCKTHLPEWQSHYLEQELVSLPSSSLKHQDKANDGSHSFIGDLSIQIPAVDQFEKPDDNGDLCDAEHSPDFSWNINGCGIPSSNPTAHRSSWYQNRNNSLSLGFQSHVWSDKKVDSLCNDLSNGPKKPRTQVSYSVPSAGYEFSSRQRNHHQKGLSHKRVRKASEKSSDVARVPEKNIKCLSCGANVLITHGDKGWRESRAHVVLEVFDHNEWRLSVKLFGITRYSYKAHQFLQPGSTNRYTHAMMWKGGKDWILEFPDRSQWALFKEMHEECYNRNIRSASVRNIPIPGVHLIEENDDNGSEETFIRSCMYFQQVEADAEMALDPCRVLYDMDSEDEQWISNAQNSVKDNSEFSWISEEMFEKTIDVFEKAAYAKKLDHFTPDEIEDLMLNVGPLCVVKIIYDHWQQRRQKKGMALIRHFQPPLWERYQKQVREWELAMTKNNAPSNGCLDKVTTLEKPAMFAFCLKPRGLESLNKGLKHRSQKKISVSGNANSNLDQDGFHTFRRRQNALPFGDENQGHSYDSFDDSSLALTSARVFLPRDAGSLKYYPTSNGAGYRNHIPKFHKPRYDSPGSRHHFLAGPKRQGIEQLDASVLEELRQRDAMAEARFKCHLAKLKRDRAKRLLYKVDVAIHKAIATLMTAEAMKASEDSLVRGGDSVAADCNSFPLFSVLLGTFSSLGSAQFRVTVALICMVY

SEQ ID NO: 106894 - protein, 112 aa, Glycine max
  Coding DNA Sequence Number=SeqID_15209
MDDDHHGKRDSDGAISVNEIRNNDDTITIIVETPKQPSIDDEDTSQRWCHYGVCCCDHHRREQMYGGHHSGWEIWEQTTFKNEVVEVWEMKHNLETKKFREGSFESVGDEEK

SEQ ID NO: 106895 - protein, 30 aa, Glycine max
  Coding DNA Sequence Number=SeqID_15210
MDTSEPYTGAMRGIMHEPQANLGTDKKFSP

SEQ ID NO: 106896 - protein, 72 aa, Glycine max
  Coding DNA Sequence Number=SeqID_15211
MLKLLSKIKVKKNHTFPVVYEREYYDVKGLVLVEALNQQPENDREGALEGLKMNITDTTKGAENGIIGWLTK

SEQ ID NO: 106897 - protein, 181 aa, Glycine max
  Coding DNA Sequence Number=SeqID_15212
  Homolog annotation: Hit_ID=Q2HTA0; Match level="QueryCoverage=30%, HitCoverage=8%, E-value=3e-10, Identity=56%"; Hit description=IMP dehydrogenase/GMP reductase, related
  Pfam annotation: Domain name=DUF1723; Domain location=100-149; Score =45.3; E_value=2.1e-10; Accession=PF08330.1; Description=Protein of unknown function (DUF1723)
RLLRRGLGRQVTGDEEEVPQCRRPTTSACRQWTTTIVAEDINHVDHAVDEATSVLMSYANHVATRVWAGEVEKFGRYAPEIEGIVAATGLSSLITCLLETGDMGLLFVFAESWNKETSSFHISIGEMTVTLNDVASLLHLPIIGAFHTFDAIDEGDPSPKPWLGDSSKIKQGMQKKALGFS

SEQ ID NO: 106898 - protein, 477 aa, Glycine max
  Coding DNA Sequence Number=SeqID_15213
  Homolog annotation: Hit_ID=A5AWQ8; Match level="QueryCoverage=92%, HitCoverage=24%, E-value=1e-74, Identity=52%"; Hit description =Putative uncharacterized protein
  Subcellular localization annotation: CTP_CleavageSite=54; ConfidenceScore=5.35e-01
MSLKNHTLFFGTSLHGSLESGTSKRSPFRLDKRQLLPQKVLCSCTCCVSPKRCRLNKAKGFIEANLLPSVCSAISEHIQRDLVFGKVRQISLLSITLESCSFGPHKEEFSCGEAPTVKLRLRPFVSLRRGKLVIDAVLSHPSLLVVQRKDFTWLGIPFNEGGRERSCSAEEGIDYRTRTRRLAREEAFAQWERERDDAAREAAEVGYFVSERSCGLSQGDDGLKEIETRSLESSESAPFFCMNDGKHDHRLMDKGVNYDTKHSALEKSFGVRFPGTGLRFWSRVISGPRKHKFKRKATGSNIFPSGGAIKKRMFERSASAAHAYFCDQSQWKFGEPSSSSESYGFMSHDMHLVKSETRESEIENLQSTDDVAQPANPNSSTVKNEECVPYVADNQIDDNDNSSGGQRDLISHFLSGSIEMLKSDVGLKVEDIVSEHVDGVDFVQSEGITKTLPITLDSVHFRGATLMLLAYGDKEVR

SEQ ID NO: 106899 - protein, 390 aa, Glycine max
  Coding DNA Sequence Number=SeqID_15214
  Homolog annotation: Hit_ID=A7PLG9; Match level="QueryCoverage=15%, HitCoverage=7%, E-value=7e-09, Identity=50%"; Hit description =Chromosome chr7 scaffold_20, whole genome shotgun sequence
MEVIVSSTMAMEVAAISLTVVVAAKAMAVGVVVHPNQYQNQYPNQYPTNQYSNEYPTQSSNSYPNQPPYQNASPQYNNPPPQAHLTSAQSSSSQNWYPDSGASHHVTNVSQNIQSTTPFEGPDQITIVNGQGLNINFSGVEDVHFLERKLDNIILGGLKMYVNIPKFDRSKLGMPCQAAQGREMGEQQEEEYRGRYLRMKPEVNAGVKGGSYVEAVTRNLSTMAQRGRFTRDDGIYYKSRSTVHLNIPATGQKWLKEAWVGRLKNVALHDRVEEELPWEIAATTSSKLKDRLKDKNPFSTQWRSGIRGCVQGTGEMMDVEDDVENLRQLDVARVLIKTPWSPLINHTVSVHMQGEILNVHIIEESASLADPPYCRRGREASSSEEVFSEE

SEQ ID NO: 106900 - protein, 145 aa, Glycine max
  Coding DNA Sequence Number=SeqID_15215
MEWFYKISHPLMSLPQLGEPPRHQPMVHDDTYIIVDPLVLPVHTTTMPQPPALAAIDANMPQHAMAAYQKMAKSLEHMINMRIVTIGTDAYTLTEHYLGLAILWAQINLGLKNLASAKIYGLCQVSDHVVHGFPNTIWVFKAILQ

SEQ ID NO: 106901 - protein, 827 aa, Glycine max
  Coding DNA Sequence Number=SeqID_15216
  Gene Ontology: Mol. function=nucleic acid binding
  Homolog annotation: Hit_ID=Q2AA09; Match level="QueryCoverage=8%, HitCoverage=25%, E-value=4e-10, Identity=50%"; Hit description =Retrotransposon gag protein
  Pfam annotation: Domain name=Retrotrans_gag; Domain location=121-212; Score=31.1; E_value=4.1e-06; Accession=PF03732.8; Description =Retrotransposon gag protein
METEIVEFHMGHVPYDFAPMYTVLGHLHGKDLEAATIPEEEPQSSEASSSFPIIEHPHLDPIEDYIMAEDPRRVTLEDYSSSNVPQFFTSIAQLEVQAQTITYPPSLIQLAGVPEDAIRLSLFSFSLSGEAKRWLHSFKGNSLKTWDEVVEKFLKKYFPEFKTAEGKAAISSFHQFPDESLTPTSFYFKVIGSALSAGSGAKPESLTKALSANAALSPKCLLEVTTSSRGTWVATLAPKPLHSLISEHISVSTVCLPAPLHPLLLHTLHYTIQYLLGFTMNALSAPAALSRFIATLLNQNDANAKNASALSVNARLCAKAQCLSVEPELSASMKKCFLCLRAKRQLAALSACVNFIRKRKASSTPTQVRFNKSRFTSQEAWERYTDIIVPRKLLLERNVVDEELTDFGDGNIDVAIVKEFYANLYDPEEKSPKQVRVRGHLIKFDEDTLNAFLKTPVIVEEGESLCAYSRFALLRLDPQELAAKLCIQGRVFELNADGQPLKILRKNMTTLAQIWSVLSFFNLIPTSHTSDVTLDRARLIYGIIMKMDMNVGGVQSDSRSLESLSPAINLAYIKKNCWNLNDLTITFRGPRKAKGKRSEAPSTAPSEAPAPSSSTHPPSSSIDIPVIPPAPSQIPLPTPLSASPVDFIFTPQMPQMLHSMLQSIHRRQSIIMQRLQGLGLPSIMSIEEFNAQVAWPGDQPSSSGEGEYHPQKMVQGEFVPNLGEVYQGKFVPNLGEALGMKAKYLRKKGKYGEGMNEKVKVILWMNALLEPKLLNPRKTMNCWQPNPITSLESSSDSFLCVHFCMIGDEMQRLELVLVVYDGISLNT

SEQ ID NO: 106902 - protein, 278 aa, Glycine max
  Coding DNA Sequence Number=SeqID_15217
  Gene Ontology: Mol. function=helicase activity; Biological process =viral genome replication
  Homolog annotation: Hit_ID=Q2A9E0; Match level="QueryCoverage=85%, HitCoverage=17%, E-value=3e-56, Identity=47%"; Hit description =Putative uncharacterized protein
MWYNERISKHKNCVSPRFSLCCGDDKVELPLLQNPPKHLQRLLFDDNTIDSKNYQHNIWAYNMMFAFTSAGIKLDKSINDSIGPPTIRIQGQPCHRIGSLLPMPGKEPKFAQLYIFDTKNEPAGIQPHIVSSLSHMLDEHNVHAKSFRMARDRLADSQVDNIRLKLIATREKDGHVYNLPNVPEVVALIVGDFDPISKRDIIVETQHGELQRIHQLPCSYLGLQYPLLFPYGEDGYRVDILHCSMMPPHCSYFLCIYVSRKFSMGSFLIGKLTGSSNI

SEQ ID NO: 106903 - protein, 47 aa, Glycine max
  Coding DNA Sequence Number=SeqID_15218
MVRTRGHGAGTCGGHGSGGPSDGTPFRRLTFPSSSDLDLDGVTWCDV

SEQ ID NO: 106904 - protein, 140 aa, Glycine max
  Coding DNA Sequence Number=SeqID_15219
MAEPSKKRKGTSSRSQWHSESQETLIPSSIPSGSLFSSEEQRIRYTNLFSSRFIIDPKFIDMDFFSNKSFECIQAFENSNLIHFMSLKLSVYSDLVKAFYSNLEIQEGTLISEVYGIKMVIDQSLFYDLTQLPSEGVPFE

SEQ ID NO: 106905 - protein, 177 aa, Glycine max
  Coding DNA Sequence Number=SeqID_15220
  Subcellular localization annotation: CTP_CleavageSite=41; ConfidenceScore=5.16e-01
MSNKDKSEIWRPGRTALPPHRRKSNTSAISSSSGALPPFPEAPTEKSGQSPGHATAALNCSGPHDVYNIPTSASEQRCVLHYLLLTVLRLLWCLALRLPGCTVLLNEGLVNRRSDELAGGDGHSIELTEREVRVVVAGQDVAKQQCYPNLSEGGHAGAYDSHSSPCGSPGEVLPQYA

SEQ ID NO: 106906 - protein, 165 aa, Glycine max
  Coding DNA Sequence Number=SeqID_15221
MLRSIHQGQIILLQSLQVVAPLGSIPFVEQFLERVAWPGAQPSLHREDEGPTAQVPQHVEDESSEATIPEPFILEEEAGETQARQEAAATLERSLEDTSEPLAPVVDLSSPQHAAEPSTPILKIPEDPTTPVLTLNTSPSATPVLHLTDEEDVQTQDTQDQSHEF

SEQ ID NO: 106907 - protein, 67 aa, Glycine max
  Coding DNA Sequence Number=SeqID_15222
  Subcellular localization annotation: CTP_CleavageSite=39; ConfidenceScore=5.07e-01
MPVSAKTKRPLSSHKKTKPTYIVNFLCNTKTTKLLLRLKAQVEKDEGLSGEGQSPRVEKDEGPSGEG

SEQ ID NO: 106908 - protein, 225 aa, Glycine max
  Coding DNA Sequence Number=SeqID_15223
MTTLTQIWMTLLLSNIQPSDHNSDLPLPKCQLVYAILTRMSIHMAQLIADAIYIFAGMAPTRHPLDPDKSNRALGFPALITGLCQSFGVPVAPSKVIRPPITRAFIEKYCTQRQAQGDAPQAANAPPPHQAGPTGSFDTEQYLRHLVRQQAANHRAHVQTHDCLYQMSLSLQSQGFTSFPCPTPNQFRAEVTWPGDWPKARAGEAPAEAPDEADEGAGPHDWEIP

SEQ ID NO: 106909 - protein, 146 aa, Glycine max
  Coding DNA Sequence Number=SeqID_15224
  Gene Ontology: Mol. function=oxidoreductase activity; Cellular component=integral to membrane; Biological process=potassium ion transport
  Homolog annotation: Hit_ID=Q7CZ22; Match level="QueryCoverage=100%, HitCoverage=42%, E-value=1e-73, Identity=96%"; Hit description =Putative uncharacterized protein
MINRWIEEDGLVDTLEELGIGSIVFSPLAQGMLTTKYLGGVPDGSRASQSKSLNPAFLNERNVENIRALNGIAERRGQTLAQMAIAWVLRGGRITSALIGASRVEQVEDCVKALDKPDFTTEELAEIDRYAKDADINLWAKSAERV

SEQ ID NO: 106910 - protein, 168 aa, Glycine max
  Coding DNA Sequence Number=SeqID_15225
  Homolog annotation: Hit_ID=A0ST23; Match level="QueryCoverage=14%, HitCoverage=51%, E-value=4e-07, Identity=100%"; Hit description =Putative reverse transcriptase
VPPVQLLTGWCVTAKAPPDISAGKCSGRVPFAIQAAQLLGRAIGAGLFAITPAGERGMCCKAIKLGNARVFPVTTLLQPGVVSLLLKGILERDQAYRYRRPRGGARYQLLFPLVRVNFELGVIMVIAVSFGKPVVPAALMNRPTRGERRFAYWALAECILAYYVGTDE

SEQ ID NO: 106911 - protein, 242 aa, Glycine max
  Coding DNA Sequence Number=SeqID_15226
  Homolog annotation: Hit_ID=Q6UUU1; Match level="QueryCoverage=24%, HitCoverage=40%, E-value=3e-18, Identity=78%"; Hit description =Putative uncharacterized protein
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 106912 - protein, 45 aa, Glycine max
  Coding DNA Sequence Number=SeqID_15227
MTCLSKDNPIRRHSYVSQRSLCGRARARLTGALSKGGKMRGVATN

SEQ ID NO: 106913 - protein, 170 aa, Glycine max
  Coding DNA Sequence Number=SeqID_15228
  Gene Ontology: Mol. function=nucleotide binding; Biological process =defense response
  Homolog annotation: Hit_ID=Q6L477; Match level="QueryCoverage=61%, HitCoverage=16%, E-value=3e-10, Identity=28%"; Hit description =Putative uncharacterized protein OSJNBa0009L15.8
  Subcellular localization annotation: CTP_CleavageSite=26; ConfidenceScore=5.59e-01
IIGSPPASLPPSDASASPSTVKWTRKASRLRSLSTRPPGAERPVVHVDPATGKADDPHRKKLRTYLGIVARDKVDVTYENWKEVPTAQKDLIWEDIQAEFDILEASDSRTKRKLLQTVGERWRQFKSDLTRKWALAADQDGVEDTVCEKYGINKEKWAKFCQTRRDPSRE

SEQ ID NO: 106914 - protein, 16 aa, Glycine max
  Coding DNA Sequence Number=SeqID_15229
MELASGIITQDNNIVT

SEQ ID NO: 106915 - protein, 139 aa, Glycine max
  Coding DNA Sequence Number=SeqID_15230
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=72%, E-value=3e-24, Identity=69%"; Hit description=LacZ protein
MNQPTTVNVNPDRWLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106916 - protein, 112 aa, Glycine max
  Coding DNA Sequence Number=SeqID_15231
MVSISCPSCSATDGDWLSASQFGTQAYEPEASALARLPAFVQFRETCRQLHNESANARAIECGPLRVLRQLALKADVLHTGDYYVGTVTPGCSQSDSASVEKKAAPVRQLNM

SEQ ID NO: 106917 - protein, 260 aa, Glycine max
  Coding DNA Sequence Number=SeqID_15232
MTPRINHLSRWRVRGHLVKFDEDTLNTFLKTPVILAYIKKNGWNLDDPIVTFIGPRKARGKRSEVPTTSVAPETLAPSSSTALVPHIQTPVIPPTSTQIPLPALSYAGPLNFIFTPQMLHSMLQSLHRGQSIIMQSLQGLGLPSIMSMDEFDVQVAWPGAQPSPFGGDGASTAQESIPEEPATVAAEGEDELTPPEPFYFDPGEHMAHEEETSTDQIPEPSPVPIPDDAIPSAQAYELEQPIPQDSPTAQVLDLNEHTKE

SEQ ID NO: 106918 - protein, 155 aa, Glycine max
  Coding DNA Sequence Number=SeqID_15233
  Homolog annotation: Hit_ID=UPI00016621D1; Match level="QueryCoverage =83%, HitCoverage=40%, E-value=1e-09, Identity=34%"; Hit description =UPI00016621D1 related cluster
MTGSLDELISCFLIRVDPWILVPIALRGLHAFTFRGLHVLAFRGLHVLSLRGLHALAFRGLHALAFRGLHVLTFRGLHALAFRGLHALTFRGLHVLTFRGLNVLAFRGLRTLTFRGLHVLASRGLHVLVFRGLHVLTFRGPHALAYRGLHVFTSP

SEQ ID NO: 106919 - protein, 121 aa, Glycine max
  Coding DNA Sequence Number=SeqID_15234
MHFMDTRARKIISSYLQHLGIMVHLQSSPQCPMYAFKKKQTSLLHDDESRLIQGDSRCFDQNKDDDKKPMRKIQEKFQVSSFQESRIKNNQELDSRLKIQESRKDSIKISTEKFFKTLSST

SEQ ID NO: 106920 - protein, 98 aa, Glycine max
  Coding DNA Sequence Number=SeqID_15235
MECLESVWETLEGNERCRFRGTIRLTATSLVSSSEEDLEEDPEELPPEPAMDAPDLPEDDEDPLPDIDSPEDIMLASEVDSTEESGPGGTANSDDSSS

SEQ ID NO: 106921 - protein, 56 aa, Glycine max
  Coding DNA Sequence Number=SeqID_15236
MASRKRKATTSLPQEPYDTTRRQISKTGSSQGKLIKFDAALLNAFLETPPVIQPGE

SEQ ID NO: 106922 - protein, 157 aa, Glycine max
  Coding DNA Sequence Number=SeqID_15237
MRWSDSEQRWLVVVTGGQWWWRRRLGPATLAQAKFGSPGRADPAQILMLWLKNHISYSRCYIANPKGQNVQNWVASLQSTIESDPALCFHDCIHKGMKLVGNDQGMIVRLLTRYLHHSCWAPIFKGSHGRHSKQRRCLPLWWYSLVGCGGVIGVRFH

SEQ ID NO: 106923 - protein, 74 aa, Glycine max
  Coding DNA Sequence Number=SeqID_15238
  Subcellular localization annotation: CTP_CleavageSite=47; ConfidenceScore=5.07e-01
MGPKSTLRLMRTLGPSPASLAQSTWSLLSNALAVEAKLHGKSKMMTKEMKKSSKVNQEQFKIRIKKNSRLKEKV

SEQ ID NO: 106924 - protein, 41 aa, Glycine max
  Coding DNA Sequence Number=SeqID_15239
MDTYVSPLSTQITPNVVGDEEPDDVHANRSSYKGRSKVATT

SEQ ID NO: 106925 - protein, 56 aa, Glycine max
  Coding DNA Sequence Number=SeqID_15240
ALKGLDDAPQPKSKVPTRWIVVKMTTIILGSFRNNWEAYFNDPRPLESERLKALRI

SEQ ID NO: 106926 - protein, 78 aa, Glycine max
  Coding DNA Sequence Number=SeqID_15241
  Subcellular localization annotation: CTP_CleavageSite=70; ConfidenceScore=5.64e-01
MESPSLLGALFAYPRSSKAMFHMSSSPSLTGVMQFGMCRNRPIGGRATRGLMGASSMGGKCAESPPTFIRGKRRKNRK

SEQ ID NO: 106927 - protein, 147 aa, Glycine max
  Coding DNA Sequence Number=SeqID_15242
  Homolog annotation: Hit_ID=Q6UUU1; Match level="QueryCoverage=40%, HitCoverage=40%, E-value=1e-18, Identity=78%"; Hit description =Putative uncharacterized protein
  Subcellular localization annotation: CTP_CleavageSite=40; ConfidenceScore=5.27e-01
MAQHWSQRLATAPETVECKAGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106928 - protein, 64 aa, Glycine max
  Coding DNA Sequence Number=SeqID_15243
  Gene Ontology: Mol. function=unfolded protein binding; Cellular component=cytoplasm; Biological process=cellular protein metabolic process
  Homolog annotation: Hit_ID=Q2YIJ3; Match level="QueryCoverage=100%, HitCoverage=11%, E-value=4e-25, Identity=92%"; Hit description=60 kDa chaperonin
MAAKDVKFGRSAREKMLRGVDILADAVKVTLGPKGRNVVIDKSFGAPRITKDGVSVAKESNWED

SEQ ID NO: 106929 - protein, 128 aa, Glycine max
  Coding DNA Sequence Number=SeqID_15244
PSAPSDLSNSEWRLLSLAEIAYSGWSFASLTPLRKVEKGPQLLVVFVVAAALEEEHMAYLDQQHFGREGQAVVVAVIVVEDLPISYLDDYSNLDCICCLKDHNYSVVVGFAAEGVYYKCLQHRLQVAH

SEQ ID NO: 106930 - protein, 38 aa, Glycine max
  Coding DNA Sequence Number=SeqID_15245
MTENWELEGGLMPSLEEFESRRKGPTTLRAIGLRSTPN

SEQ ID NO: 106931 - protein, 283 aa, Glycine max
  Coding DNA Sequence Number=SeqID_15246
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFLCEYGYTQLVTKLPTITTFDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106932 - protein, 247 aa, Glycine max
  Coding DNA Sequence Number=SeqID_15247
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLKNINTNIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106933 - protein, 68 aa, Glycine max
  Coding DNA Sequence Number=SeqID_15248
  Homolog annotation: Hit_ID=A5ATL8; Match level="QueryCoverage=97%, HitCoverage=57%, E-value=4e-19, Identity=70%"; Hit description =Putative uncharacterized protein
TLPGLDMPRILLKERGAFGNADTGGAWLSSARAVRKVRMTSSHHAPYALGDTRATMDGTKDRDPARVS

SEQ ID NO: 106934 - protein, 76 aa, Glycine max
  Coding DNA Sequence Number=SeqID_15249
MASGNRLPRVGNRLQGLKMKERERASSNRLPMLCNRLPGLEMETSNKPLVIDYQLCVIDYTVHIAGFHVLKLCNSS

SEQ ID NO: 106935 - protein, 88 aa, Glycine max
  Coding DNA Sequence Number=SeqID_15250
MASRKRKATTSLPQEPYDTTRFTSEGAWERYSQNIHSRNILLERNVNLFVTEYDEFRRELIRQNWHKALTQHMDRDIDVALVKEFYSN

SEQ ID NO: 106936 - protein, 16 aa, Glycine max
  Coding DNA Sequence Number=SeqID_15251
NWKGGLVPYLEEFESR

SEQ ID NO: 106937 - protein, 237 aa, Glycine max
  Coding DNA Sequence Number=SeqID_15252
  Homolog annotation: Hit_ID=O52175; Match level="QueryCoverage=35%, HitCoverage=95%, E-value=3e-32, Identity=84%"; Hit description =Salmonella berta plasmid pBERT, complete plasmid sequence
MVKVGTSYVPINVSFSPKVGPGLPGINRDTRIYIINSLTDQSVTIKLIRKGARFPFGKPCRCATAYEAKRGRSSAGLLRIAGAKGRSVHTAIKLGAGCSVEVRSCGKKRLTGSAEYVIRTHYGRFLADSTLGGGSGKWPTRAAGIRRCQEDDFNKLNREVRGPRQSRFSIGSAPLTSITKSDAQISGGETRQDYKDTRRFPLAAPSCALLFLPFGLPVSFRCYGRVCLIPRLTLSSG

SEQ ID NO: 106938 - protein, 82 aa, Glycine max
  Coding DNA Sequence Number=SeqID_15253
MGVQIATRPTWALLACLGELGGKLLPHFLINKGRSEEKFRSALLPRHFRNVSVTFPWVISRRFLTVLRRSSFVLHRSSVFNW

SEQ ID NO: 106939 - protein, 245 aa, Glycine max
  Coding DNA Sequence Number=SeqID_15254
MAREYFPNEYMMWNCPSRVGRWHEGFFSNASVCVTKWPRGSSPQRDLGRIKRLKEPVLLPSMTVTALGALNTSSASRPSRDGHFFGSDVQLRDDEYTDFQEEIGRRQWASLVTPMAKFDPDIVLEFYANAWPTEEGVRDMRSWVRGQWISFDADAIGQLLGYPLVLEEGQKCEYGQRRNRSDGFDEEAIAQLLCIPGQDFARTAAGRRVRIMRTNMTTLTQIWMTLLLSNILPTDHNSDLPLPKC

SEQ ID NO: 106940 - protein, 279 aa, Glycine max
  Coding DNA Sequence Number=SeqID_15255
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
WNSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSICFTFNRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106941 - protein, 256 aa, Glycine max
  Coding DNA Sequence Number=SeqID_15256
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLATEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106942 - protein, 230 aa, Glycine max
  Coding DNA Sequence Number=SeqID_15257
  Homolog annotation: Hit_ID=UPI00016621D1; Match level="QueryCoverage =91%, HitCoverage=41%, E-value=1e-17, Identity=32%"; Hit description =UPI00016621D1 related cluster
FQAACPHLQRTTHHRLQRVHALTFRGLHALTFRGLHVLTFRGLHVLAFRGLHVLVFRGLLALTFKGLHTFRGLYVLTIRGLHVLAIRGLVALTFKGLHAFAFRGLHALAFRGLHVLTFRGLHFLTFRGLHVLIFRGLLTLAFRGLHVLAIRGLHALTFRGLHVLVIRGLHVLTFRGLHVLIFRGLHSLAFRGLHVLVFRGLHTLAFRGLRVLTFSGLHIHTLREFKVLCP

SEQ ID NO: 106943 - protein, 112 aa, Glycine max
  Coding DNA Sequence Number=SeqID_15258
MPTGAAARGRSCCAAANADRKFWIGARTGSSILPRLHRSSWKNACTDALAQRTGRAADLWRGDAVATAAGSGRTCVATGAAAATPAAGAGAEPAYVDRRQYRYAAAVAGRQR

SEQ ID NO: 106944 - protein, 173 aa, Glycine max
  Coding DNA Sequence Number=SeqID_15259
  Gene Ontology: Mol. function=phospholipase A1 activity; Cellular component=cell outer membrane; Biological process=lipid catabolic process
  Homolog annotation: Hit_ID=A4WG00; Match level="QueryCoverage=55%, HitCoverage=33%, E-value=3e-49, Identity=91%"; Hit description =Phospholipase A(1) precursor
  Pfam annotation: Domain name=PLA1; Domain location=1-101; Score= -46.9; E_value=1.3e-07; Accession=PF02253.6; Description =Phospholipase A1
MAQNGNMMVEVKPWYVVGSTDDNPDITKYMGYYQLRIGYQLGDAVLSARGQYNWNTGYGGAEVGLSYPMTKHVRIYTQVYSGYGESLIDYNFNQTRALKIAPVSFLAYGVNVAQAEVLNQESLAKQVLHETFGYQQFRPGQETIIETVLEGRDCLVVMPTGGGKSLCYQVPAL

SEQ ID NO: 106945 - protein, 282 aa, Glycine max
  Coding DNA Sequence Number=SeqID_15260
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMGPRVGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 106946 - protein, 96 aa, Glycine max
  Coding DNA Sequence Number=SeqID_15261
MGWSILARLGNPDVPPAVSSQALDRRLQVDWARDPREGPRVLMSLREVSLAIREVCDAILPRKGPIIRTMSKRLQEDWARAAEEGPRVLMNLRVDF

SEQ ID NO: 106947 - protein, 218 aa, Glycine max
  Coding DNA Sequence Number=SeqID_15262
MGVFLLWLVVVSIPKSIQKRNKCKESFLQTTTTSELDKPIMIPKVDCYKGKEKMTGEYEDVPSTPYVKARLDRLFKHEVVVMQQMKELTSIDWQDLQRYYIVGAYCSSLEPKEKSSIDGVHHTIGRYFQTINHNLFVVYGREILLCLSTTSHSLLIFQTLFSPLFIMSSQSLKRLGHEVFDGPPPSQKYMCLIKEALLITREVLAEALHDQAHADREA

SEQ ID NO: 106948 - protein, 97 aa, Glycine max
  Coding DNA Sequence Number=SeqID_15263
MAVFYMKGDDLSWFKVVSRICQLDLMMKYVQFQLSLAHQWAKRASIAKCSFSVTEESGKASISRPCAKREISALSAAVVFSQAQCMTSTKLKSTYSC

SEQ ID NO: 106949 - protein, 222 aa, Glycine max
  Coding DNA Sequence Number=SeqID_15264
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=23%, HitCoverage=50%, E-value=1e-23, Identity=100%"; Hit description=LacZ protein
MTPVTERQEQRAHEEPQGETPGIFIVLSGFATTDLSVRFRDACQGGGAYGKTALPRPSHFPVKYLPGIFQEISAPFPFFSCHMKHFTDTLISANIKPRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106950 - protein, 159 aa, Glycine max
  Coding DNA Sequence Number=SeqID_15265
  Subcellular localization annotation: CTP_CleavageSite=73; ConfidenceScore=5.16e-01
MGAALTRGGVPHFGHFQGLRNCLGKGRSGGGASSLFTPAGERGDGFPSHDVVKRRPVNCNTTHYRANWSSTAVAAALELVDPPGCRNSMFDGIYYSDNRSNSRANTCNKPRLLEGMHLLDKRSTQALPVALMIHDNSSDRTAFVPATHHSNFCPINFRW

SEQ ID NO: 106951 - protein, 106 aa, Glycine max
  Coding DNA Sequence Number=SeqID_15266
MTPVNRKAGTGERTREPPGGNAWGAEPMEKRLCRGALCRFPVNHLPAISNSCARGTTFERAATERWSSVIREEAGIVVVSHIRWHVRLFSPATEALHWEHPHQANI

SEQ ID NO: 106952 - protein, 99 aa, Glycine max
  Coding DNA Sequence Number=SeqID_15267
MPSRGEETIPLHRVLPLVRPQEASRKWGGRNTEKIFGGKSKNLGSFAPFLPRGEACLPVRKPPFMHRERKGELGSTLSKQRRSICQLVPSMEGRKNRHY

SEQ ID NO: 106953 - protein, 67 aa, Glycine max
  Coding DNA Sequence Number=SeqID_15268
  Subcellular localization annotation: CTP_CleavageSite=43; ConfidenceScore=5.11e-01
MDPGIRPIFNSQCVQKVPSGVANCRNIPFGGRATRGSWVRLPREEGARSRHQHLFKENVGKTGTCGL

SEQ ID NO: 106954 - protein, 144 aa, Glycine max
  Coding DNA Sequence Number=SeqID_15269
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=3e-25, Identity=55%"; Hit description =Putative uncharacterized protein
  Subcellular localization annotation: CTP_CleavageSite=38; ConfidenceScore=5.26e-01
MTMITPSSKLTLTKGNKSWISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 106955 - protein, 76 aa, Glycine max
  Coding DNA Sequence Number=SeqID_15270
PTGCPFPPARSRHHDIGIAPARHPMDPKKSNRVLELSSSNYGQAQGKTPQQPGDGRQRATDAPPSPLEFTSAHPQK

SEQ ID NO: 106956 - protein, 77 aa, Glycine max
  Coding DNA Sequence Number=SeqID_15271
MEYSNAGSIHPCIQDSIENIIGVKANGNCGYRAIAALLVWVKNHGFFTRPLSFSTIGVVVEHALSLSDKAVAHPVHR

SEQ ID NO: 106957 - protein, 35 aa, Glycine max
  Coding DNA Sequence Number=SeqID_15272
MPKWEGKRVILKLFLTPGLPRLASGSPGPPNSLRV

SEQ ID NO: 106958 - protein, 85 aa, Glycine max
  Coding DNA Sequence Number=SeqID_15273
MATMMEAMMSMKKITEANAVTVATTSAIAKVNPMPSSGLNQMNHPTSDMTHEIPHHNLADFAPCLGYATGGQAVVVPMPNTLEGP

SEQ ID NO: 106959 - protein, 303 aa, Glycine max
  Coding DNA Sequence Number=SeqID_15274
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIMTTLEGLQLTHTHLSSLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFLSGGSLVRSPVPAFRFTGVIP

SEQ ID NO: 106960 - protein, 256 aa, Glycine max
  Coding DNA Sequence Number=SeqID_15275
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGTYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 106961 - protein, 106 aa, Glycine max
  Coding DNA Sequence Number=SeqID_15276
MGESLTEQCRVKVEGLRVMNFFSRRRSNDVRRQIPGLNPGQAVETTKLEYGRGRGNFRWSGEMRRDRKEHQRRKHSAGADTDTERRKLGERMGLDTPVVLAVNDGY

SEQ ID NO: 106962 - protein, 305 aa, Glycine max
  Coding DNA Sequence Number=SeqID_15277
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMQFICIWLPDISYIVLCGSVLTSLDVATNSQLLLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 106963 - protein, 89 aa, Glycine max
  Coding DNA Sequence Number=SeqID_15278
MAVISPGKIYQPPFPKWYNPNATYAYHGKTPGHSTEKCLALKYKVQHLIDAGWLTFQEDRPNGKQTRSPIMEGEQLMSSSRVGRAGLSL

SEQ ID NO: 106964 - protein, 125 aa, Glycine max
  Coding DNA Sequence Number=SeqID_15279
VLQWLLFLSAVPPVQLLTGVVRNGKSTAGHQRWQAAQLLGRAIGAGLFAITPAGERGMCCKAIKLGNARDPATGEPGTESFPRPPFFSARLFALKNTGFYGRSATPGCRRRPWGDLVVPTGWRRW

SEQ ID NO: 106965 - protein, 92 aa, Glycine max
  Coding DNA Sequence Number=SeqID_15280
MLVRMIPTRLHAAARVKSCLDLQGSCTKASSSGCARIVGPPPGSGGGQGTNKGKLLAPHPGAQVSPSEVEDVSPFEGKGMQPSEGEGMHTTF

SEQ ID NO: 106966 - protein, 163 aa, Glycine max
  Coding DNA Sequence Number=SeqID_15281
  Gene Ontology: Biological process=transposition, DNA-mediated
  Homolog annotation: Hit_ID=Q1J7G7; Match level="QueryCoverage=25%, HitCoverage=71%, E-value=3e-12, Identity=74%"; Hit description =Transposase
LGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPPECILAYYVGTDEGVSEVLSCGRRKKAAPGASAEYVIQDIFPLSFAH

SEQ ID NO: 106967 - protein, 75 aa, Glycine max
  Coding DNA Sequence Number=SeqID_15282
MAQPPILRTYQMNTRLVGSKTMIVILTPLPGPKEITCLHPTKQYSNGIGNLRIIHVLVISALSLPNFTAVGDMVT

SEQ ID NO: 106968 - protein, 369 aa, Glycine max
  Coding DNA Sequence Number=SeqID_15283
IAVERQQATQIAAPGLAQHRQGNTAQAHHPPRQPQAEQQRGVFGDGGGRRRPSHVPAQAHHQPDIQYDIQQVADDQQDHRRPHVLHAEQPAQQHQIGQRRRGAEPADLKKTPRLFQHFAIATDDPQRQFDQRITQQDDRRSGQQRQQQRLHKGARQRLRVLCPQRLRRQAGGAHAQEQQQHEQEAGRHRADRDAPQIDRAVEVADHRGVHQPEQRHGNIGENHRQGQAPQSFIGVAAVANGKVRNKNAPEQGRLIQEAALRVRRLNPVAVADHADRQPFDSEILLTQIDHDRLEFVVLWQQFNHVAVLFQALDRHFVFDARHHDLAIAHVLRFVYRQQIAIQNADVAHRHAVHPQQEIGARFKQGRIHL

SEQ ID NO: 106969 - protein, 136 aa, Glycine max
  Coding DNA Sequence Number=SeqID_15284
  Subcellular localization annotation: CTP_CleavageSite=34; ConfidenceScore=5.07e-01
MWVQAIGLFAQVTCAPEFGLPRPFNQRLLVLHVGGGAVKQRVKFPTANVQSFEFGMTGPLNESISCFLIRADPWVLVPSPSEDCTSSLSKDYASSPSEDYTSSLSEGYTPSPSKGCTPSPLEGYASSFSVCSISTP

SEQ ID NO: 106970 - protein, 70 aa, Glycine max
  Coding DNA Sequence Number=SeqID_15285
MGKAEEVQEKVKADMEAMKEQMATMMEAMMSMNKIMEADAVAVATTRAVAKANPMPPSGLNQMNHPTLAM

SEQ ID NO: 106971 - protein, 338 aa, Glycine max
  Coding DNA Sequence Number=SeqID_15286
  Homolog annotation: Hit_ID=Q84VH5; Match level="QueryCoverage=100%, HitCoverage=57%, E-value=1e-139, Identity=70%"; Hit description =Envelope-like protein
PVPEKLVPKRQQGVKISENPSFATSPREEDTEMDKKIRSFVNSILKNASVPDADKDVPKSSTPNAEVLSSSSEEKSTEEEDQATEETPAPRAPEPAPGDFIDLEEVESDEEPIAKKLAPGIAERLQSRKGKPPITRSGRIKTTAQKKSTPITPTTSRWSKVAIPSKKRKEISSSDSDDDVELDVPDIKRAKKSGKKELGRDALDCKEIMDLIKAAGLLKTVTKLGDCYESLVREFIVNIPSDITNRKSAPPQKVFVRGKCVRFSPAVINKYLGRPTEGVVDIAVSEHQIAKEITAKQVQHWPKKGKLSAGKLSVKYAILHRIGAANWVPTNHTSTVAT

SEQ ID NO: 106972 - protein, 69 aa, Glycine max
  Coding DNA Sequence Number=SeqID_15287
MEAEGQAVTREIFKRVFMEKYFPKDVWNKKEMEFLELNLRLEVKQAMNYQGLCQFPLLVNLCQIWDEDS

SEQ ID NO: 106973 - protein, 601 aa, Glycine max
  Coding DNA Sequence Number=SeqID_15288
  Gene Ontology: Mol. function=hydrolase activity, hydrolyzing O -glycosyl compounds; Cellular component=periplasmic space; Biological process=metabolic process
  Homolog annotation: Hit_ID=P0AGC4; Match level="QueryCoverage=95%, HitCoverage=89%, E-value=0.0, Identity=64%"; Hit description=Soluble lytic murein transglycosylase precursor
  Pfam annotation: Domain name=SLT; Domain location=492-595; Score =105.4; E_value=1.7e-28; Accession=PF01464.11; Description =Transglycosylase SLT domain
MKGVRHKLERSNEESGVEKWRNWMIGICLVSTAGSVWADSLDQQRQRYAQIKQAWDNKQMDQVEQLMPTLQDYPLYPYLQYRLLAQDLDQETGLAVKNFIQQYPTLPPARSLQTRFVNVLAHRQDWPGVLSFSPDEPKPVQARCNWYYAKWATGQQQAAFDGAKAIWLRGTALPNDCDKLFSVWRASGQLSPITILERIRLAMKAGNDSLVNYLAKMLPADYQTTASALIALQQNPQTVTTFASTLGPTDFTRMATSYAFARVARQDMDNARMMIPQLVQAQKMSPAEEQDLKETVVWRMMGADLTSEQARWRDAVVMNSESTALIERRVRLALSENDRRGLNTWIARLPVEAKEKDEWQYWQADLLMAQGRKEEAEEILRKLMQQRGFYPMVAAQRLGVEYPLQVDQAPAADNSVVQGPEMARVRELMYWGLDNLARSEWANLISSKTHTQQQMLARYANEQDWWDLSVQATITAKMWDSLKERFPLAWRNLYQQYTSDKGITPSYAMAISRQESAWNPKARSPVGASGLMQVMPGTASHTVKMYNIPGYVNSSQLLDPQTNIQIGTQYLEYVYQQFGQNRIFSSAAYNAGPGRRCHCCS

SEQ ID NO: 106974 - protein, 121 aa, Glycine max
  Coding DNA Sequence Number=SeqID_15289
  Gene Ontology: Mol. function=aspartic-type endopeptidase activity; Biological process=DNA integration
  Homolog annotation: Hit_ID=A5B4U1; Match level="QueryCoverage=100%, HitCoverage=21%, E-value=1e-36, Identity=56%"; Hit description =Putative uncharacterized protein
DIDYVIRKDEPPTITNESSPVVALYERWEQSNWLSVMFIKTKISTEIHDSVNQHEKVRNLLKVIDDQFITLDKALTNILIMKFSFLQLTSVKGSFMMHFILNTLPPEYGSFKISYNTRKDK

SEQ ID NO: 106975 - protein, 126 aa, Glycine max
  Coding DNA Sequence Number=SeqID_15290
  Subcellular localization annotation: CTP_CleavageSite=41; ConfidenceScore=5.15e-01
LQHSILSVSLYYGTQSDIRVKSYCRLNLLKASTFNSSVSIYCGTQSNIRVKSYCRLNWLRGSTFNFERLDILRNSIRHPSKKLLSFELAESSNIQFRASRYMRDTIRHPNKKILSSELAQRFTIQF

SEQ ID NO: 106976 - protein, 207 aa, Glycine max
  Coding DNA Sequence Number=SeqID_15291
  Subcellular localization annotation: CTP_CleavageSite=61; ConfidenceScore=5.17e-01
LPWKLLRKDLTTLAQTWSVLSYSNLALTSHTSDLNLDRARARRYEAQSPSATPAPPTSAPSTSALPSAPATPILPELAPGPALIMQSLQDATWPGVQPSPLGGGEASVAQEPQPDQEDDILEASKPIPSELFIVETSPTIPQEDAAAVTPQVTPQPQPEPTTLALDLSSPQLEPSAPVPDLPLSQDSPSGTPAQDLNEHATDSAQDH

SEQ ID NO: 106977 - protein, 173 aa, Glycine max
  Coding DNA Sequence Number=SeqID_15292
  Gene Ontology: Mol. function=chitin binding; Cellular component =extracellular region; Biological process=chitin metabolic process
  Homolog annotation: Hit_ID=UPI000069F178; Match level="QueryCoverage =97%, HitCoverage=99%, E-value=2e-20, Identity=35%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
  Subcellular localization annotation: CTP_CleavageSite=59; ConfidenceScore=5.66e-01
MVRTCSPLKDRACSPLKVRTCSPLKVRTCSPIKARACSPLKARPRSPRNVRTCSPLMVRACSPMKVRTCSPLKARACSPLMARTYCPLKARACSPLMARTYSPLKARACSPLKVSTYSPLKARACSPLKVTAHSPQKVRPCSPLLARTCSPLMARTCSPLKARARSPLTAKDV

SEQ ID NO: 106978 - protein, 202 aa, Glycine max
  Coding DNA Sequence Number=SeqID_15293
  Homolog annotation: Hit_ID=A2R1J9; Match level="QueryCoverage=100%, HitCoverage=17%, E-value=2e-60, Identity=51%"; Hit description =Contig An13c0060, complete genome
MSLGWRILTLAVPLLVIAGLETTYQISQKRNGLADITSDGYIRYTWVYIPAFIMLLIQALFECSHFSTQVIQPYLELRRGGLTAQESLMDNYLSKLTMHALWSALIKRKYAIFTTALTMILAPCLTIAASGLYSTEAASYVRAVSILRNDSFNSTVEPQAYHSGQKGIGLTGALVVGTNLSYPDWTYDEVVLPALKEGTLMD

SEQ ID NO: 106979 - protein, 211 aa, Glycine max
  Coding DNA Sequence Number=SeqID_15294
MASSGGYHEWLKVRTRGLDWLSKLKVINEGNFEAPEEDEEVRALKTELGKARLAKEKFKLVATDVQKECAEFREENAATARALEQETKRARKEEHGRDKFRGALWGSNSELKLQREERDQSRAHSMVLKEELAACSRSKRNLSQRLCETETNMLAIVSKYQEELNLATAHEHKVADEYAQVYAKKEARRRVINSLHQEATMWMDRFALTLN

SEQ ID NO: 106980 - protein, 89 aa, Glycine max
  Coding DNA Sequence Number=SeqID_15295
MQEEQCEDCLLYAYPLWKGQCKLGRTLGRHDIVGSRGGKKKGQLGYPMRGVPSEEIIAPFIARLSQMVKVKNARDNLAPKDKESEWGKS

SEQ ID NO: 106981 - protein, 229 aa, Glycine max
  Coding DNA Sequence Number=SeqID_15296
  Gene Ontology: Mol. function=transferase activity; Cellular component= intracellular; Biological process=regulation of transcription, DNA -dependent
  Homolog annotation: Hit_ID=A8AE65; Match level="QueryCoverage=100%, HitCoverage=62%, E-value=1e-118, Identity=91%"; Hit description =Putative uncharacterized protein
  Pfam annotation: Domain name=HTH_11; Domain location=4-53; Score =20.4; E_value=0.0017; Accession=PF08279.3; Description=HTH domain
  Pfam annotation: Domain name=HTH_5; Domain location=2-49; Score=12.7; E_value=0.02; Accession=PF01022.11; Description=Bacterial regulatory protein, arsR family
  Pfam module annotation: Pfam domain module=HTH_11::HTH_5; Domain location=4-53::2-49
MNEREKQILKILRRNPLIQQNEIADILQISRSRVAAHIMDLMRKGMIKGKGYILTEREYCVVVGAINMDIRGTAEIHYPQSASHPGSIHCSAGGVGRNIAHNLALLGRDVHLISAVGSDFYGETLLEQTRQAGVNVSSCIRLHGHNTSTYLSVANQQDETVLAINDTQILQKLTPQLLDNSRDLLRHAGVILADCNLTPEAMEWVFTIADDIPVFIDTVSEFKAEKIKS

SEQ ID NO: 106982 - protein, 159 aa, Glycine max
  Coding DNA Sequence Number=SeqID_15297
  Homolog annotation: Hit_ID=Q6WAY4; Match level="QueryCoverage=93%, HitCoverage=26%, E-value=4e-16, Identity=33%"; Hit description =Putative uncharacterized protein
MGHRAAKCCQDFQLVPTVEEFEEILGCPLGERKPYLFLGFYPSMARVAKAVKISMQELDRVKQNRNEVVGIPRKHLEGKAKALANQGEWVLFIDTFALLIFGVVLFPNLEGLVDLVAIDAFLAYHHSKESPTISILADLYDTFDRRCEKSSACCTPALY

SEQ ID NO: 106983 - protein, 120 aa, Glycine max
  Coding DNA Sequence Number=SeqID_15298
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPGVTIFPLLSQVKPPSSFTAGVPSSNS

SEQ ID NO: 106984 - protein, 119 aa, Glycine max
  Coding DNA Sequence Number=SeqID_15299
MEWFYIISHLFMTPAQPRDPPRVPLIQQYDIFVEPDVSQQSVAAAAPDEAEVDVHSPRHAVDGYVAIADKLERLLNMRILTEGTKVYIVVEKCLSIARSYIGQPIVGHSSRRRRHMDDH

SEQ ID NO: 106985 - protein, 250 aa, Glycine max
  Coding DNA Sequence Number=SeqID_15300
  Homolog annotation: Hit_ID=A7V2T2; Match level="QueryCoverage=65%, HitCoverage=65%, E-value=7e-15, Identity=37%"; Hit description =Putative uncharacterized protein
MQDAGRPLADAGRVLGGLGAASARLDPEQPHAGIVQERMEKADGVGAPADAGHHRVRQPPRLLDDLRPRFLADHLLQFAHKPGIGMGAGAGPQQVVGVVRMGDPVADGGIHRVLQGGAAVPHRTHLGAQHLHARHVGGLARHVDGAHVDHAFQAVQRAHRGRGDPVLPRAGLGDDAALAHAPRQQRLTQAIVDLVGARVVQVFAFEEQAGAAQLVADRRGIQQRARAAHVVRQHGAVLGPEPGFRPDGAI

SEQ ID NO: 106986 - protein, 285 aa, Glycine max
  Coding DNA Sequence Number=SeqID_15301
MNFVDYLGACNGMEEVLHKRVKSTLSFKEATTFLLHESDKFLELSFKGGGGDGTKFKSNGRNREPRCEELKHKVFIEKGILEKKEVSHVSSGSVGSGGKVQEITNTLHPSKASFENIKCFDDFEAVKLSMIMKCKEVAVGEKQKRRRKNKKTICQKQNKIKYVLSIHYVQVLKFLLRIANELIALVHSFAFGLSARRKLSAKLDNDHHLAVKSDGNFMVDDETKVEAIDNYKHEGIWRPGWEFTWYIKFYDVMVVPMAIALSGQPLLGQPVMVMMEACLRSFYGG

SEQ ID NO: 106987 - protein, 78 aa, Glycine max
  Coding DNA Sequence Number=SeqID_15302
MGAKYLEVVKRGSHPNKGWSPDKIRTQNDHNLSLRFVGHDRAWATRHRMTIICLCVPPDTIASGWRKSDAILLRKGIG

SEQ ID NO: 106988 - protein, 64 aa, Glycine max
  Coding DNA Sequence Number=SeqID_15303
LYEEVTETHELRKNTSFRFPPHYGILRIAQARFLLISNTPRDFIYCATKDTEYLKAANQRLHVI

SEQ ID NO: 106989 - protein, 40 aa, Glycine max
  Coding DNA Sequence Number=SeqID_15304
MACEKRISCGADRQVMMKGSSLWVMARRLQWKLLELLDYS

SEQ ID NO: 106990 - protein, 192 aa, Glycine max
  Coding DNA Sequence Number=SeqID_15305
MVEREMITMMVDTLPVFYYEKLVGYMPSSFADLVFAGERIEVGLKRGKFDYVSSTNVNAKRIGATGAKRKEGDAHAVSSTPAWVKPQQTPHGTHQYAQHHPSFSAHAGNASSSTPVQPKAPTQREAPQVPTPNTTRRGPVIPTRQGNFPPRAIAGIHPAPNDVRRSSTIPHRQSFGRGNSRKGPRTPFPEVV

SEQ ID NO: 106991 - protein, 41 aa, Glycine max
  Coding DNA Sequence Number=SeqID_15306
MARTRGRDRAAGEDAGDVPERRRPTASARRLRVHQMDYGGT

SEQ ID NO: 106992 - protein, 74 aa, Glycine max
  Coding DNA Sequence Number=SeqID_15307
  Gene Ontology: Mol. function=DNA binding; Cellular component=nucleus
  Homolog annotation: Hit_ID=Q0PJF1; Match level="QueryCoverage=50%, HitCoverage=17%, E-value=1e-13, Identity=100%"; Hit description=MYB transcription factor MYB96
MTMITNSSSVPIRSKLIELEAKIEENKKIRNKIKILKDFQASCTRRTGNALSMKKDPRVQLISSKKPFAPKNSK

SEQ ID NO: 106993 - protein, 134 aa, Glycine max
  Coding DNA Sequence Number=SeqID_15308
  Homolog annotation: Hit_ID=A0ST23; Match level="QueryCoverage=33%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLACELRTEKGTELEFVIMVIAVSFGKPVVPAALMNRPTRGERRFAYWALFRFLAH

SEQ ID NO: 106994 - protein, 116 aa, Glycine max
  Coding DNA Sequence Number=SeqID_15309
MAPRKLASKRSKKDKAAEGTSSASEYDSHRFRSAEHQQRFEAIKGWSFLRERRVQLRDDEYTDFQEEIVRRRWASLVTPMAKFDPDIVLEFYANACPYGGRRARYEVLGKGSVGIL

SEQ ID NO: 106995 - protein, 27 aa, Glycine max
  Coding DNA Sequence Number=SeqID_15310
MVEAMMSMEKIMEAKAVVVVATSAVAK

SEQ ID NO: 106996 - protein, 146 aa, Glycine max
  Coding DNA Sequence Number=SeqID_15311
MVASFGYRKERDDSWVKKGAQPNDDEGHLLAEEDSSLLQSILDRFDGLQTYVGERFVTIKKGEIVEASFMMMKQEILKMPKAQVIDSRLQDQASRIQSKIQDSREEIKKQQVKTSYRISIKRNFQKPNSTVLFYKRIFSNFLKLPE

SEQ ID NO: 106997 - protein, 149 aa, Glycine max
  Coding DNA Sequence Number=SeqID_15312
  Gene Ontology: Mol. function=unfolded protein binding; Cellular component=chloroplast; Biological process=cellular protein metabolic process
  Homolog annotation: Hit_ID=P08926; Match level="QueryCoverage=38%, HitCoverage=9%, E-value=5e-22, Identity=89%"; Hit description =RuBisCO large subunit-binding protein subunit alpha, chloroplast precursor
GGGAYGKTPATRPLYGSWPFAGLLLTCSFLRYPLILWITVLPPLSELIPLAAAERPSAASHWHDRFPDWKAGSERNAINALIAPAALIAQNAGIEGEVVVEKIKSGEWEVGYNAMADRYENLVEAGVIDPAKVTRCALQNAASVAGGIL

SEQ ID NO: 106998 - protein, 160 aa, Glycine max
  Coding DNA Sequence Number=SeqID_15313
  Homolog annotation: Hit_ID=B0HC01; Match level="QueryCoverage=20%, HitCoverage=70%, E-value=4e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTFINERFTTLGNVTVVEFRIHTTRYSWYPPPLTTLDWSTSSASMLDRSEGIL

SEQ ID NO: 106999 - protein, 168 aa, Glycine max
  Coding DNA Sequence Number=SeqID_15314
MIQSFEQQQEMSVIELCVEVDVTGAFAINLTNSLLSCENNMSHNESGSATVGTNSEEDFDDDDYLISNSYVEDSLDEDEDIDEMFDTDDEAACGSQTPFWDSASHYSNINWSHPDQEEICGLDMGSNFNMGQELYVGMEFDTKSAVKNALQQYVMKVPQSFKVVESKS

SEQ ID NO: 107000 - protein, 95 aa, Glycine max
  Coding DNA Sequence Number=SeqID_15315
  Subcellular localization annotation: CTP_CleavageSite=50; ConfidenceScore=5.20e-01
IFQKKIDLLQHQGVAAQNRTRLYNHGGCTSAVPSPGLKSYFGTSFVVKVECTSTWVVILRTREGASLVDQFKWRGYWKSEEPVVAWGLDVGTGCC

SEQ ID NO: 107001 - protein, 191 aa, Glycine max
  Coding DNA Sequence Number=SeqID_15316
MAKSSYTRENVATARALERETKRARKEEHGRDKFQGALWGNNNELKLRREERDQSQVHGMVLKEELAACSRSKRSLAQHLEATERSMLAIIGQYKEDLNQSLTHEQKLVEDFAQAYAEKEARGRVIDELHQEATMWMDRFALTLNGSQDLPRLLAKAKAIAEACSAPEEIHRLINYCQHMIDLMAHIIRNR

SEQ ID NO: 107002 - protein, 55 aa, Glycine max
  Coding DNA Sequence Number=SeqID_15317
GQSHLRQWSDVGAKLKAENNQGTLGRTQVEARVTTDRSSSLAQLWTNGKRRCKAT

SEQ ID NO: 107003 - protein, 137 aa, Glycine max
  Coding DNA Sequence Number=SeqID_15318
MGIATTETPSGPEEVKQGPGVSSSGYGPLSTLQGARSPQQGLCPQDTYSRECLSPAARSSGPPTNRAFIKKYCAPRQAQGETPQQPGDGRQRATDAPPSPLEFTSAHPQKGLSIAYTTWPTNRRPSPKPKVSKVLGQ

SEQ ID NO: 107004 - protein, 134 aa, Glycine max
  Coding DNA Sequence Number=SeqID_15319
MEFGDINVHFNILDAMKHPSEDLSVFCVEIIDHIIDEYMTDLHSNLHACLSSCVESEFVLDHMSEFDAESESEFDIDYMSADVLPLEIDFIESDRTNHVSGSTHTSDFLYEVQAEKPSLSTTIQPSTPELKPLP

SEQ ID NO: 107005 - protein, 125 aa, Glycine max
  Coding DNA Sequence Number=SeqID_15320
MGEVRLCRPCQHKQQKIRADWGKEERRGCSRRNLGSCLANTPINPSQYSLVCLAPSELFGPGRKILQLDTCPAKDICPTIKSPRSSPDSCKASSCRQFQSWHKFQFGEEPSSEEASGVHPDSDVI

SEQ ID NO: 107006 - protein, 142 aa, Glycine max
  Coding DNA Sequence Number=SeqID_15321
MESESSVGSSYGVLDDGASLSYFHEGSGYDNLVVVFCMHRSPTGNLVPLDFEIEATLRRNRAERRRKLLQDRAIAYILEEEAQSSDSTSSDSLSSRESAIYLPEASVMADEDQQRVTLRIILVAQCRNSLQVLRILKSKLTT

SEQ ID NO: 107007 - protein, 156 aa, Glycine max
  Coding DNA Sequence Number=SeqID_15322
MWAFLIVHQIDWAHLVRYRMHKALRANAPLPYPQLVTLFLHHFQIPLDDEPFVQVKRSFAIGAGAVTSFRYRKDWNGQWLKKDELPPQDERTPSPPPQRDDSALMTEVLSELQCLRTYVGECFDSLDTRFAGMDIRLTQLEEDVGYIRQSFDLPPS

SEQ ID NO: 107008 - protein, 229 aa, Glycine max
  Coding DNA Sequence Number=SeqID_15323
  Gene Ontology: Mol. function=protein kinase C binding; Cellular component=cell projection
  Homolog annotation: Hit_ID=UPI0000F2ADE5; Match level="QueryCoverage =44%, HitCoverage=14%, E-value=1e-09, Identity=37%"; Hit description =PREDICTED: similar to PDZ-LIM protein cypher3s isoform 1
MLSPSEGYTPSPSEDYWSSPSEGYTSSPLEDYTSFPSEGYTPSPSEDYTSSPSKGYTSSSLEDYTSSPSEGYTPSPSEDYTSSPSEGCTFSPWVLVPSPSEGYTTLAFRRLHVLAFRGLDVLTLGTSTLTLRGLHALAFRGLHVLAFRGLHALAFKELHALAFRGLHILTFRGLQALVFRGLHSSPSENYTPSPSEDYTSSPSKGCTSSLSEGSTSAPLENSRSSALNA

SEQ ID NO: 107009 - protein, 93 aa, Glycine max
  Coding DNA Sequence Number=SeqID_15324
MVIRTFVNQSQASPLIETTLVSPSSSKDSKSPMTHGDNIWSSAPFLSKDYRSPVYHPETGKSDDIRDEDGRPLLIILKIFADLLLSSRDRQVR

SEQ ID NO: 107010 - protein, 228 aa, Glycine max
  Coding DNA Sequence Number=SeqID_15325
  Gene Ontology: Cellular component=integral to membrane
  Homolog annotation: Hit_ID=Q1H2N3; Match level="QueryCoverage=100%, HitCoverage=51%, E-value=3e-46, Identity=43%"; Hit description =Uncharacterized lipoprotein
MTHRTVAGAPDDGKNYVQTQLGVIDTGYRKDAAENKNNAGQEFDADLDAELLRRMMVKLGLDEQKADQVMTQAASDKRADVVKESDQSVTLKLNEPFDRAWRRVGLALDRIGFVTEDKNRSEGIFYVRYADTDAEDPIKQKKGLLERLKFWGSDDDDKSTTPKDVKPGDKTKFWKGTSDGDKSSKQYHIQVLENADDTTDVYVLTPDNKRNTSTTANRIISLLYDQLK

SEQ ID NO: 107011 - protein, 113 aa, Glycine max
  Coding DNA Sequence Number=SeqID_15326
  Gene Ontology: Mol. function=transcription regulator activity; Biological process=regulation of transcription, DNA-dependent
  Homolog annotation: Hit_ID=A8AH30; Match level="QueryCoverage=62%, HitCoverage=35%, E-value=2e-24, Identity=74%"; Hit description =Putative uncharacterized protein
  Pfam annotation: Domain name=TetR_N; Domain location=56-102; Score =39.1; E_value=1.5e-08; Accession=PF00440.14; Description=Bacterial regulatory proteins, tetR f
MSPGYAAAYHIDQACLRQQAAETAVSQDNLFHTTDWSNTLPAMNKTVQRNETREHLLATGEQVCLQRGFTGMGLSEMLALAEVPKGSFYHYFRSKEAFGVALLERYFVNYQQQ

SEQ ID NO: 107012 - protein, 143 aa, Glycine max
  Coding DNA Sequence Number=SeqID_15327
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=32%, HitCoverage=23%, E-value=7e-17, Identity=86%"; Hit description =Chromosome chr4 scaffold_32, whole genome shotgun sequence
  Pfam annotation: Domain name=APC10; Domain location=2-98; Score= -51.6; E_value=9.7e-05; Accession=PF03256.7; Description=Anaphase -promoting complex, subunit 10 (APC10)
MWGFILLWLWIVLYLVFKLDESYTPSKVSIHAGDGFHNLKEIKTMELVKPTGWVYVSLYGADPSCYPPNLPLSIRIPRTSQGEVLREVVPRPTMHNSVFLDQRVKLPPHWHNVFASEKEMRGRFNLALAEGAKIIFNYNLPSN

SEQ ID NO: 107013 - protein, 103 aa, Glycine max
  Coding DNA Sequence Number=SeqID_15328
MVIPQREEEIGHMHWASLVTSMAKFDPEIVMEFYANAWPTEEGARDMRSWVRGQWILFNIDSLSQFLGHPLILEEGQHCEFSKRRSQVSGFDEEAIAQLLCIS

SEQ ID NO: 107014 - protein, 46 aa, Glycine max
  Coding DNA Sequence Number=SeqID_15329
MEKIHLFFRRFGKTFNEMESRMTKVEEDVSYIRSSFDLPPPPPPSS

SEQ ID NO: 107015 - protein, 214 aa, Glycine max
  Coding DNA Sequence Number=SeqID_15330
  Gene Ontology: Mol. function=aspartic-type endopeptidase activity; Biological process=DNA integration
  Homolog annotation: Hit_ID=A5AEB7; Match level="QueryCoverage=89%, HitCoverage=21%, E-value=4e-48, Identity=47%"; Hit description =Putative uncharacterized protein
SASGHGPFQCFMVLALSCVLINYYGRYTKNGQASGLFVKFLQEHVIVAQCTMPSSLDQNGVAKRRTQTLMDKMRSVGNRVIIYNPQEKKLDPRIISGYFIGYAKNSKGGSGQFQDIASEKDHYEAQLSCSSDKLIIIHTPQVQMGVRQSVIEIPQTVENDPVDQAVDEEQQVPQEDHEATLRRSTRVKRFAIPNDYVVYLQESDYNIGVANDPK

SEQ ID NO: 107016 - protein, 76 aa, Glycine max
  Coding DNA Sequence Number=SeqID_15331
  Subcellular localization annotation: CTP_CleavageSite=24; ConfidenceScore=5.01e-01
SPKRSLAIDVNSNSRTRSRYNEIGSMAGGRMNRMSDEKLSSALSPTSEAGKRTRLGVASSKAGPSIPTDLLLSVPC

SEQ ID NO: 107017 - protein, 309 aa, Glycine max
  Coding DNA Sequence Number=SeqID_15332
  Gene Ontology: Mol. function=L-lactate dehydrogenase (cytochrome) activity; Cellular component=integral to membrane; Biological process=electron transport
  Homolog annotation: Hit_ID=A9CI08; Match level="QueryCoverage=54%, HitCoverage=43%, E-value=3e-87, Identity=98%"; Hit description=L -lactate dehydrogenase
  Pfam annotation: Domain name=DUF81; Domain location=1-152; Score= -54.0; E_value=0.0069; Accession=PF01925.10; Description=Domain of unknown function DUF81
  Pfam annotation: Domain name=FMN_dh; Domain location=161-309; Score =7.2; E_value=1.8e-14; Accession=PF01070.9; Description=FMN-dependent dehydrogenase
  Pfam module annotation: Pfam domain module=DUF81::FMN_dh; Domain location=1-152::161-309
MTAGTGVWTTSALGLCLAVYAAYSLLARPISIPARLEPKLSPIMGLVTGLLTGGTGIFVVPAVPYIQSLGFSRDDLVQALGLSFTISTLALAAGLASQNAFHVEHLSLSALAVLPALLGMWLGQKIRHIVSPATFRRCHHSNVKALSMGKILTIADLKNQAQRRVPKMFFDYADSGAWTESTYRANEDDFAKIKLRQRVLVDMTDRSLATEMVGEKVSMPVALSPTGLTGMQHADGEMLAAKAAEEFGVPFTLSTMSICSIEDVASVTSKPFWFQLYVMKDRDFVNNLIDRAKAAGCSALVLTLDLQIL

SEQ ID NO: 107018 - protein, 42 aa, Glycine max
  Coding DNA Sequence Number=SeqID_15333
MHLENTGGQACLQQTNQNQFFDLQSPTPASFSPYQLCSSQLT

SEQ ID NO: 107019 - protein, 107 aa, Glycine max
  Coding DNA Sequence Number=SeqID_15334
  Homolog annotation: Hit_ID=UPI0000ECBAF8; Match level="QueryCoverage =38%, HitCoverage=48%, E-value=1e-16, Identity=100%"; Hit description= UPI0000ECBAF8 related cluster
MLGTGLNFGRARGDCEDRFYSPAKARRALHTMENDKLRRVHSDVTASRSVGDKSGMQAWHWPSFYNVVTGKTLALPNLIALQHIPLSPAGVIAKRPAPIALPNSCAA

SEQ ID NO: 107020 - protein, 119 aa, Glycine max
  Coding DNA Sequence Number=SeqID_15335
  Homolog annotation: Hit_ID=Q2HW87; Match level="QueryCoverage=78%, HitCoverage=8%, E-value=2e-07, Identity=32%"; Hit description=RNA -directed DNA polymerase (Reverse transcriptase); Zinc finger, CCHC -type; Peptidase ...
  Homolog annotation: Hit description=aspartic, active site; Retrotransposon gag protein
  Pfam annotation: Domain name=zf-CCHC; Domain location=18-35; Score =14.1; E_value=0.011; Accession=PF00098.14; Description=Zinc knuckle
  Pfam annotation: Domain name=zf-CCHC; Domain location=38-55; Score =18.2; E_value=0.0027; Accession=PF00098.14; Description=Zinc knuckle
  Pfam module annotation: Pfam domain module=zf-CCHC::zf-CCHC; Domain location=18-35::38-55
MGFASGSGSKPTTFPTQIICFRCGKPSHISSNYTNKDRICFNYRKNGHIQRNCPYPKKEQNGGVLNDQTEHSKATGRVFTLNGVEASKSKDLIQGMDSLSSNHVLLNCFDKTLVFDDSR

SEQ ID NO: 107021 - protein, 61 aa, Glycine max
  Coding DNA Sequence Number=SeqID_15336
MEDWGNFLHRILEEDPEDFAPIKVFLLRDSLCTRARLAGQNSLSAIPFWVGIAFSTPFSLT

SEQ ID NO: 107022 - protein, 173 aa, Glycine max
  Coding DNA Sequence Number=SeqID_15337
  Homolog annotation: Hit_ID=A0ST23; Match level="QueryCoverage=18%, HitCoverage=65%, E-value=2e-11, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLIPFDINLRENSSQEKGNDKGISKEEEFGLGKLNMDGPITRARSKRFHEELVGKPVVPAALMNRPTRGERRFAYWALFRFLAH

SEQ ID NO: 107023 - protein, 122 aa, Glycine max
  Coding DNA Sequence Number=SeqID_15338
MGHNRTSELKVIVVRFCYKLSFSISSVSIYFGTQSDIRVKSYCRLNLLRASVFNYERLAIYYRTQSDIRVKELSFSIYERLDIFGAQSDIRVKSYCRLNLLRASVSQLRASRYITGLNRTSE

SEQ ID NO: 107024 - protein, 56 aa, Glycine max
  Coding DNA Sequence Number=SeqID_15339
  Subcellular localization annotation: CTP_CleavageSite=17; ConfidenceScore=5.38e-01
MSSRAQHVISSFNEKIVSSALSTSSPSHLLPRTQSSRSSQDPNTNNKPGVSYHIPN

SEQ ID NO: 107025 - protein, 257 aa, Glycine max
  Coding DNA Sequence Number=SeqID_15340
MLFARFSPTIRAALGALALIAGLFAPQAHADKLYGGIATDGKHAKIYWALPEDSEKAAEAAALAACRKGGGKDCKSLSWFSDSCMTYARNTSNDLFPGNSVSPEMAAKKAIRRCTAGSPNGKCWLTTMPLCVGPGYSAQDMEAARRATPAELEALSAKLNDREYWGAVAEKDSGDLTYSDGYPNEKDAINQLLEWDECTGCTKVLTYRDTCVGMAWAKGVKGRGTSYTALDPDPKTARDAARNTCSAKSGLPNCVAM

SEQ ID NO: 107026 - protein, 92 aa, Glycine max
  Coding DNA Sequence Number=SeqID_15341
  Subcellular localization annotation: CTP_CleavageSite=48; ConfidenceScore=5.80e-01
MGSPPASTPPPPPPPPPSPPSDASASLSAVKRTRKASRLRSLSTRPPSAERPVVHVDPTTGKADGPHKKKLRTYLGIVARDKVDVTYENWKE

SEQ ID NO: 107027 - protein, 138 aa, Glycine max
  Coding DNA Sequence Number=SeqID_15342
  Homolog annotation: Hit_ID=A6FJQ2; Match level="QueryCoverage=27%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVDSRGSPHPRLLPVEGGDSSEGNADRPQDRALHADRALCALDHGGSFGVPSSNS

SEQ ID NO: 107028 - protein, 98 aa, Glycine max
  Coding DNA Sequence Number=SeqID_15343
MGDQEETQEQMKADMSALKEKMASMMEAMLWTRQLMENNVATAAVVSSATDADPTLPVTAHHPLPNTVGRERSTLGHIRSRTWRIFAWYQTSSPPQNS

SEQ ID NO: 107029 - protein, 57 aa, Glycine max
  Coding DNA Sequence Number=SeqID_15344
MLSLLSASVRKWLLGKERHRPQHPRPAMTALDSHLRRPGIATLILLLERRSCLREMS

SEQ ID NO: 107030 - protein, 133 aa, Glycine max
  Coding DNA Sequence Number=SeqID_15345
MTNFMDGSIDVAIVKDFYANLYDLEDNSPKLLRVRGQLIKFDADALNTFLKTPVIIEEGEELPSYSRFCRLRPDPHELAARLCIPGRGFELNVDGLPLKILRKNLTTCSLPASAPDHVCKLTIRRENHVRNDA

SEQ ID NO: 107031 - protein, 84 aa, Glycine max
  Coding DNA Sequence Number=SeqID_15346
MKIIYFSTLSSGNRLHFLHYRRLDLFDIIKIFMIYTKAMRLAVWPFAQQTSIAHPSSRFFLTLSRGMLRSMDSSLSQQIGLVRG

SEQ ID NO: 107032 - protein, 42 aa, Glycine max
  Coding DNA Sequence Number=SeqID_15347
EIMMQSYPARELDRRLQEDWDRDAREGLRVLMSLRVDFGPRG

SEQ ID NO: 107033 - protein, 71 aa, Glycine max
  Coding DNA Sequence Number=SeqID_15348
MIMMGQDIYSIQFAKQAKLAQASFLLSAEGTHSLKLMAAEWRRKKDDWRHHFKEKMSQEQAHHHRKPWIRA

SEQ ID NO: 107034 - protein, 110 aa, Glycine max
  Coding DNA Sequence Number=SeqID_15349
MFQDSIKFQESRFKNNQDQDSRLKIQESREDSIKIRYILCGTSRGYIYLGCYTENKRGYISCGSVQVEGTSTWLFKENKGGNIPYGSLAFKGFYKVERNLKNHWLLGDWM

SEQ ID NO: 107035 - protein, 88 aa, Glycine max
  Coding DNA Sequence Number=SeqID_15350
  Gene Ontology: Mol. function=cysteine-type peptidase activity; Biological process=proteolysis
  Homolog annotation: Hit_ID=Q6UU79; Match level="QueryCoverage=97%, HitCoverage=10%, E-value=3e-08, Identity=36%"; Hit description =Putative transposon protein
MCKCPTCGVSRYKVKDDESCDDATTKNNRPAKMACFDDHLQPPSLVVHQAKVMMIAVPRQPGNDIDMYLTSLIEDLRKLWEVWDENLQ

SEQ ID NO: 107036 - protein, 87 aa, Glycine max
  Coding DNA Sequence Number=SeqID_15351
MSFRTYEKAWTVLERKINDQSEQRAISRANLGVEESNFDSELIWARLDERKCEFRNLHFVQIFAVKLCNRILHKCRKMLCFRWLWKE

SEQ ID NO: 107037 - protein, 66 aa, Glycine max
  Coding DNA Sequence Number=SeqID_15352
  Subcellular localization annotation: CTP_CleavageSite=34; ConfidenceScore=5.06e-01
MDDALFLAWSWLKASEKGGTLGVLYVMSTVPLIMGSTPASTPPPPPPSDASASPSIVKRTRKASCL

SEQ ID NO: 107038 - protein, 164 aa, Glycine max
  Coding DNA Sequence Number=SeqID_15353
MSKSCGFGMTGPLDESISCFLIRMDPWVLVTLTFRGPHVLALRGLHVLTIRGVHAFTSRGLHVLTFRGVHALTFRGPHVLTFRGLHALAIRGLHILTFVGLHALTFRGLHVLRQQRAARPHLERTTRPRLERTTRPRLERTTRPHHQRGARLHLQRTTRPRLGY

SEQ ID NO: 107039 - protein, 306 aa, Glycine max
  Coding DNA Sequence Number=SeqID_15354
  Gene Ontology: Mol. function=motor activity; Cellular component=cell projection
  Homolog annotation: Hit_ID=UPI00016621D1; Match level="QueryCoverage =96%, HitCoverage=42%, E-value=5e-20, Identity=32%"; Hit description =UPI00016621D1 related cluster
RGLHALTFKGLHVLAFRGLHVLAFRRRHALTIRDLQVLAFRGLHILTFEGLHALAFRGPHVLAIRGLHALTSRGLHVLVIRGLHTLTFKGLHVLTIRELHALTFRGLHALTYRGLHILATRGLHALSFRGLDIIAFRGPHILAIRGQHALTFRGQHVLTFRELHALTFRRLHVLTFRELHVLTIRGLHVLTIRGLHALTFTGLHILTMKGLHVLTFRGIHVLAIRGLHAYTFRGLHVLAIRGLHAVTFRGLHVLAIRGLHALTFKGLHFLPIKGLQALTFRGLHVLAIRRLHALTFRRQHFLAIRG

SEQ ID NO: 107040 - protein, 38 aa, Glycine max
  Coding DNA Sequence Number=SeqID_15355
MGEGNLIRNYHGLPKRICPASMGTISQLNSSLYVPMKK

SEQ ID NO: 107041 - protein, 102 aa, Glycine max
  Coding DNA Sequence Number=SeqID_15356
MKKRDTNHQSVSLENKTGDSTVLKIGDSAKVVIKQDMKGRKHKYGFNNNKREKPEKKITLDDVNQFAFIMIITISMNIVSFFFSDNVRSDLCGQRTNIGVHV

SEQ ID NO: 107042 - protein, 85 aa, Glycine max
  Coding DNA Sequence Number=SeqID_15357
  Subcellular localization annotation: CTP_CleavageSite=50; ConfidenceScore=5.64e-01
MASSPSSPPPPPPSDASALSSAVKWTRKATRLRSLSTRPPGAERPVVHVDPATGKADGPYRKKLRTYLGVMARDKVDVTYKNWKE

SEQ ID NO: 107043 - protein, 55 aa, Glycine max
  Coding DNA Sequence Number=SeqID_15358
MYVDEKEQESGITIRNLTDVILPRKGPVTRAMSKRLQEDWARVAEEGPRVLLNLR

SEQ ID NO: 107044 - protein, 45 aa, Glycine max
  Coding DNA Sequence Number=SeqID_15359
MTTDSPPLLMLPWTQQPTLPWEGGAGLTGVSSKGGRRAESPQMFI

SEQ ID NO: 107045 - protein, 124 aa, Glycine max
  Coding DNA Sequence Number=SeqID_15360
MAFQVRCVYLVVALDVIGVVDEVVFRYVSSKNTRVVLKLKYLSGQVLSCTLWENYCLQFLSYLNDVQDERPIVILLTHASIKEAQGSYSSSVSNSFKASKLMINDLVLEIQEFRESLLDLGIEG

SEQ ID NO: 107046 - protein, 128 aa, Glycine max
  Coding DNA Sequence Number=SeqID_15361
  Homolog annotation: Hit_ID=Q6WAY6; Match level="QueryCoverage=95%, HitCoverage=23%, E-value=8e-15, Identity=35%"; Hit description =Putative uncharacterized protein
ELVDLAAINVFLAYYHSKESPIVAVLADAYDTFDQRCEKSSARIVCCTPALYVWLVSHIFRHERASVNWFPRWKEEGVGVLCSCEGFPNVPLMETRGCINYNPMLAIRQLGYPVRGAPSEEIIAPFIA

SEQ ID NO: 107047 - protein, 268 aa, Glycine max
  Coding DNA Sequence Number=SeqID_15362
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLVITWLMKHNVAIAGVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107048 - protein, 153 aa, Glycine max
  Coding DNA Sequence Number=SeqID_15363
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=71%, E-value=1e-24, Identity=69%"; Hit description=LacZ protein
  Subcellular localization annotation: CTP_CleavageSite=47; ConfidenceScore=5.50e-01
MTMITPSSKLTLTKGNKSWYRAPPRGRRTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107049 - protein, 157 aa, Glycine max
  Coding DNA Sequence Number=SeqID_15364
  Gene Ontology: Mol. function=2 iron, 2 sulfur cluster binding; Cellular component=cytoplasm; Biological process=electron transport
  Homolog annotation: Hit_ID=A0JKZ3; Match level="QueryCoverage=89%, HitCoverage=81%, E-value=3e-73, Identity=95%"; Hit description=CoxS
  Pfam annotation: Domain name=Fer2; Domain location=3-64; Score=18.2; E_value=0.0062; Accession=PF00111.18; Description=2Fe-2S iron-sulfur cluster binding domain
  Pfam annotation: Domain name=Fer2_2; Domain location=72-146; Score =99.0; E_value=1.5e-26; Accession=PF01799.11; Description=[2Fe-2S] binding domain
  Pfam module annotation: Pfam domain module=Fer2::Fer2_2; Domain location=3-64::72-146
MEINVNGRVVPLGDISPETPLLYVLRNDLQLNGPKYGCGLGECGACTVLIDGVAARSCSMPLSAVGNKSVTTLEGLGTAEAPHPVQQGFIDEQAAQCGYCANGMIMTLVALFEREPQADEQTIKKELAYNLCRCGTHIEILHAAERARDLLAARRQA

SEQ ID NO: 107050 - protein, 221 aa, Glycine max
  Coding DNA Sequence Number=SeqID_15365
  Homolog annotation: Hit_ID=Q6UUU1; Match level="QueryCoverage=33%, HitCoverage=51%, E-value=1e-21, Identity=72%"; Hit description =Putative uncharacterized protein
  Subcellular localization annotation: CTP_CleavageSite=46; ConfidenceScore=5.06e-01
MVKVEPPYVPINVSFSPKVGPGLPAVPPVQLLTGWCVTAKAPPDISAGKCSGRVPFAIQAAQLLGRAIGAGLFAITPAGERGMCCKAIKLGSGGGGFNSLCLDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEIFLGDARKILNRE

SEQ ID NO: 107051 - protein, 199 aa, Glycine max
  Coding DNA Sequence Number=SeqID_15366
  Homolog annotation: Hit_ID=Q6L419; Match level="QueryCoverage=49%, HitCoverage=24%, E-value=6e-07, Identity=32%"; Hit description =Putative gag polyprotein, identical
MDNEEGVQEQMKADLSALKDQMASISEVMLKLQKTIEDKATTTASSTARGSGAGATVCLKSRPRQKHDSACQAPTFEGQLPPYADYPVQDDEEGDTYLGPLLHFKDPSPHELPQPNIVRHVPSSPAPVIKSVPFAEDKGKIDALEERLRAVEGLGNYPFSDLADLCLVPNIVIPPKFKVSDFDKYKGTTYPKGHLRMYC

SEQ ID NO: 107052 - protein, 102 aa, Glycine max
  Coding DNA Sequence Number=SeqID_15367
METCLGVEELLQQMIDQGRLEVGSEGREEQHICMQSTDGSSVARPKPLVIYFTKGTASQKPGHPLAARPVPFPYQNSHAVPWRYTPLEGEGRRSHRRQLVVG

SEQ ID NO: 107053 - protein, 580 aa, Glycine max
  Coding DNA Sequence Number=SeqID_15368
  Gene Ontology: Mol. function=protein serine/threonine kinase activity; Cellular component=plasma membrane; Biological process =protein amino acid phosphorylation
  Homolog annotation: Hit_ID=Q7XZK4; Match level="QueryCoverage=99%, HitCoverage=99%, E-value=0.0, Identity=73%"; Hit description=Calcium- dependent calmodulin-independent protein kinase isoform 2
  Pfam annotation: Domain name=Pkinase; Domain location=48-358; Score =311.0; E_value=2.3e-90; Accession=PF00069.16; Description=Protein kinase domain
  Pfam annotation: Domain name=Pkinase_Tyr; Domain location=48-358; Score=-43.0; E_value=9e-10; Accession=PF07714.8; Description=Protein tyrosine kinase
  Pfam annotation: Domain name=efhand; Domain location=405-433; Score =24.9; E_value=0.0003; Accession=PF00036.23; Description=EF hand
  Pfam annotation: Domain name=efhand; Domain location=441-469; Score =24.0; E_value=0.00054; Accession=PF00036.23; Description=EF hand
  Pfam annotation: Domain name=efhand; Domain location=477-505; Score =28.9; E_value=1.9e-05; Accession=PF00036.23; Description=EF hand
  Pfam annotation: Domain name=efhand; Domain location=513-541; Score =38.1; E_value=3.2e-08; Accession=PF00036.23; Description=EF hand
  Pfam module annotation: Pfam domain module=Pkinase::Pkinase _Tyr::efhand::efhand::efhand::efhand; Domain location=48-358::48 -358::405-433::441-469::477-505::513-541
MGNCCVVPSGQTRKEKKQKKKWNPYEDGWGKKLVVLTEPTGRDIGLRYDLGRELGRGEFGVTYLCQDRETKEELACKSISKKKLRTAIDIEDVRREVEIMRLLPKHPNVVSLKDTYEDDNAVHLVMELCEGGELFDRIVARGHYTERAAATVTRTIVEVVQFAILSGWFSMSVGYIFKMAFTLISVEEELFLCISLIKPANKLYIGRGIICFLMCHKHGVMHRDLKPENFLFGNKKETAPLKAIDFGLSVLFKPGERFNEIVGSPYYMAPEVLKRNYGPEVDIWSAGVILYILLCGVPPFWAETEKGVAQAIIRSVVDFKREPWPKVSDNAKDLVKKMLDPDPKCRLTAQEVLDHPWLQNEKKAPNVSLGETVRSRLMQFSVMNKLKKRALRVIGEFLSLEEAAGIKEGFQLMDTSNKGKINMDELRVGLHKLGHQIPDGDVQILMDAGDVDNDGYLDYGEFVAISIHLRKIDKDEHLHKAFQFFDKNQSGYIEIEELHNALVDEIETNSEEVINAIMHDVDTDKDGKISYEEFAAMMKAGTDWRKASRQYSRERFSSLSQKLIKDGSLQLNNDDGSRLY

SEQ ID NO: 107054 - protein, 71 aa, Glycine max
  Coding DNA Sequence Number=SeqID_15369
ESVQVIEVSSSEEDPEELPPEPAMDALDLPEDDEDPLPDVDSPEDIMSASEADSTEESGPGGTAISDDSSS

SEQ ID NO: 107055 - protein, 148 aa, Glycine max
  Coding DNA Sequence Number=SeqID_15370
METIVMAAQFIHDRVEMECLEGVWETLEGNARCRFRGTIQLTATLLVHPEEPTRTLQRTVEWILPTPTPYLPVKPVQVIEVTSSEEDPEEDPEKLPPEPAVDALDFLEGDEDPLPEVDSPEDVMSASEADSMEESGPRRIATSGGSSS

SEQ ID NO: 107056 - protein, 28 aa, Glycine max
  Coding DNA Sequence Number=SeqID_15371
TYVVLADFGKERNVKALYLEQSLLGEKR

SEQ ID NO: 107057 - protein, 120 aa, Glycine max
  Coding DNA Sequence Number=SeqID_15372
  Gene Ontology: Mol. function=aspartic-type endopeptidase activity; Biological process=DNA integration
  Homolog annotation: Hit_ID=Q2QW17; Match level="QueryCoverage=70%, HitCoverage=7%, E-value=8e-10, Identity=35%"; Hit description =Retrotransposon protein, putative, Ty1-copia subclass
MDSAASKHICRDREMFDTLKTDGEFNNFKLGNGGKMKVEGIRSVRMKLHDGAIRTFSNVRFVPSAIVNMISMGEMTSQGYIYVALKRNYESKVKKKVKFSNVVEVFRDTSVGGGVCSLSN

SEQ ID NO: 107058 - protein, 56 aa, Glycine max
  Coding DNA Sequence Number=SeqID_15373
MRTRSPLKVRACSPLKARMCSPLEIDCPFERGDSPCNLILSFANLFENSLRVCVSV

SEQ ID NO: 107059 - protein, 84 aa, Glycine max
  Coding DNA Sequence Number=SeqID_15374
  Gene Ontology: Biological process=transposition, DNA-mediated
  Homolog annotation: Hit_ID=Q1J7G7; Match level="QueryCoverage=39%, HitCoverage=47%, E-value=1e-11, Identity=96%"; Hit description =Transposase
MPIKRLHFRPKVGPRASRYQQGHQDLFFLRSDLPSQVLQWLLFLSAVPPVQLLTGWCVTAKAPPDISAGKCSGHAARNHHTRRA

SEQ ID NO: 107060 - protein, 211 aa, Glycine max
  Coding DNA Sequence Number=SeqID_15375
MKDKRDEEEKLENQKKKKDSKALSLKAKGKENEEKDSSKKTVKNENHFAIKGDIKRALLLKQSFYLLVSRETSLSTAIPLGLEVIPQVKELLDKGLVHKSLNPCALLVSQIGIIRHQIPKIGGMMNVLSGATLFCKITHAPNIFMICVHRDSLGSDQRVLMDPKRIKVITEWPTPPSIEGKSPEFKEPLDLRSNPFEGGGNDTILPPKGIR

SEQ ID NO: 107061 - protein, 166 aa, Glycine max
  Coding DNA Sequence Number=SeqID_15376
MKGTVHEPQVNIGADQKFTPVDVFKQEKKGGDKPWDFNGLIKHQTALLPSLQNGQVTKSNRTYTLRGFPERFAKDRIRGLHVLALRGLHVLTIRGLHALTSRGLHVLALRGLHALTLGTSYPHRQRTTRPRLERTTRPHHQRAARPYLQRTTCPRLERATRPHLGY

SEQ ID NO: 107062 - protein, 87 aa, Glycine max
  Coding DNA Sequence Number=SeqID_15377
  Homolog annotation: Hit_ID=A2FDT0; Match level="QueryCoverage=97%, HitCoverage=16%, E-value=1e-07, Identity=35%"; Hit description =Putative uncharacterized protein
RVHALAFRGLHGVALEDYTSSPLEGLHVLAFKGLHALAFRGIHVLPFRGLHVLPFRGLHVLTFRGLHVLTFRGLHVLAVGGLHALPF

SEQ ID NO: 107063 - protein, 66 aa, Glycine max
  Coding DNA Sequence Number=SeqID_15378
MKGLFVAKFESNEVLLSPIALKVVGPLLLDSNSSRDGTNPPFQFPIWQLTNKETKRQAITTYQKIK

SEQ ID NO: 107064 - protein, 57 aa, Glycine max
  Coding DNA Sequence Number=SeqID_15379
MSQRALRGRARARLTGALSKGGKVDKSGALAPTYPLSERISDQRSSSLCVNQVILFT

SEQ ID NO: 107065 - protein, 43 aa, Glycine max
  Coding DNA Sequence Number=SeqID_15380
MTSIRKCSIGVIRLKAQVEKDEDPSGEGQSPQVEKDEGPSGEG

SEQ ID NO: 107066 - protein, 118 aa, Glycine max
  Coding DNA Sequence Number=SeqID_15381
QFPLLNDPNKACIYVIKGRSNRGFSFPWSGNLLYNTEKNKMIFTQQNLSELFGTCTFLSLELPKHAKASSQGQTLVHAEASSRKMPNSLKNQISSLNSGALSEPDNSSSSGFFLVLSH

SEQ ID NO: 107067 - protein, 53 aa, Glycine max
  Coding DNA Sequence Number=SeqID_15382
MDQAGEEIEIKSDSTNKSFKVNGHRLKSFLTNPSLVDIVVEETSLLHPTLPPP

SEQ ID NO: 107068 - protein, 88 aa, Glycine max
  Coding DNA Sequence Number=SeqID_15383
MARSVFAPCPYFRDLHGRELKGLLVIIPKVVISLLMVSRVPSGVANCRNLPFGGRATRDSWVRLPRKEYARSRHQRLFEENVGKPEKA

SEQ ID NO: 107069 - protein, 100 aa, Glycine max
  Coding DNA Sequence Number=SeqID_15384
MILHEITRPNSLTTVPVESPTVVTYPSARGRREGSQVRLPWEENARSRHKHLFEENVEKTGKVWSTNFKCERFGSCFYAQGRVFPSLLRILNCNEEIRST

SEQ ID NO: 107070 - protein, 101 aa, Glycine max
  Coding DNA Sequence Number=SeqID_15385
  Homolog annotation: Hit_ID=A5B5H1; Match level="QueryCoverage=67%, HitCoverage=17%, E-value=4e-07, Identity=40%"; Hit description =Putative uncharacterized protein
MATIDITGSNRNDLNKPFRFEGYHFKHWKQKMMFSMKKVAYVLNTDIPVMPKDAEKEVKDKMTMELALWNENDYLCNNFILNGLADDLYDYYSLYKSAKLI

SEQ ID NO: 107071 - protein, 126 aa, Glycine max
  Coding DNA Sequence Number=SeqID_15386
MYPPLFSLNNLVDVPSTRTDPQEMYPLLFSVTINQVDVSSTCTTKDIPSNVLRQSSQAISPLKLCEWGNKRILRREKGDTKEFRQLILRSFGKGRREIQKEFRRLVLDEFFLAKEEENEKMNSTSF

SEQ ID NO: 107072 - protein, 122 aa, Glycine max
  Coding DNA Sequence Number=SeqID_15387
SKFLEIWLAIALEKNSLRDCSKLALPWGESSVDLRLKNENKTFEVIAMQAGKVWGAPSVLKRRRKMSVCMTHVSYKVTHEEHILYHDGTSTEDILRFDEELGMGTTNSHGIWSGPAFSGLMN

SEQ ID NO: 107073 - protein, 105 aa, Glycine max
  Coding DNA Sequence Number=SeqID_15388
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=55%, HitCoverage=46%, E-value=9e-25, Identity=94%"; Hit description =Putative uncharacterized protein
MVLVLTIESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107074 - protein, 44 aa, Glycine max
  Coding DNA Sequence Number=SeqID_15389
VVSQKDTKARSGSSGINTAGPISISKGSEGLSYTDLSVHSKGDI

SEQ ID NO: 107075 - protein, 53 aa, Glycine max
  Coding DNA Sequence Number=SeqID_15390
IGKDNIEANINLPYFHGKDNVEAYLDWEIRVEQKLKRKLMKEDKSGQMPQGLP

SEQ ID NO: 107076 - protein, 266 aa, Glycine max
  Coding DNA Sequence Number=SeqID_15391
  Homolog annotation: Hit_ID=Q6WAY6; Match level="QueryCoverage=67%, HitCoverage=38%, E-value=7e-21, Identity=29%"; Hit description =Putative uncharacterized protein
KIAAVVGDSAKELDRTKQTRNGVVGLPRKYLEGKARDMASQEKWGPFADILALLIFGVVLFPNVDGLVDLAAIDAFLAYHHSKESPVVAILADLFDTFDRSAINWFPRWKEGKEGVLFSCGDYPNIPYIGTRGCINYNPVLAIRQLGYPMRGAPTEESISPFLVRNLGAQNLKAIQRVHKAWRSPPPKDKELRRIRNGVIGGYHGWLRIHTRGLDWLSKLKVIDEENFEASEEDEEVQALKLELGKARLAKEKFKSAATHIRKECT

SEQ ID NO: 107077 - protein, 109 aa, Glycine max
  Coding DNA Sequence Number=SeqID_15392
MAHQIDLGVPKSKPSYRVPVPISYCSPLRRLREEEVFHARRCLEWAWSICVQIVGTLCLFYKSLHKVTSYPIPRLDDLPVMSCKWCNYLFKNCHSKVVSITKLKQDEKW

SEQ ID NO: 107078 - protein, 101 aa, Glycine max
  Coding DNA Sequence Number=SeqID_15393
MTWGESDLSNGANNSEGRKDGSLKNSSVKMRKNSATQEARNIVDMGIGLGVSLIGKEEIMAKGEGGARVDTKRGGAIIILQETKKKCYIRNYVTLYGVTLK

SEQ ID NO: 107079 - protein, 126 aa, Glycine max
  Coding DNA Sequence Number=SeqID_15394
  Subcellular localization annotation: CTP_CleavageSite=72; ConfidenceScore=5.60e-01
MKDRRNTTSGDVSSTSRNLTISQNLLQSSARWLPCQAQLSPSLSTVKNSQKTQLTLRNRDFSLNRQSSPVTLAQPKGEDGALSELAFAQRLYTAHPSSIIVHALSHQLGRLADDALSQKMSGLASS

SEQ ID NO: 107080 - protein, 76 aa, Glycine max
  Coding DNA Sequence Number=SeqID_15395
  Homolog annotation: Hit_ID=A5BKY7; Match level="QueryCoverage=100%, HitCoverage=13%, E-value=1e-07, Identity=43%"; Hit description =Putative uncharacterized protein
  Pfam annotation: Domain name=zf-CCHC; Domain location=41-58; Score =20.2; E_value=0.0013; Accession=PF00098.14; Description=Zinc knuckle
MEMGESALLTTAYGMNKAVKSQANQKGNDKIPPQADIKKVKKCFFCKKKGHMKKNCSRFQKWLEKKGYANLRKPVE

SEQ ID NO: 107081 - protein, 46 aa, Glycine max
  Coding DNA Sequence Number=SeqID_15396
  Homolog annotation: Hit_ID=Q0PCF3; Match level="QueryCoverage=97%, HitCoverage=18%, E-value=1e-07, Identity=49%"; Hit description =Deoxymugineic acid synthase1
MWEMPYSEESLVPFDFLTKSIGVSNFSCKKLENLLSFATIPPSVNQ

SEQ ID NO: 107082 - protein, 260 aa, Glycine max
  Coding DNA Sequence Number=SeqID_15397
QTEKEHLSTGSLDGKKEEPEFLSSAEDFRMQLGYPMRGAPLEEELPPVRKAWEVVQKEDKEFRGSNNGPIGGYHEWLKAHVQALDWLPSLRTAKREEVEAPKEDEEVARREEHGWNKFRGALWGSNSELKLWKEERDQSREDNLILKDELKACFRSKKSLSQRLCETKTNMLAIISKYQEELNLATTHEHRVADEYAQVYAEKEARGRVIDSLHQEATMWMDRFALTLNGSQEIPQLLAKAKAMADTYSAPVEIHGLLSY

SEQ ID NO: 107083 - protein, 127 aa, Glycine max
  Coding DNA Sequence Number=SeqID_15398
LVEKSSNSFGAYTEKNPKEECNVVMTRNKKPVAVEDEGIVALKEQTVVKDSTGKTNEEETGNNYAFQRSFAADATLLKVFERYVDKEEQIHSLGKYRCGGQLQCCDTEDPSTKTQGPWKCDYSLFNR

SEQ ID NO: 107084 - protein, 280 aa, Glycine max
  Coding DNA Sequence Number=SeqID_15399
  Gene Ontology: Mol. function=ATP-dependent helicase activity; Cellular component=phycobilisome; Biological process=regulation of transcription, DNA-dependent
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDRYPVQTYVLEKNDSVIRDAVLREMERGGQVYYLYNKVDTIDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107085 - protein, 110 aa, Glycine max
  Coding DNA Sequence Number=SeqID_15400
MTPVNRKAGTGERTREPPGGNAGIFIVLSGFATTDLSVRFRDACQGGGAYGKTALPRPSHSVNPGDTTSSRAAASPAVELNNSRPIHIRPLAPAGVIAQRPAYRSRWPIH

SEQ ID NO: 107086 - protein, 35 aa, Glycine max
  Coding DNA Sequence Number=SeqID_15401
MKVDSLNLEYFFQYFLVRWLTPLVLTKFSRSSIFT

SEQ ID NO: 107087 - protein, 77 aa, Glycine max
  Coding DNA Sequence Number=SeqID_15402
MLENVKDNVPDFCTGMGMLAISKEEFPFLNDFYKNNINLNDFYKPEQSTSLKRRKVGNLKLQTTFSFKHLTCVNGET

SEQ ID NO: 107088 - protein, 65 aa, Glycine max
  Coding DNA Sequence Number=SeqID_15403
MTPVNRKAGTGERTREPPGGNAWGAEPMEKRLCRGHIFTSLVKSASFGIRIPAPWGKPLVLSVAA

SEQ ID NO: 107089 - protein, 221 aa, Glycine max
  Coding DNA Sequence Number=SeqID_15404
  Gene Ontology: Mol. function=pyridoxal phosphate binding; Cellular component=chloroplast; Biological process=amino acid metabolic process
  Homolog annotation: Hit_ID=A8G7Q7; Match level="QueryCoverage=87%, HitCoverage=64%, E-value=3e-76, Identity=72%"; Hit description =Pyridoxal-5'-phosphate-dependent protein beta subunit
  Pfam annotation: Domain name=PALP; Domain location=32-221; Score =33.2; E_value=2.4e-10; Accession=PF00291.16; Description=Pyridoxal -phosphate dependent enzyme
MAVLLRMPALSRHLTGSAAAFHMACEAGMNSLFDAIVSAHQQLRPQLGCELYLKCDHLQHTGSFKFRGASNKLRLLDSEQRRRGVIAASTGNHGQAVALAGQLMGVGVTVYAPETAASIKLDTIRALGGTVERVPGDALNAELAGEQAAREQGKTYISPYNDEQVIAGQGTCGMELVEQLTGLDAVFVAVGGGGYIAGIGTVLRQLSPNTQLIACWPENAT

SEQ ID NO: 107090 - protein, 75 aa, Glycine max
  Coding DNA Sequence Number=SeqID_15405
MTKDDSIISPSTSNPLLILSENNYVEVFLAPTDQEKRKKVKLGESDHGGTTKVEEKQGDIDSIVENERCYVHSVL

SEQ ID NO: 107091 - protein, 269 aa, Glycine max
  Coding DNA Sequence Number=SeqID_15406
  Homolog annotation: Hit_ID=Q6UUU1; Match level="QueryCoverage=22%, HitCoverage=40%, E-value=3e-18, Identity=78%"; Hit description =Putative uncharacterized protein
VPPVQLLTGWCVTAKAPPDISAGKCSGHAARRVPFAIQAAQLLGRAIGAGLFAITPAGERGMCCKAIKLGAPVLLFLSAVPPVQLLTGWCVTAKAPPDISAGKCSGHAARRVPFAIQAAQLLGRAIGADQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107092 - protein, 103 aa, Glycine max
  Coding DNA Sequence Number=SeqID_15407
MIMRGQDIYSSQEKTTSFPSSSGSEDEVRGEESTEEVYPHEEEVVIIKKGEIVEAKLHDDDKGDDKKLKGQSKNEFKMFKKESRTIQGSRGKFEERFKIQEES

SEQ ID NO: 107093 - protein, 35 aa, Glycine max
  Coding DNA Sequence Number=SeqID_15408
HEKTTIDTPEPYTGAMRGTMREPQENLGADQKFSP

SEQ ID NO: 107094 - protein, 258 aa, Glycine max
  Coding DNA Sequence Number=SeqID_15409
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDAGTKKREWALCQQDKELTVDSDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 107095 - protein, 60 aa, Glycine max
  Coding DNA Sequence Number=SeqID_15410
MEITISKLKVQFDNYNSAQRWVQLISSLINWKKRCELIKFWGCIRKLPKEATCSLGRAVM

SEQ ID NO: 107096 - protein, 331 aa, Glycine max
  Coding DNA Sequence Number=SeqID_15411
  Gene Ontology: Biological process=transposition, DNA-mediated
  Homolog annotation: Hit_ID=Q6UUU1; Match level="QueryCoverage=18%, HitCoverage=40%, E-value=5e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDREAAEVTSPHTLPQPFPQPQRGEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWPRLSHSTPDTQFR

SEQ ID NO: 107097 - protein, 78 aa, Glycine max
  Coding DNA Sequence Number=SeqID_15412
  Homolog annotation: Hit_ID=Q6UUU1; Match level="QueryCoverage=92%, HitCoverage=48%, E-value=4e-27, Identity=83%"; Hit description =Putative uncharacterized protein
MAYERGGDFLEDARKILNREVRGPRQSRFSIGSAPLTSITKSDAQISGGETRQDYKDTRRFPLAAPSCALLFLPFGLP

SEQ ID NO: 107098 - protein, 90 aa, Glycine max
  Coding DNA Sequence Number=SeqID_15413
MASPELITMKDKTEYQAYRYRRPRGGARIYSASSLTDSLRSVVRLRRAEMAYERGGDFLEDARRYLTGSERAAAKPFFHRLRPPDKHHEI

SEQ ID NO: 107099 - protein, 70 aa, Glycine max
  Coding DNA Sequence Number=SeqID_15414
MACSVFAPCPYLRDLYGRELKGLLVIIPKAIISLLMVSRGIIPFEEHIAAVGTTSNNMLSKKKTLDEGSL

SEQ ID NO: 107100 - protein, 241 aa, Glycine max
  Coding DNA Sequence Number=SeqID_15415
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSMVDSGFPNMPGYLVPFRRNKYHLHDFHEGYGRPLGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107101 - protein, 100 aa, Glycine max
  Coding DNA Sequence Number=SeqID_15416
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=42%, HitCoverage=41%, E-value=1e-11, Identity=78%"; Hit description=LacZ protein
MDVAVVGDPFDVHLIDLREQIGLQDVFAGAAHPPFASWRNSEEARTDRPSQQLRSLNGEWDAPCSGALSAAGVVVTRSVTATLASADVRRCFCRYAPPRQ

SEQ ID NO: 107102 - protein, 164 aa, Glycine max
  Coding DNA Sequence Number=SeqID_15417
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=6e-25, Identity=55%"; Hit description =Putative uncharacterized protein
MTMITPSSKLTLTKGNKSWYRAPPRGITNSEGLALHAKEGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107103 - protein, 49 aa, Glycine max
  Coding DNA Sequence Number=SeqID_15418
VDSNSGGCGGIDGGAAADVAAPASTAADSPLLPRRHNDGAYVAGVCAIR

SEQ ID NO: 107104 - protein, 143 aa, Glycine max
  Coding DNA Sequence Number=SeqID_15419
  Homolog annotation: Hit_ID=A2Q500; Match level="QueryCoverage=53%, HitCoverage=9%, E-value=2e-07, Identity=38%"; Hit description =Endonuclease/exonuclease/phosphatase
MESPSFRENSVQGWLPHCTDHLTTSKGSISFARALVEVDASLELIEEVCFRLHSGKTFIQKIEYENRPSFCTHCKMIGHRLTKCKVVPVAKHDHKITTTKGPFTAQSQVTEVASLIETNASNPSGKQKEDQAQLSTPPCIQQS

SEQ ID NO: 107105 - protein, 334 aa, Glycine max
  Coding DNA Sequence Number=SeqID_15420
  Gene Ontology: Mol. function=transferase activity; Cellular component= cytoplasm; Biological process=regulation of transcription
  Homolog annotation: Hit_ID=A7Q5E3; Match level="QueryCoverage=94%, HitCoverage=94%, E-value=2e-91, Identity=59%"; Hit description =Chromosome undetermined scaffold_53, whole genome shotgun sequence
MGVVEQEMEEEEKEKHTNNHNHPSSLHPIKEECVSVRKPFSGDRVKRDEWSEGAVSTLLEAYEAKWVLRNRAKLKGHDWEDVARHVSARANCTKSPKTSTQCKNKVESMKKRYRSESAATADHASSSWPLYSRLDLLLRGTGPVLSSPPPPPAMMPAAMPVLSPVEPSQPPQLSPPPAAPSGPLANAQNSHGSNGIDEKLAKEDGLGTKSSDQVSSKNPLDTDSSTPALYSKKDGLRCNKRKKKTIDNTGRRRKECVEIAESLRWLTEAMIRSEQARMDTMKEIERMRVEAEAKRGEMDLKRTEIIANTQLEIARIFASVNNKGVDSSLRIGRS

SEQ ID NO: 107106 - protein, 50 aa, Glycine max
  Coding DNA Sequence Number=SeqID_15421
RAFIKKYCTPKQAQGKTPQQHWDGRYQAIDTPPPPLEFTSAHPQKGSKIP

SEQ ID NO: 107107 - protein, 182 aa, Glycine max
  Coding DNA Sequence Number=SeqID_15422
  Gene Ontology: Mol. function=oxidoreductase activity; Cellular component=cytoplasm; Biological process=metabolic process
  Homolog annotation: Hit_ID=A8GIX1; Match level="QueryCoverage=98%, HitCoverage=71%, E-value=8e-87, Identity=89%"; Hit description=Short- chain dehydrogenase/reductase SDR
  Pfam annotation: Domain name=KR; Domain location=1-148; Score=-67.8; E_value=0.0021; Accession=PF08659.1; Description=KR domain
  Pfam annotation: Domain name=adh_short; Domain location=3-136; Score =38.6; E_value=2.3e-08; Accession=PF00106.16; Description=short chain dehydrogenase
  Pfam module annotation: Pfam domain module=KR::adh_short; Domain location=1-148::3-136
MSLTASGAALREQGAQVETQTIDLASPDSIRSAFEKIAAGGGIDGLVNNAALATGVGGKTMMEYDIDLWDRVMQVNVRGTWLVSQAAVPLLARSPHAKIVNVASDTALWGAPRLMAYVASKGALIAMTRSMARELGPQGICVNAIAPGLTRVEATEYVPAERHQLYEQGRALAGAQHPDDVN

SEQ ID NO: 107108 - protein, 249 aa, Glycine max
  Coding DNA Sequence Number=SeqID_15423
  Homolog annotation: Hit_ID=Q6UUU1; Match level="QueryCoverage=24%, HitCoverage=40%, E-value=3e-18, Identity=78%"; Hit description =Putative uncharacterized protein
  Subcellular localization annotation: CTP_CleavageSite=42; ConfidenceScore=5.13e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLIYAKHAKTGYHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 107109 - protein, 155 aa, Glycine max
  Coding DNA Sequence Number=SeqID_15424
MTGRLLAGSLALESRILHYLTPKIFKPCTVTFFLQHFNIPFDSEPYVLIKRSFLIDAAVVASFGYRKERDGSWVKNGAQPNDDEGQLLVEVDSSLLQSILDRFNGLQTYVGERFDALERQVDTRFDEMDSRITKVEKDVTIIRGCLDLPPPSPSV

SEQ ID NO: 107110 - protein, 275 aa, Glycine max
  Coding DNA Sequence Number=SeqID_15425
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 107111 - protein, 148 aa, Glycine max
  Coding DNA Sequence Number=SeqID_15426
MQLPQESLNKKPRGLARKSMAVTNFVELCGAATELAACSRSKRNLSQRLCEIETNMLAIDSKYQEELNLATTHEHKVADEYAQVYAEKKARGRVIDALHQEATMLMDQFALTLNGSQELPRLLAKAKAMADTYSAPRRSTDFSAIVSI

SEQ ID NO: 107112 - protein, 127 aa, Glycine max
  Coding DNA Sequence Number=SeqID_15427
MTDPGSLLLRPEKGSIDVAIVKEFYANLYDPEDKSPKQVRVRGHLVKFDADTLNTFLKTPMIIKEGEELPTYSRFVLLRPDPQELVAKLCIPGMGFELNADGLPLKILRKNMTTLAQTWSVLSYSIL

SEQ ID NO: 107113 - protein, 258 aa, Glycine max
  Coding DNA Sequence Number=SeqID_15428
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=46%, HitCoverage=96%, E-value=2e-24, Identity=55%"; Hit description =Putative uncharacterized protein
MTPVNRKAGTGERTREPPGGNAGIFIVLSGFATTDLSVRFRDACQGGGAYGKTALPRPSHFPVKYLPGIFQEISAPFPFFSCHMKHFTDTLISANIETAMTMITPSSKLTLTKGNKSWYRAPPREEELRLRVPISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107114 - protein, 96 aa, Glycine max
  Coding DNA Sequence Number=SeqID_15429
  Pfam annotation: Domain name=Ins_element1; Domain location=27-90; Score=-23.1; E_value=0.024; Accession=PF03811.4; Description =Insertion element protein
  Subcellular localization annotation: CTP_CleavageSite=36; ConfidenceScore=5.41e-01
MVKVGTSYVPINVHFRQKLAQGFPAPVASVSISCPSCSATEGNGVIRNAKATAGTSARKCKAGVPKTLTLTHHLTSLRFTARFPVGKPVVPFAAFK

SEQ ID NO: 107115 - protein, 235 aa, Glycine max
  Coding DNA Sequence Number=SeqID_15430
MQSQMQSQGLALPPEPLAGSLAPRVSTKESYVDPSGNDPETGDSDRCSLYIEANPARLVALRRVYKGSTVVHNTPLFPGQVKLGVEEVKDLDAPVPVATDEVSLVGQTIHTFLAWLIHLVKPLSQQAVVSLAKPPQTPDPGVDDLLYLMTLIIPEFFLRPYQVTWDATMFGVFNPDFPLYIKHKDLSEIAHNGQCLSISVLQLWILHLTETSMRAGNSDLYGFLNAQSIQRSGLS

SEQ ID NO: 107116 - protein, 149 aa, Glycine max
  Coding DNA Sequence Number=SeqID_15431
  Homolog annotation: Hit_ID=A0PAV3; Match level="QueryCoverage=43%, HitCoverage=31%, E-value=3e-07, Identity=52%"; Hit description =Restriction endonuclease
  Subcellular localization annotation: CTP_CleavageSite=96; ConfidenceScore=5.15e-01
MVKVGTSYVPINVSFSPKVGPGLPGINRDTRIYLFCEHRRTSALASVAVTLRVTTTPAALNAPLQGASHSPFRLRNCWEGRSGFPSHDVVKRRPVNCNTTHYRANWSSTAVAAALELVDPPGCRNSMLCVSQGQLKMSGRLGADVETVE

SEQ ID NO: 107117 - protein, 90 aa, Glycine max
  Coding DNA Sequence Number=SeqID_15432
MKREKHVSYSSHDSCKSLSEELRNYYGRQHRSHTKHHSQRREKDRRPQEVEQLFACHHISEERKFPLATLSFQGYVQRLRQGSISVEEYR

SEQ ID NO: 107118 - protein, 288 aa, Glycine max
  Coding DNA Sequence Number=SeqID_15433
  Homolog annotation: Hit_ID=Q6WAY4; Match level="QueryCoverage=60%, HitCoverage=36%, E-value=4e-08, Identity=28%"; Hit description =Putative uncharacterized protein
MGSSQTPSLKKRFYQVKIKSLGVVGLKELGQLMGQLQRQAFRKAYSKIWDLTMAEVSTEAIASLAQYYDQPLRKPYLFSGFYPSLARISKIVKISTQILDREKQVENGVVGVPRKCLEAKARVLASQGEWAPFMDILELLIFGVVLFPNMDGLVDRAAIDAFSPFTTVRKARAGVLQRVHKAWEMSQRKDKELRGSSNGPIGGYHRWLKAYAQDLDWLPSLRTTKGMEIETPEKDEEENAKLRDNIATTKALEQKTKRARKEEHGRNKFRGALWGSNSELKLQRKGRD

SEQ ID NO: 107119 - protein, 458 aa, Glycine max
  Coding DNA Sequence Number=SeqID_15434
  Gene Ontology: Mol. function=nucleoside-triphosphatase activity; Cellular component=endoplasmic reticulum; Biological process =proteolysis
  Homolog annotation: Hit_ID=Q9ZNT0; Match level="QueryCoverage=100%, HitCoverage=100%, E-value=0.0, Identity=81%"; Hit description =Putative ATPase
  Pfam annotation: Domain name=AAA; Domain location=166-375; Score =232.5; E_value=9.3e-67; Accession=PF00004.20; Description=ATPase family associated with various cellular activities (AAA)
  Pfam annotation: Domain name=AAA_2; Domain location=162-292; Score= -46.8; E_value=0.04; Accession=PF07724.5; Description=ATPase family associated with various c
  Pfam annotation: Domain name=AAA_3; Domain location=166-291; Score= -14.9; E_value=0.014; Accession=PF07726.2; Description=ATPase family associated with various
  Pfam annotation: Domain name=AAA_5; Domain location=166-297; Score =1.4; E_value=0.0022; Accession=PF07728.5; Description=ATPase family associated with various
  Pfam annotation: Domain name=MIT; Domain location=5-73; Score=110.3; E_value=5.9e-30; Accession=PF04212.9; Description=MIT domain
  Pfam annotation: Domain name=Vps4_C; Domain location=390-455; Score =129.8; E_value=7.9e-36; Accession=PF09336.1; Description=Vps4 C terminal oligomerisation domain
  Pfam module annotation: Pfam domain module=AAA::AAA_2::AAA_3::AAA _5::MIT::Vps4_C; Domain location=166-375::162-292::166-291::166 -297::5-73::390-455
MYSNFKEQAIEYVKQAVDEDNKGNYAKAFQLYMNALEYFKTHLKYEKNPKIKEAITQKFTEYLRRAEEIRAVLDDGPSGPASSGDAAVATRPKTKPKDGGKDGDGEDPEQAKLRAGLNSAIVREKPNVKWNDVAGLESAKQALQEAVILPVKFPQFFTGKRRPWRAFLLYGPPGTGKSYLAKAVATEADSTFFSVSSSDLVSKWMGESEKLVSNLFQMARESAPSIIFVDEIDSLCGQRGEGNESEASRRIKTELLVQMQGVGHNDQKVLVLAATNTPYALDQAIRRRFDKRIYIPLPDLKARQHMFKAWAIYMMMFIGLIVYCEPSKWPYNVHLGDTPHNLAESDFEHLARKTEGFSGSDISVCVKDVLFEPVRKTQDAMFFFRNPEDMWIPCGPKQQSAVQTTMQDLAAKGLASKILPPPISRTDFDKVLARQRPTVSKSDLDVHERFTKEFGEEG

SEQ ID NO: 107120 - protein, 77 aa, Glycine max
  Coding DNA Sequence Number=SeqID_15435
GGGVGGGGGRGGGGGIGIGIGVGVGVGAGAGHGSGVGGGVGVAGELIKAYEGQPPPQPIILVKNVYCALYICTLKLN

SEQ ID NO: 107121 - protein, 239 aa, Glycine max
  Coding DNA Sequence Number=SeqID_15436
  Gene Ontology: Mol. function=transporter activity; Cellular component= integral to membrane; Biological process=transport
  Homolog annotation: Hit_ID=Q107W9; Match level="QueryCoverage=100%, HitCoverage=100%, E-value=5e-71, Identity=55%"; Hit description =Small basic intrinsic protein 1
  Pfam annotation: Domain name=MIP; Domain location=2-226; Score=-63.1; E_value=1.1e-05; Accession=PF00230.11; Description=Major intrinsic protein
MGWIKAAIGDAILTSMWVFIISTLRIVTTEITVFLGLQPFFLAGLIISTILNSIYVLTISFIGRILGGVSFNPSTSLSFYTAGLRPDSSLSSMAVRFPAQAYGGAVGIKTLLLVMPSHYKDMLKGPFLKVDLHSGAVAEGLLTFIHNMAIFFVMFKGPRNPFVKVYLLSVTTAALAILGGGFTGPSMNPANAFGWAFVNNKHNTWEQFYVYWIGPFIGASSAALIFRSMFMPPIKQKKA

SEQ ID NO: 107122 - protein, 380 aa, Glycine max
  Coding DNA Sequence Number=SeqID_15437
  Homolog annotation: Hit_ID=A7QFD7; Match level="QueryCoverage=82%, HitCoverage=80%, E-value=1e-141, Identity=77%"; Hit description =Chromosome undetermined scaffold_87, whole genome shotgun sequence
MGKREKQKQRHEKGHRGRGSFNYLQEDHDFDDTPRPSPSEEECADDSNEEKEEEEEEEEEGHENQSHDMPSKFLLYQQSVQSPKGDISYLQKFFLMYVGGRMPLHLQEDFCGTALLSTEWLRSDSRRTVVGLDLDLEALNWCMESNIPKVGADGFSRMSLFHGNVLQPLQSKLNEENLQTDVPESDAPTGSVAQDDKYTKRNIILPGRDIVCAFNYSCCCLHKRAELVLYFKHAREALSTKGGIFVMDLYGGTSSEHKLRLQRRFPNFTVCQSFTYVWEQAEFDIIQRKTRISLHFHMKKEQRKLRHAFSYSWRLWTLPEIRDCLEEAGFRSVHFWVREMPDTTEIMRTEGFGAGKNVKYEEATSFQQQDSWNAYIVGVA

SEQ ID NO: 107123 - protein, 895 aa, Glycine max
  Coding DNA Sequence Number=SeqID_15438
  Gene Ontology: Mol. function=transferase activity, transferring glycosyl groups; Cellular component=intracellular; Biological process=protein amino acid ADP-ribosylation
  Homolog annotation: Hit_ID=Q9SWB4; Match level="QueryCoverage=94%, HitCoverage=100%, E-value=0.0, Identity=87%"; Hit description=Poly [ADP-ribose] polymerase 3 (EC 2.4.2.30) (PARP-3) (ADPRT 3) (NAD(+) ADP-ribosyltransferase 3)
  Pfam annotation: Domain name=PADR1; Domain location=147-200; Score =121.6; E_value=2.3e-33; Accession=PF08063.3; Description=PADR1 (NUC008) domain
  Pfam annotation: Domain name=PARP; Domain location=666-881; Score =316.3; E_value=5.8e-92; Accession=PF00644.11; Description=Poly(ADP -ribose) polymerase catalytic domain
  Pfam annotation: Domain name=PARP_reg; Domain location=529-664; Score= -29.9; E_value=0.083; Accession=PF02877.5; Description=Poly(ADP -ribose) polymerase, regulatory domain
  Pfam annotation: Domain name=WGR; Domain location=408-496; Score =123.7; E_value=5.5e-34; Accession=PF05406.6; Description=WGR domain
  Pfam module annotation: Pfam domain module=PADR1::PARP::PARP _reg::WGR; Domain location=147-200::666-881::529-664::408-496
FRAVVVVSAVQRIKAYLVHIICESSDSELHAFVHHSSSGEVFHYSVGFSTTKMKVQETRSHVHALGEEEKVMTRKQKAESKAHEVEHSPKKAKVEKEDGHINGKSETGVAEEYDEFCKATTEHLPLEQMRDILEANGLDSSGSDLEITRRCQDLLFYGALDKCSVCNGSLEFDGRRYVCRGFYSEWASCTFSTRNPPRKQEPIKLPDSVQNSLASDVTILPTFYFVFPSLFAKEISGPESQASQGSRLSRKTLYWNDDLSDGSSYSDTRSTCLVASPAERERGGTSKLAEAIFYPGRRGYEVARTTGEVKKRLFLRRRPALIELRERSIPVVREAWLIDSIEKQEPQPLEAYDLVSDLSVDGKGIPWDKQDPGEEAIESLSAELKLYGKRGVYKDTKLQEQGGKIFERDGILYNCAFSVCDQGRGLNDYCVMQLIVVPENRLHLYFKKGRVGDDPNAEERLEEWDNVDGALKEFVRLFEEITGNEFEPWEREKKFQKKPLKFYPIDMDDGIEVRHGALGLRQLGIAATHCKLEPLVANFMKVLCSQEIYKYALMEMGYDCPDLPIGMVTNLHLKKCEDVLLEFIDKVKSLKETGPKAEAVWTDFSQRWFTLMHSTRPFNFRDYQEIADHAAAALEGVRDITQASHLIGDMTGSTIDDPLSETYKKLGCSISALDKSSDDYEMIVKYLEKTYEPVKVGDIEYGVSVENIFAVQTGGCPSYEDIIKLPNKVLLWCGSRSSNLLRHLQKGFLPAICSLPIPGYMFGKAIVCSDAAAEAARYGFTAVDRPEGFLVLAIASLGNEITELKTPPEDASSLEEKKVGVKGPGKKKTDESEHFVWKDDIKVPCGKLVASDHQDSPLEYNEYAVYDKKRARISYLVGVKYEEKEEKGAVIDTAE

SEQ ID NO: 107124 - protein, 573 aa, Glycine max
  Coding DNA Sequence Number=SeqID_15439
  Gene Ontology: Mol. function=protein binding; Cellular component =integral to membrane; Biological process=phagocytosis, engulfment
  Homolog annotation: Hit_ID=A7QFB8; Match level="QueryCoverage=86%, HitCoverage=83%, E-value=1e-179, Identity=60%"; Hit description =Chromosome undetermined scaffold_87, whole genome shotgun sequence
  Pfam annotation: Domain name=EMP70; Domain location=51-530; Score =560.3; E_value=2.1e-165; Accession=PF02990.7; Description =Endomembrane protein 70
  Pfam annotation: Domain name=NnrU; Domain location=301-473; Score= -112.8; E_value=0.049; Accession=PF07298.2; Description=NnrU protein
  Pfam module annotation: Pfam domain module=EMP70::NnrU; Domain location=51-530::301-473
MAKPHHLFLLLLLLCATLEFSSSSPSDHLYNVGELVPLFVNKVGPFNNPSETYEYYDLPFCTPDPIVRKKESLGEVLNGDRLSNALYEFKFRVDKIDETLCQKNLTIDQIATFKRAINRDFYFQFYLDDLPLWGFIGKLEEDGWTPGGGGPNYYLFTHVQFDVLYNGNRIIQVNAFGDPNRAADITKDVGVDVKFTYSVIWNATKVRFENRMDRYLRASLMPVHQQVHWFSFVNSIVIILLLIGLLALLYMRHLRSDLKKYSNANEEDNEVGWKSLQHGDVFRPPPNSSLLFAVVGTGTQLLILLCVLLFLALIGTLYPYNRGGLLNWLVLLYALSSVFAGYTAASFHGLFAENGWERSASLAAILYTGPVFVVASILNIVAISYRATIGLPFGSIIVILVLLTFLAIPLLAFGGVIGYRFRSKFQSSSATKRHPRDIQQLAWYRRTPFLMFIGGLVPFSAIVLQLHQAYASMWGYKIYTLPSILFATFIPVILIIALVSIGLTYIQLSAEDHECLLPFNVFLLPYSPPSLVCVPGISAVWWLNSHFHVWVLRLLLCEIKYEWILAAILLYWL

SEQ ID NO: 107125 - protein, 282 aa, Glycine max
  Coding DNA Sequence Number=SeqID_15440
  Gene Ontology: Mol. function=hydrolase activity; Cellular component =cellulose and pectin-containing cell wall
  Homolog annotation: Hit_ID=A7QFC5; Match level="QueryCoverage=95%, HitCoverage=99%, E-value=7e-55, Identity=41%"; Hit description =Chromosome undetermined scaffold_87, whole genome shotgun sequence
MVSRAAIVLLIGLVGMFYQGTQLPPPNNSDSSDDGVPVSPPRVRLRDGRYLAYREKGVPKDQAKHSIIIVHGFGSSKDMNFLAPQKPLDIEVLIRYLDTKKELIDELGIYILQYDRAGYGESDPNPKRSLKSEALDIEELADLLQIGLAGVAMIAPVINYLWPSFPESLIKEDYRRKLIKWSMWGDWMVAFGNWEFDPLKLSNPFPDNRSSAHIWQGYEDKVVPSQIQRFVTQKLPWIQYHEVPDGGHLIVHYSGLCEAILKALLLGEENLSYRPRPEVFVS

SEQ ID NO: 107126 - protein, 31 aa, Glycine max
  Coding DNA Sequence Number=SeqID_15441
MSLLLLEVAVINGVDDPPCMPSTGWAYRMRY

SEQ ID NO: 107127 - protein, 409 aa, Glycine max
  Coding DNA Sequence Number=SeqID_15442
  Gene Ontology: Mol. function=hydrolase activity, hydrolyzing O -glycosyl compounds; Cellular component=anchored to membrane; Biological process=cell wall organization and biogenesis
  Homolog annotation: Hit_ID=A9PDC4; Match level="QueryCoverage=79%, HitCoverage=86%, E-value=1e-148, Identity=74%"; Hit description =Putative uncharacterized protein
  Pfam annotation: Domain name=Glyco_hydro_17; Domain location=37-355; Score=361.6; E_value=1.3e-105; Accession=PF00332.9; Description =Glycosyl hydrolases family 17
MAIMIRSVMTGFSFFISMLLFLLTISDLFARIHGLGFGINYGQIGNNLPLPSQVAVLIKSMNVSRIKLYDADPDVLQAFSQYNVEFIIGLGNEYLENMTNPYKAQTWIQQHVQPYLSQTKITCITVGNEVFNSNDTQQMLNLLPAMQTVHDALVNLGLDQQVTVTTAHSFNILSNSYPPSSGAFREDLVQYIQALLDFHAQINSPFLINAYPFFAYKDNPDEVSLNYVLFQPNEGMADPNTNFHYDNMLYAQIDAVYAAIKQMGHDDVQVRISETGWPSNGDPEEVGATPQNAALYNGNLIKRIEQKQGTPAKPSVPIDIYVFALFNENLKPGPASERNYGLYYPNGSPVYNIGLKGYLPEMPLAAKSNSVAPPPLSSLPQPSYTTGIATSPNDNNRLITVIDNNALMK

SEQ ID NO: 107128 - protein, 151 aa, Glycine max
  Coding DNA Sequence Number=SeqID_15443
  Gene Ontology: Mol. function=histone deacetylase activity; Cellular component=nucleus; Biological process=histone deacetylation
  Homolog annotation: Hit_ID=A7PK34; Match level="QueryCoverage=51%, HitCoverage=18%, E-value=5e-37, Identity=89%"; Hit description =Chromosome chr15 scaffold_19, whole genome shotgun sequence
MPVAAFGCKKIIVVYNRNCGCNIKVLVASTTTLPHLFAISRIAGDVGSVYFGAKHPMKPHRLCMTHHLVLSYDLHKKMEIYRPHKAYPVELAQFHSADYVEFLNRITPDTQHLFLNELTKWIREDLKIQNMIQPRYIDMNLKEKIFYINAQ

SEQ ID NO: 107129 - protein, 222 aa, Glycine max
  Coding DNA Sequence Number=SeqID_15444
  Gene Ontology: Mol. function=zinc ion binding
  Homolog annotation: Hit_ID=Q10PQ2; Match level="QueryCoverage=59%, HitCoverage=17%, E-value=2e-10, Identity=32%"; Hit description =Transposon protein, putative, unclassified
  Pfam annotation: Domain name=SWIM; Domain location=62-93; Score=19.1; E_value=0.0032; Accession=PF04434.8; Description=SWIM zinc finger
MRAAAKVLVKKFEDEGLPTVKVAIVLNNGDSSFSNRDSWNHIKNLRRKNLDVGVIEAVFNYYLTSKIAKCGCQLYEFIGILCKHILMIFKAKGIVEIPNHFVLQRWTKDANKGLEAGYTEDKFVGASITPRILRMMLAQQQANILVDHAEDSEDMYKFIILQFAKTHKLTIIMQTNFNDADNMPLLESDRTNGNQHCTLEQMSKAPHLILGDPAYHKGEKKG

SEQ ID NO: 107130 - protein, 531 aa, Glycine max
  Coding DNA Sequence Number=SeqID_15445
  Gene Ontology: Mol. function=nucleic acid binding
  Homolog annotation: Hit_ID=A7QFA8; Match level="QueryCoverage=31%, HitCoverage=35%, E-value=3e-47, Identity=62%"; Hit description =Chromosome undetermined scaffold_87, whole genome shotgun sequence
  Pfam annotation: Domain name=RRM_1; Domain location=47-118; Score =59.4; E_value=1.2e-14; Accession=PF00076.13; Description=RNA recognition motif. (a.k.a. RRM, RB
MTEDQDNGELKIAAPAEGNTLTNVGWIVTAVGGRGACWRLQPQVKAVYVKNLPKNVTQEQLKKLFERHGKITKVVLPPAKSGQEKNRIGFVHFAERSNAMKALKNTERYELEGQLLECSLAKPQADQKSGGSNTQKPGPGLLPSYPPHVGYGLVGGAYGALGAGYAAPGLAQPLLYGGGQTPAGMAMMPMLLADGRIGYVLQQPGMQPQAPPSHHRGGRGGGGSGSGNRNAGSSTLPRPQLPLTPQTFSFFLLTFSSSSPTQPANPTLRFPSLILCESNPSLLHFFAPCNTKAKAEACLADKIIGPPFGGGLIDLSLIRSYRDHSVGHVWIQQVISPSYDTVPWRKQGFHECPCGEVALRDIILTPAMKLLLMTRLGISTEEEARAMTTTCSRVRLTWLTAVSPESLQWHTYMTISPMRASTPTSRLESWAFAHLPNVGYFEPKIDDLNDLIANKWKPTQVGLFSYFIKCEIDVWSYLSERAYDTTWLKWQHVIPLGDVVPPRGLQSWVQLREAKEEDGQGQGQGWWQGQQ

SEQ ID NO: 107131 - protein, 60 aa, Glycine max
  Coding DNA Sequence Number=SeqID_15446
  Homolog annotation: Hit_ID=A7QF99; Match level="QueryCoverage=55%, HitCoverage=11%, E-value=8e-08, Identity=81%"; Hit description =Chromosome undetermined scaffold_87, whole genome shotgun sequence
DNGRFVLKEVRTPIQEFLHAHREDGRLKLHFVQPEDEEKEEDGDDEDYDEVESVVEEEHV

SEQ ID NO: 107132 - protein, 168 aa, Glycine max
  Coding DNA Sequence Number=SeqID_15447
  Homolog annotation: Hit_ID=A2Q624; Match level="QueryCoverage=36%, HitCoverage=26%, E-value=6e-07, Identity=44%"; Hit description =Ribonuclease H
MVNGTLVILYDSTYIYAALVNHIRNLFTRDWNFSIQHIYKEGNCCADLLTRKGSSSDKLVIVDQCPPFLILALLSDACCTLHLGGVFLINDVEEHGINGNMAVHVDHKVMVQPHEPGGAGDANGWNNGSLGFADIGADAAPINAHLHFDFLFSIAIHSTSCVSSTEKG

SEQ ID NO: 107133 - protein, 438 aa, Glycine max
  Coding DNA Sequence Number=SeqID_15448
  Homolog annotation: Hit_ID=A7QF78; Match level="QueryCoverage=88%, HitCoverage=99%, E-value=1e-162, Identity=68%"; Hit description =Chromosome undetermined scaffold_87, whole genome shotgun sequence
  Pfam annotation: Domain name=DUF1022; Domain location=86-431; Score =650.7; E_value=1.2e-192; Accession=PF06258.2; Description=Protein of unknown function (DUF1022)
NGNLPEEAFSGNNPDDVLPEVVCEYFRKTQIILPEEAGFPILRYAFDIESMRRIQLPEPPSPTGRSGTPDIFESGVHTFVRRAVVIGNGFAASENQSVGLVRALGLSDKHLMLKSQEKKLMPSPSENGVSAGLLAVLEADVKEIVSFAHETYEKEGPLLVVACGRDTISTASSIKRLASENVFVVQIQHPRLHLKGFDMVITPKHDYYPLTPEGQEQVPRFLQSWITPRDPPDCHVVLTMGALHQIDFSSIRSVAASWHDEFAHVPRPLLVVNIGGPTRNCRYGVDLAKELAASLLNVLASCGSVRISFSVRTPQKVSNIIVKELGSNPKVYIWDGQGPNLHMGHLAWADAFVVTADSVSMISEACSTGKPVYVLGAERCRWKFTEFHKSLREQGVVRPFTGSEDISESWSYPPLTDTADAAKKVHEALAARGWKLKV

SEQ ID NO: 107134 - protein, 34 aa, Glycine max
  Coding DNA Sequence Number=SeqID_15449
VNYELPYLIDVFGSMDYQGINVDPTLSYRLLCGT

SEQ ID NO: 107135 - protein, 147 aa, Glycine max
  Coding DNA Sequence Number=SeqID_15450
  Homolog annotation: Hit_ID=Q8L7C3; Match level="QueryCoverage=37%, HitCoverage=38%, E-value=3e-16, Identity=74%"; Hit description =Expressed protein
FVKSPVSARNPLRKAVAMGNGRVTCFERNWLRADYSVIGFGLIGWLAPSSVPAINEKEEEDDDERHEKKNEIEMSDLDELDLAQRENLASVCLDCCLEFVIRIITLSNVKNSKESLFYLVEMKVTFNKTDIQTYLKLNMFGYGLYPS

SEQ ID NO: 107136 - protein, 63 aa, Glycine max
  Coding DNA Sequence Number=SeqID_15451
MAPMKPKRKRRRKARRKSKKAEEVFNRGPLRSMEARGWQSFSTSSMRERMSKSHYRVANEVGA

SEQ ID NO: 107137 - protein, 453 aa, Glycine max
  Coding DNA Sequence Number=SeqID_15452
  Gene Ontology: Mol. function=oxidoreductase activity; Cellular component=cytoplasm; Biological process=metabolic process
  Homolog annotation: Hit_ID=A7QF60; Match level="QueryCoverage=54%, HitCoverage=76%, E-value=1e-105, Identity=76%"; Hit description =Chromosome undetermined scaffold_87, whole genome shotgun sequence
  Pfam annotation: Domain name=Epimerase; Domain location=164-397; Score=-58.7; E_value=0.0086; Accession=PF01370.12; Description=NAD dependent epimerasedehydratase family
  Pfam annotation: Domain name=KR; Domain location=163-332; Score= -84.1; E_value=0.018; Accession=PF08659.1; Description=KR domain
  Pfam annotation: Domain name=adh_short; Domain location=162-327; Score=85.7; E_value=1.5e-22; Accession=PF00106.16; Description=short chain dehydrogenase
  Pfam module annotation: Pfam domain module=Epimerase::KR::adh_short; Domain location=164-397::163-332::162-327
MAMTSSRETIASVNRRGGGGHGGGHASSMGMHGGENGEHGNLPRPLGTNPVYAGAAAGSAHQRNNNHHHVDAPDKLPLVVAPGTPPLLVAPGRPLLVVALGRPPLSPLSHRPVKSRHVSRSGETHPSALPSRKSASYIPYFSIRKLRHGKCLTGLSYWKKGKVAIITGGASGIGEATARLFSKHGAHVVIADIQDDLGLSICKHLESASYVHCDVTNETDVENCVNTTVSKHGKLDIMFNNAGITGVNKTSILDNTKSEFEEVINVNLVGVFLGTKHAARVMIPARRGSIVNTASVCGSIGGVASHAYTSSKHAVVGLTKNTAVELGAFGVRVNCVSPYVVATPLAKNFFKLDDDGVQGIYSNLKGTDLVPNDVAEAALYLASDESKYVSGHNLVVDGGFTVVNMDDLKANTEYTGYTVASNVVQWFWEVVKAFNKEDMARLLQFVTGTSKVM

SEQ ID NO: 107138 - protein, 75 aa, Glycine max
  Coding DNA Sequence Number=SeqID_15453
MAVIVSGGDEGRLHGGEGELAFHGVHDLVRRVSGGGSARGRHPRAAIGGGGVRGRELGGIGRGNERDLSVWRVRK

SEQ ID NO: 107139 - protein, 2150 aa, Glycine max
  Coding DNA Sequence Number=SeqID_15454
  Gene Ontology: Mol. function=DNA-directed DNA polymerase activity; Cellular component=epsilon DNA polymerase complex; Biological process=nucleobase, nucleoside, nucleotide and nucleic acid metabolic process
  Homolog annotation: Hit_ID=Q6K777; Match level="QueryCoverage=97%, HitCoverage=94%, E-value=0.0, Identity=60%"; Hit description=DNA polymerase
  Pfam annotation: Domain name=DNA_pol_B; Domain location=491-1113; Score=-99.1; E_value=1.9e-05; Accession=PF00136.12; Description=DNA polymerase family B
  Pfam annotation: Domain name=DNA_pol_B_exo; Domain location=83-422; Score=326.4; E_value=5.1e-95; Accession=PF03104.10; Description=DNA polymerase family B, exonuclease domain
  Pfam annotation: Domain name=DUF1744; Domain location=1415-1796; Score=541.2; E_value=1.1e-159; Accession=PF08490.3; Description =Domain of unknown function (DUF1744)
  Pfam module annotation: Pfam domain module=DNA_pol_B::DNA_pol_B _exo::DUF1744; Domain location=491-1113::83-422::1415-1796
VTPKTFDLVATMSGDGRRRDRRDNRASKKRKLNRTPEEELEAKLGFDLFSEGEKRLGWLLTFASSSVDDEDSYKVYSCVDLYFVAQDGSSFKTKFRFRPYFYVATKDKMEIDVEAYLKRRYEGQIADVEIIEKEDLDLLSFDTVQQLMDVKRDLMPTVERNKAKSDAAEAFLSVSTERREHRPQDFLDCITDVREYDVPYHVRFAIDNVILFSDAVLLSIFIMTLAITRELDIRCGQWYDVGVSSNNGVTLEKKTDLLQRAEVRICAFDIETTKLPLKFPDADYDLIMMISYMVDGQGYLIINRECVGDDIEDIEYTPKPEFEGCFKVTNAQNEIELLRLWFSHMQEVKPGIYVTYNGDFFDWPFLERRATHHGFKMSDELGFKCDMNQGECRARYACHLDCFAWVKRDSYLPQGSQGLKAVTKAKLGYDPLEVNPEDMVRFAKEKPQMMASYSVSDAVATYYLYTTYVHPFIFSLATIIPMSPDEVLRKGSGTLCEMLLMVQAYKANVICPNKHQSDPEKFYNNHLLESETYIGGHVECLESGVFRSDIPSSFTLEPSAYQQLINNLDRDLQYAITVEGKMDLEFVSNYDEVKNAIMEKPPSIVTEEVCTACDFNRPGKTCLRKLEWVWRGETFMAKKSDYYALKTQIESEFVDDSEKNNKALTHYSEKSSKSFLDLPKAEQQSRLKERLKKYCQKAYKRVLDKPVTELREAGICMRENPFYVDTVRSFVLSGSSFRDRRYEYKGLNKVWKGKLSEAKASGNSMKIQEAQDMVVLYDSLQLAHKCILNSFYGYVMRKGARWYSMEMAGVVTYTGAKIIQNARLLVEKIGKPLELDTDDPKKKFTISYPCVMLNVDVAINNTNDQYQTLTDPIRKTYTTHSECSIEFEVDGPYKAMILPASKEEGILIKKRYAVFNDDGTLAELKGFEIKRRGELKLIKVFQAELFDKFLHGSTLEECYSAVASVANGWLDLLDGKDIADSELLDYISESSTMSKSLADYGQQKSCAVTTARRLADFLGDTMVKDKGLRCQYIVASEPKGTPVSERAVPVAIFETDAEVMKFYVRKWCKVSSDVGIRSIVDWSYYKQRLSSAIQKIITIPAAMQKVANPVPRVVHPDWLHKKVREKEDKFRQRKLVDAFKSMNRNEHSKRHDDSTRVPLVMDGDIVNELEDFGNKDRSSTCRPRPIIRHYEANNEQHSRKVNDQEDVEQQHNKPLQQNVYRSVDYQGWLQIKKRTWKDILERRKKQRLENSKKSDRVSSVLEQMNGKGNQGRSHVSSYLKRLEVDLTKRHWQIIQLVPSSLIGQFFAWVVVDGSMHKIHVSVPRVFYLNSRSAITEGFMGKRVNKTLPHGRHSYNLYEVSINEIQYGEASQKLAALLADPDVEGRAIYIGYFPASKTMTVVVVNPYQNKDLSPVFLERHFHDACQSLSIEPPPRNGINFKVDYVAHVKDAEAVMQRAINGHRENHMPMVAVIECPNVQLVKLGIRALDNFPCLSVPYNARDSQYQILGWQQVAAKTGMQRCAASVQWLNQRIALSRYAHVPLGNFELDWLIFIADIFFSRALHDNQQVLWISDDGLPDLGGINSEQNCFVDEVQQPALTYPGAYRNVTVELKIHHLAVNALLKYNLVNEMEGGTLLRFGHELDSGAFSTNDQNGFDESTSCVQAFRVLKQLIQRCLADAVTSGNVYADSILQHLYRWLCSPKSKLHDPALHQLLHKVMQKVFALLLAEFRKLGATIVFANFSKIIIDTGKYDLSRAKAYCDSLLRTIQSRDLFEWIELEPLQFWCSLLFMDQVSSIENLVVKKQLLIDSVGDLGDEDGEAPKRRGTAQSHGQQVQNLHHHGTRPWWGAFQQGLQGTVKGHWPDSTSSSLSLPWTSGTALLKVGGGKLVAMGGGGRCGAGEEGWCATFSIWFGIRVGYNYGGIPTKSDEAVNNESQVDIISSWNIAEYLPKKIQNGDSCTPSINIGAAEAFESEITEFTKEQIGSYFTHKLLGIVHDIGLHMKGMNRLENNQSTSGLPPLTGDVHRGDASLEFIKHVCAVLALDQSVQHEVLVLRKNLLKYVDVKEFAPEAKFHGPCHSFILSNVICSYCNDCRDLDLCRDSALLTEEWRCAVPQCAQPYDREVMENALLQTAHLGARKMQVNFVKKCKFS

SEQ ID NO: 107140 - protein, 39 aa, Glycine max
  Coding DNA Sequence Number=SeqID_15455
METNTNVSLRKKELPQHLVVGFWLGAVVNEGEAVVVIMK

SEQ ID NO: 107141 - protein, 487 aa, Glycine max
  Coding DNA Sequence Number=SeqID_15456
  Gene Ontology: Mol. function=oxidoreductase activity; Cellular component=mitochondrial outer membrane; Biological process=electron transport
  Homolog annotation: Hit_ID=A7PGD2; Match level="QueryCoverage=70%, HitCoverage=97%, E-value=1e-112, Identity=57%"; Hit description =Chromosome chr6 scaffold_15, whole genome shotgun sequence
  Pfam annotation: Domain name=Pyr_redox; Domain location=123-211; Score=15.6; E_value=0.00018; Accession=PF00070.18; Description =Pyridine nucleotide-disulphide oxidor
  Pfam annotation: Domain name=Pyr_redox; Domain location=5-105; Score =1.3; E_value=0.0036; Accession=PF00070.18; Description=Pyridine nucleotide-disulphide oxidor
  Pfam annotation: Domain name=Pyr_redox_2; Domain location=5-259; Score=42.1; E_value=2e-09; Accession=PF07992.5; Description=Pyridine nucleotide-disulphide oxidore
  Pfam module annotation: Pfam domain module=Pyr_redox::Pyr_redox::Pyr _redox_2; Domain location=123-211::5-105::5-259
MAEKKVVILGGGVAGANLAKTIQHQANVTLIDPVVEHRKEYFEIPWASLRGLVEPTFAERIVINHREYFKKGDLVVSSAVNITETAVVTADGQQIAYDYLVIATGHTEPIPKTRRERLDQYKGGPTGVELAAEIAVDFPDKKVTIVHKGTRLLEYIGTKASSKALKWLKSKKVDVKLEQSVDLSSSSEASKTYQTSNGETIEADLHFLCIGKPLGSTWIRETLLNNDLDADGRIKVDKHLRVKGKSNIFAIGDITDVQEIKQGMYASAHAQVVAKNLKLLIEGGGKEHKLGTYKAQPPISMVSLGRKIAVAQFPFMTVLGRLPGMIKSGDLFVGKTRKELGVEPNARVYGSSLHLYGVQLFHFYLMWGFTSHLYSNNLPLKYLWYLHRCSIHGTRRLDPPLGRLSIQGIPKVKDPSPPSYSSELFTKSNHLMALVAHYDLELHQMVRLGNRLRRAACPVDGVAVQVTKRREGQAIGVSLSDAYALSE

SEQ ID NO: 107142 - protein, 126 aa, Glycine max
  Coding DNA Sequence Number=SeqID_15457
MANSSDERCFNMALVAGNEATEKKGWSKAHCTIGQSLKLGEHHRPRIKKAIAGHPLVPGKRNTFHIEGDDNEAFIIRYALCHKTLQNGVDLSVHGELSLREGSMVLSKAMDSPLKTFRGKLHGIVL

SEQ ID NO: 107143 - protein, 928 aa, Glycine max
  Coding DNA Sequence Number=SeqID_15458
  Gene Ontology: Mol. function=transcription regulator activity; Cellular component=nucleus; Biological process=regulation of transcription
  Homolog annotation: Hit_ID=Q2HVX8; Match level="QueryCoverage=98%, HitCoverage=96%, E-value=0.0, Identity=59%"; Hit description=Helix -loop-helix DNA-binding
MMLLLIWEDYYYEPLPSPFPPRTVGRSNFPYQDGEGCWFSSESQLGIQEEDRVRVLINKMMVNNSVSIAGEGIVGRAAFTGNYQWILLNNFTRDAYPPEVYPELHYQFSAGMQTVAVIPVLPHGVVQLGSFSPIMEDIGFVNDVKNFILQLGCVPGALLSEDYSAKVSNEKFAGPVTVDPPVITSNCTPSVANGSNQLTNSPLASRPVAQPPHPLRGGINNYQGSLLTPQAYNPNQVFDGICQPKAHSMIKTNVCGQPKKTIVEAEAKVIPTNFDSCLQQHSVYNARSAFNELSSFNQSNLSDGSLKYMEQQTSGVGRQSQVIPNVNPSSALNMPRLKIDGGKILEQNQSSSDSSLLGGIPICSGSNLLRTNMINCSLSNPPKVSTNTSDFSGMYKVGFGLQSNNTTTNAVLCSVPNFTNQSVSNHMNLEGSGQKSLSIDLKQVWDAFASTDQRIDDDLLQAALKIPSLHLEEHVPMGDHISGFVQDCLSKDLTSQHMMKMNVKHAEADAQLPSGDDLFDVLGVDLKRRLLNGNRNELLATDSDAITEHLDKKATHMNLQGVGPNNSYSVNEAISESGIFSGTDTDHLLDAVVLKAQSAAKQNSDEMSCRTTLTRISTASIPSPVCKQVMPDHVAPRGLFDFPKTGVKTASAETSSLRSGCSKDDAGNCSQTTSIYGSKLSSWVENSSNFKRESSVSTGYSKRPDEVCKSNRKRLKPGENPRPRPKDRQMIQDRVKELREIVPNGAKCSIDALLEKTIKHMLFLQSVTKHADKLKQTGESKIVSKEGGLLLKDNFEGGATWAYEVGAQSMVCPIIVEDLNPPRQMLVEMLCEECGFFLEIADLIRGLGLTILKGVMEARNDKIWARFAVEANRDVTRMEIFMSLVRLLDQTMKGGASSSNAIDNNMMLYHSFPQATQIPATGRPSSLQ

SEQ ID NO: 107144 - protein, 54 aa, Glycine max
  Coding DNA Sequence Number=SeqID_15459
MKSLLEQHYGEIESRFWDEFEPELRRRWSLYDAKGSRHRVIVNLIREQPFMTQG

SEQ ID NO: 107145 - protein, 57 aa, Glycine max
  Coding DNA Sequence Number=SeqID_15460
MSTLTGVTKGTISVEESDNGHVAREIAVQHKFCGDEGEMVHWKLLSMAVHNGWREGE

SEQ ID NO: 107146 - protein, 93 aa, Glycine max
  Coding DNA Sequence Number=SeqID_15461
  Gene Ontology: Mol. function=microtubule motor activity; Cellular component=microtubule associated complex; Biological process =microtubule-based movement
  Homolog annotation: Hit_ID=A5AE19; Match level="QueryCoverage=64%, HitCoverage=9%, E-value=5e-15, Identity=68%"; Hit description =Putative uncharacterized protein
MKSNKDLALKQQVELYVKRVQDPDHGLQKVALESMRGAMVEKIEHMKLEAESKDKKSLEEIEPSLFDLEEKHTQANATIKENEFIISNLLKSG

SEQ ID NO: 107147 - protein, 35 aa, Glycine max
  Coding DNA Sequence Number=SeqID_15462
MTLKPLWHDSISVDTRHVSSNFMKGGKKNKKAEAT

SEQ ID NO: 107148 - protein, 177 aa, Glycine max
  Coding DNA Sequence Number=SeqID_15463
  Gene Ontology: Mol. function=phosphoprotein phosphatase activity; Cellular component=nucleus
  Homolog annotation: Hit_ID=A7QVR2; Match level="QueryCoverage=55%, HitCoverage=10%, E-value=6e-38, Identity=82%"; Hit description =Serine/threonine protein phosphatase
MDVDSSMVPEPDHDPPVQNHAERDQLGESPSPPPSEGGGSPAQPHQQPLPPTAAQVQQPNPLVGPRLAPTYSVVNAILEKKEDGPGPRCGHTLTAVAAVGEEGTPGYIGPRLILFGGATALEGNSAVSGTPSSAGNAGILFGHGNSGSLKPCFVGYFVLGTQCDQTSCEIFTNLAVL

SEQ ID NO: 107149 - protein, 186 aa, Glycine max
  Coding DNA Sequence Number=SeqID_15464
  Homolog annotation: Hit_ID=Q8VZ18; Match level="QueryCoverage=71%, HitCoverage=58%, E-value=5e-41, Identity=60%"; Hit description =Putative uncharacterized protein At3g44150
  Subcellular localization annotation: CTP_CleavageSite=87; ConfidenceScore=5.04e-01
MALKRASWLLLLPLLSAVAAAATNTNSVYHPCSDARIQRSDGFTFGIAFSSRDSFFYNQNQSLQLSPCDRRLSLSSSNAQLALFRPRVDEISLLTINTSSFFPDNYGGYMVAFAGKKYAARSPLAFVANSTYTVTSFTLSFRGVGCITCTGRETAVLHARGNRTWYASTNKIVQSEHHLAKAEEVQ

SEQ ID NO: 107150 - protein, 277 aa, Glycine max
  Coding DNA Sequence Number=SeqID_15465
  Homolog annotation: Hit_ID=A7PGA5; Match level="QueryCoverage=93%, HitCoverage=76%, E-value=1e-41, Identity=39%"; Hit description =Chromosome chr6 scaffold_15, whole genome shotgun sequence
MTSMEIFVSKLEVSFQTPKLRGAISCSSVGQGVDASKSYFQGPSRNNSDSRSQAHGEDMDVGYEGNHLSQSFEGLEQNFHDDIIKLTKEQNDAEDAEYARHREKGAKRKKCIYAQFCSLVSSVRVKLASLRKNWVSLWHKTLWDLFNSLFVFEDVKDTFEAVKLFIAVTKINAINAQYEEKLAALRAQHSSRRAEFLQRESHARQQQYQQIIRDPYPSGGMAPGDPHGEVQRGYSADHLDPYRERARFLGGGRDQGFEPRGPYPGGRVYDTGSRYYN

SEQ ID NO: 107151 - protein, 32 aa, Glycine max
  Coding DNA Sequence Number=SeqID_15466
MWYLWCQFCRMDYEHAEWKRLRLYSFSSLGRI

SEQ ID NO: 107152 - protein, 118 aa, Glycine max
  Coding DNA Sequence Number=SeqID_15467
  Gene Ontology: Mol. function=strictosidine synthase activity; Cellular component=endoplasmic reticulum; Biological process =biosynthetic process
  Homolog annotation: Hit_ID=A2Q2G0; Match level="QueryCoverage=64%, HitCoverage=26%, E-value=3e-17, Identity=53%"; Hit description =Strictosidine synthase
MRYVAVQLYAAHNSDAGRMGYFLVQVVLFRRKPYVIISVVALEKAGTSEILAILPGYPDNVRVNEEGDFWVALHCRRYMFAYYNGIYPEIRKIILKLPIPIKIQYLIQIGGHQHAAVI

SEQ ID NO: 107153 - protein, 300 aa, Glycine max
  Coding DNA Sequence Number=SeqID_15468
  Gene Ontology: Mol. function=carboxylesterase activity; Cellular component=nucleus; Biological process=metabolic process
  Homolog annotation: Hit_ID=A7PGA1; Match level="QueryCoverage=97%, HitCoverage=91%, E-value=1e-131, Identity=77%"; Hit description =Chromosome chr6 scaffold_15, whole genome shotgun sequence
  Pfam annotation: Domain name=Abhydrolase_3; Domain location=49-274; Score=284.0; E_value=3e-82; Accession=PF07859.4; Description =alphabeta hydrolase fold
MRSSRPSFNVPVIDDASVLWKDVVFAPAHDLQLRLYKPADSTGSKLPVFFYFHGGGFCIGSRTWPNCQNYCFQLTSRLRAVVIAPDYRLAPENRLPSAIEDSLLAVKWLQTQALSNEPDPWLSYVADFSRVFISGDSAGGNIAHHLAARLGFGSPELTPVRVKGYVLLAPFFGGTIRTKLEAEGPKDAFLNLELIDRFWRLSVPVGETTDHPVVNPFGPYSESLEAINFDPILVVAGGSDLLKDRAEDYARRLKEWGKDIEYVEFEGQQHGFFTIDPNSEPSNKLMLIIKQFIEKHFGKV

SEQ ID NO: 107154 - protein, 55 aa, Glycine max
  Coding DNA Sequence Number=SeqID_15469
MVWFALSHLGRFESVNDDAMAVENHSGTAYGGRKSRQRRIWRSEIAVAMLHRGGS

SEQ ID NO: 107155 - protein, 192 aa, Glycine max
  Coding DNA Sequence Number=SeqID_15470
MVKAVIQGNMYHSHKFGRRHLQIGPLLPLFFPTIPLFLNFPTQHLLLKFPKTHITRKLSLTSATFSNSIEQKQKHPPFPSHHWESSQASFLTCWGCLDFNWVSRMFNGMMDPDLMKIAQEQMSRMSPAELARIQQQACLFSSSSCLCNCVCDFCRILFCALRCNVRIKVLNCGRGRSFVVILDIAGNCSRDE

SEQ ID NO: 107156 - protein, 85 aa, Glycine max
  Coding DNA Sequence Number=SeqID_15471
MDSGRFQISIPGDGCPSNTFLEEIHQQFFIFRVCPHFSAVHLQEAIFPMQNARVVVVGDTEGPPKCLVGVHVSPVYNYEIYQQVY

SEQ ID NO: 107157 - protein, 205 aa, Glycine max
  Coding DNA Sequence Number=SeqID_15472
DDNDNSINDEDDRDISGDSDADGVDANIGDNRDGIGDRSGDNDGGVTDDGCDNIDSGDGGGIDSDDNDYVGDDDRGDGIGGNKKCNCQMGVHPKRVLRSRWGSERPIEHGCDRLERDEDPIEVGVAVLLAADERRKELVATAATVGLGDDDGEVVVGEEEFGGCLTVVVCGVLWWVTTLLEDVGGEGEGRHRASGGLTCDTRGGR

SEQ ID NO: 107158 - protein, 153 aa, Glycine max
  Coding DNA Sequence Number=SeqID_15473
  Homolog annotation: Hit_ID=Q9SJS1; Match level="QueryCoverage=36%, HitCoverage=7%, E-value=3e-08, Identity=51%"; Hit description =Putative Athila retroelement ORF1 protein
MARPARDLNALSARCGAERDYEGPIASGDVVLINLEIEATCRRNNAARRRREQDTEGSSHTSPPLSPHHAEMDGEQARRVTLEDFSNTATPQFFTSIARPEVQAANISYPHSLIQLIQGNLFHGLPSEDPYAHLASYIEICNTVKIAGVPEDA

SEQ ID NO: 107159 - protein, 76 aa, Glycine max
  Coding DNA Sequence Number=SeqID_15474
MLVKVLERWGTNGRTSIVVMMENLDVGWMTTMAIAARFGNGSRDVCRWWWWWWVRVVSKRMKATFVRVLKLLYFYS

SEQ ID NO: 107160 - protein, 315 aa, Glycine max
  Coding DNA Sequence Number=SeqID_15475
  Homolog annotation: Hit_ID=Q5XM22; Match level="QueryCoverage=23%, HitCoverage=41%, E-value=7e-27, Identity=76%"; Hit description =Resistance-like protein HAAS-2
MVRTRGLGHALARVIGRGRQDEHIAVDEGVPQVTKDVPHMAEDVPQMTEDVPHMVDDVPQMSEDAPQMTADVDVTIAEDLGRDGVEGSHADEGFPGGPRDPSVLTSFAKHVAHAIWTGQEHPEPNLVSHGRKVALIGRLVPEIKGLVAATGLSPLIGCLVVTGDLGLISTFVEMWHRETNTFHLPEARAETVRARRAYVRLSWVREIYEMRCQARRWIVAARAYLMHLVGCTIFSNKSATYVHVVHLEAFHDLGQSGGYVWGAATLVHMYDQLDEASRTTTGQIGGAESMSTFRVCINASLMMRMRRRSLVPPGG

SEQ ID NO: 107161 - protein, 283 aa, Glycine max
  Coding DNA Sequence Number=SeqID_15476
  Gene Ontology: Mol. function=hydrolase activity; Cellular component =integral to membrane
  Homolog annotation: Hit_ID=O80889; Match level="QueryCoverage=56%, HitCoverage=63%, E-value=2e-52, Identity=68%"; Hit description =Putative carboxymethylenebutenolidase
  Pfam annotation: Domain name=DLH; Domain location=120-283; Score =43.7; E_value=3e-10; Accession=PF01738.9; Description=Dienelactone hydrolase family
MTVKTRNVKLDWWPRDLRRWWRSGRHVRETLAHGLKLVGQVRMFLGEGSNGLLEAICGGAAGSMLCHGKGQVRPVVESKRKKMECLGKPFIYNCARTAMVFGLCGIPLWPFFMCFFWCQRDVFHVLSTVGAIRIVVIQEWWGVDFEIKNHAVMISQLGRGYKALIPDLYKGKVGLDVAEAQHLFDGLDWQGCKHMLPVILIFPYIGIHHEKLKIQQFLVGVTGFCMGGALSVASSVLVPNVDAAVAFYGAPSSELADPAQAKAPIQAHFGELDNFVGFSDVTV

SEQ ID NO: 107162 - protein, 174 aa, Glycine max
  Coding DNA Sequence Number=SeqID_15477
MARTRGLGRAIGRLIGRDRQDDRDAVDVSERRRPTASARRQRVHQMTADAPDMAEDVPDMIEDVPDIAEDAPEMTANVQGADGAEGSHADDAEGFPGGPRDPSVLTSFADHVAHAVWSGQERPDLKLVSHGRKVTLIGRPVPEIEGLVGATGLSPLIDCSIVTGDPGLVSAFVE

SEQ ID NO: 107163 - protein, 69 aa, Glycine max
  Coding DNA Sequence Number=SeqID_15478
EKSFCLSQKLSCNQETSCLLDYENCNQETGCLLENLEHKGEGSQGVGTMRTHGGDEEVVGEDDDGDGST

SEQ ID NO: 107164 - protein, 52 aa, Glycine max
  Coding DNA Sequence Number=SeqID_15479
MTITKVVSSGTDDGGDRMMMLMVVAVKCADGDSGNRNGGMIVVVMTTTIMVG

SEQ ID NO: 107165 - protein, 76 aa, Glycine max
  Coding DNA Sequence Number=SeqID_15480
  Subcellular localization annotation: CTP_CleavageSite=44; ConfidenceScore=5.28e-01
MTVVVFLVSELLSEPSKTSCARSTFTPLNANLPPELRVAFRCLSANPKVVALTLFTKELLTSSLPPSVHRLGSDPS

SEQ ID NO: 107166 - protein, 87 aa, Glycine max
  Coding DNA Sequence Number=SeqID_15481
MVYEVYAQLPPPVPHQTTMVFYLQDIATGPNATVTPVAGIKGGDWTYTTFGSIFVVDDPALAVSVSCVWDWQVPLCKGLCCVANCVL

SEQ ID NO: 107167 - protein, 64 aa, Glycine max
  Coding DNA Sequence Number=SeqID_15482
MKKQQWKRSGRQRRRSERRRHPLGNKPWKKELLHQDDPWIRSLEIMLQWRKRKRERKREGGARN

SEQ ID NO: 107168 - protein, 69 aa, Glycine max
  Coding DNA Sequence Number=SeqID_15483
MVRELDLIEQLRDLSLVCEVAPKSVRLGALRISTISRILSIEINDKICATENLAQQQYQGRTISVRSMG

SEQ ID NO: 107169 - protein, 97 aa, Glycine max
  Coding DNA Sequence Number=SeqID_15484
  Subcellular localization annotation: CTP_CleavageSite=18; ConfidenceScore=5.19e-01
MHVCASCHPANQRVSKVVATYPSAGGRRLTRGMRVPRKEYARSRHQHLFEENVGKTGKDAIYELLSERFGSCIYARGRVFPFAPTYSSIWDEKIRPT

SEQ ID NO: 107170 - protein, 156 aa, Glycine max
  Coding DNA Sequence Number=SeqID_15485
  Homolog annotation: Hit_ID=Q84VI1; Match level="QueryCoverage=74%, HitCoverage=17%, E-value=8e-47, Identity=83%"; Hit description =Envelope-like protein
HSESFAVKLPIAFPTVLCGIMLSQHPNMLNYTDSVMKRESPLSLHYKLFEGTHVPDIVSTSVSTSGKAAASGAVSKDALIAELKDTCKVLEATIKATTEKKMELELLIKRLSESGIDDEEAAEEEGEAAEEEEEAAEEEEDAAEETESDDDSEATP

SEQ ID NO: 107171 - protein, 79 aa, Glycine max
  Coding DNA Sequence Number=SeqID_15486
MGEMLATELAQASKNLADYIIIPFLTYEMLQNRTNCATMLPFEFRHVTELHNLPDDGCQVPQNGQMKVACHQAKVPGRN

SEQ ID NO: 107172 - protein, 301 aa, Glycine max
  Coding DNA Sequence Number=SeqID_15487
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIVNKWRMISWIDVQNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWRCQGRYLTG

SEQ ID NO: 107173 - protein, 115 aa, Glycine max
  Coding DNA Sequence Number=SeqID_15488
  Homolog annotation: Hit_ID=A5BP71; Match level="QueryCoverage=65%, HitCoverage=19%, E-value=5e-10, Identity=46%"; Hit description =Putative uncharacterized protein
  Pfam annotation: Domain name=zf-CCHC; Domain location=88-105; Score =9.6; E_value=0.055; Accession=PF00098.14; Description=Zinc knuckle
MVIIVNAEACGYVNLKYYQYIDVVYTNEHILKAYSAQWWSIGNEAVIPPSNDAWTLIPDPTTIRAKGRPKSTRIRNEMDWVEPSEHRQKCSRCGAEGHNRRRYPIQSEHGSCSNH

SEQ ID NO: 107174 - protein, 38 aa, Glycine max
  Coding DNA Sequence Number=SeqID_15489
MSKMKGIGNYVSGSCTSEHNMQTMKIECMQLAEQKHAK

SEQ ID NO: 107175 - protein, 250 aa, Glycine max
  Coding DNA Sequence Number=SeqID_15490
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLEIPSGVANCHNLPFGGRAWRDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107176 - protein, 222 aa, Glycine max
  Coding DNA Sequence Number=SeqID_15491
MSSQSESYTPCLEDYTSSPSKDYTGLHALPFKGPHILPFRGLHVLAIRGLHVLTLRGLHALTFRGLHVLVLRLHALTFKQLHVLTFRGLHSSPSEDYTSSPSEGTTCPHLQRATLPRLQRTTRPHLQTTRPPLQKRLHVPRHQRATVLTIGGLHALAFRGLHALAFRGLHVLPFRGLHVLAIRGLHALNFRGLHVLGFRGLHVLTFRGTAHLRFQRAPHLRL

SEQ ID NO: 107177 - protein, 158 aa, Glycine max
  Coding DNA Sequence Number=SeqID_15492
MAASDHAILYDRTHTHQEKHVGTLFTRCIAVVFMEELMNPVVVYPKMMLLKSYRQGGSFNQNQGQGWRSHPRNQFNKDQGGPSNKPPNQGPNLYERTTKLEETLAQFMQVSMSNHKSTESAIKNLEIQVGQLAKQIAGNFSGGFGANTEKNPKEECKA

SEQ ID NO: 107178 - protein, 66 aa, Glycine max
  Coding DNA Sequence Number=SeqID_15493
MIIKESIHVAFDEINPIRPRKEILDDISDSLEGIHIHGEELKGKGKGNDEDFQIHETKTSIDLPRE

SEQ ID NO: 107179 - protein, 49 aa, Glycine max
  Coding DNA Sequence Number=SeqID_15494
MVTKPQCAHQPGQHRSHWAFSGGALVLANMDDKELPSPVNSDVVMRYYA

SEQ ID NO: 107180 - protein, 265 aa, Glycine max
  Coding DNA Sequence Number=SeqID_15495
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSPISAAKIPPKGNNSNLKTFQASSLMVRDAIGSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107181 - protein, 172 aa, Glycine max
  Coding DNA Sequence Number=SeqID_15496
MEGKDLGSTGGPHYVKIQNKRAIPPYDLPPNYTPPNVAYTPSENVNNSILILIESQQPQSDHAHVSQPMGETHEIPRHNLADFEPCLEYATEGKVVGGIPLQNTLEGPQFRPQPQPFYGKMVGYTPSSFADLVFVGERIKVGLERGKSDHPALINAKIGANEEDENREKPLL

SEQ ID NO: 107182 - protein, 112 aa, Glycine max
  Coding DNA Sequence Number=SeqID_15497
MTKGNPGDLQPFDPEIDRTFHRLVRHSVNPDHYVHFEYFVVGDFEHSDFEHSTTNFHTENMAQPLPRERTLREMAAPDFTYESLCIQYPDEDVPYVKILISILRSSILSVPP

SEQ ID NO: 107183 - protein, 94 aa, Glycine max
  Coding DNA Sequence Number=SeqID_15498
MGEEVAAQLAQASWNVAELYGLRATMLVLTSRMLRDFMDYTTVGVATYPSAGGRCVTCGMRVPRKEYARSRHQRLFEENVGKTGKDVIYELLSE

SEQ ID NO: 107184 - protein, 84 aa, Glycine max
  Coding DNA Sequence Number=SeqID_15499
MDRCPLPSSGQTESTATRHPVNIGCLIYLEWVRVSSPGRAELAWVSNPCTKWVKKGEEEGFCTKNSPPSFKEARAHGTHGFYSP

SEQ ID NO: 107185 - protein, 174 aa, Glycine max
  Coding DNA Sequence Number=SeqID_15500
MASRKLSAKRSRRDAAVEGTSAAPEFDSHRFRSAEHQQPFEAIKGWSFPRERRVQLRDDEYTDFQEEIARRRWTSLVTPMAKFDPEIVLEFYVNAWPIEEGVRDMRSWVRGQWIPFDADALSQFLGDPLVLEEGQECEFSQRRNRADGFDEEAIAQLLCIPDVDDVAAQQCPTQ

SEQ ID NO: 107186 - protein, 156 aa, Glycine max
  Coding DNA Sequence Number=SeqID_15501
  Homolog annotation: Hit_ID=A7Q7F0; Match level="QueryCoverage=51%, HitCoverage=10%, E-value=4e-11, Identity=48%"; Hit description =Chromosome chr18 scaffold_59, whole genome shotgun sequence
MGFIGFWKLVVVQNLPYDDMLRVGKIPKLLPHRLFPFARLWWPRLGNFGAVVLESVSGLKAVDFRQPEVLLVKKVHQFEVTKSPLEALAYMGLNGEYNLKELMTLQWYFHTYALRQFLIVLRSLMALITTYSSSFDDNKDDVGTSGLRIIKKRGLN

SEQ ID NO: 107187 - protein, 95 aa, Glycine max
  Coding DNA Sequence Number=SeqID_15502
MDEHLQNGKEMANTMMKINKKLEKMFNNPYGKVSRSFAVRWKDEPTWHLLHSSGSMHSVTYNQDLVSPTLLAGWTKLRQLYGLTENHQVTLTQYG

SEQ ID NO: 107188 - protein, 92 aa, Glycine max
  Coding DNA Sequence Number=SeqID_15503
IASFPFFRRFPQINVGGDSARIPFVEHASRESRVALPPKGRLRQVAKALVTRGIVELRSVSIEDQLSDLVTKLVTKDKLIYVREGLGMFPVE

SEQ ID NO: 107189 - protein, 81 aa, Glycine max
  Coding DNA Sequence Number=SeqID_15504
  Gene Ontology: Biological process=transposition, DNA-mediated
  Homolog annotation: Hit_ID=Q1J7G7; Match level="QueryCoverage=45%, HitCoverage=52%, E-value=9e-12, Identity=89%"; Hit description =Transposase
MKHFTDTLISANIGTKAGTGPPLEVDGIDKLDQVLQWLLFLSAVPPVQLLTGWCVTAKAPPDISAGKCSGHAARNHHTRRA

SEQ ID NO: 107190 - protein, 98 aa, Glycine max
  Coding DNA Sequence Number=SeqID_15505
  Homolog annotation: Hit_ID=Q6UUU1; Match level="QueryCoverage=81%, HitCoverage=54%, E-value=2e-32, Identity=85%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVSFRCYGRVCLIPRLTLSFG

SEQ ID NO: 107191 - protein, 105 aa, Glycine max
  Coding DNA Sequence Number=SeqID_15506
RSFLFGAAVVASFGYRKERDGSWVKKCTQPNDDEGQLPVEGDSSLLQSILDRFDGLQTYVGERFDALEQQVDTRFNEMDSRITKVEEDVTFIRTCFDLPPPPPSS

SEQ ID NO: 107192 - protein, 186 aa, Glycine max
  Coding DNA Sequence Number=SeqID_15507
QKLLAEKTRKKLEEAAQSGSVDGVIDPPSPARRHVKWKMACTKKTGEMTTEAAKEIAEKIISHFQDVITAAIGRPEHPRRACATGAGVTIKQYFGSAPWTKSDSVAHGNVQLDAVPVSVPDEISGTCIASGASDNSHLPCLIDTSGQVFIIAVVSPAKPPQKPYPEVDDPLYLMTLTICRNMLVIP

SEQ ID NO: 107193 - protein, 52 aa, Glycine max
  Coding DNA Sequence Number=SeqID_15508
TTQVNQEQVKSSRIKKNSRLKKKVYNQESRFKIQDLKNQDQDSRMKKRLNQD

SEQ ID NO: 107194 - protein, 121 aa, Glycine max
  Coding DNA Sequence Number=SeqID_15509
MMRREDFHDAPLLGNHETQLLTQKWKTHERQSISFMWLRKRIRMEDCLEGPFLGNHGTQLQTQSGGHMNDNKIHSWGSGKRVRMEDCLEGPLLGNHGTQLQLESGGHMNPKQFIHVGSGKG

SEQ ID NO: 107195 - protein, 252 aa, Glycine max
  Coding DNA Sequence Number=SeqID_15510
  Homolog annotation: Hit_ID=A5AKA7; Match level="QueryCoverage=54%, HitCoverage=26%, E-value=3e-07, Identity=29%"; Hit description =Putative uncharacterized protein
MVIYQSLFYDLTQLSSEGVPFEGALNDDWKFDFFVHDACRLVCTNQVDMTRMLLAGSLALESRILHYLIVCILLPRSSNLAQVSEEDLIVMWAFHTGRQIDWAHLVRYRMHKALRLNAPLPYPHVVTLFLQHFNIPLDSEPYVPIKRSFLIGAAVIASFGYRKERDGSWVKKGAQPHDDEGHLPVGEDSSLLQSILDRFDGLQTYVGERFDALEQQVDMRFDEMDSRITKVEGDVTYIRTFFDLPPPPPPSS

SEQ ID NO: 107196 - protein, 219 aa, Glycine max
  Coding DNA Sequence Number=SeqID_15511
  Homolog annotation: Hit_ID=Q6UUU1; Match level="QueryCoverage=27%, HitCoverage=40%, E-value=2e-18, Identity=78%"; Hit description =Putative uncharacterized protein
RVPFAIQAAQLLGRAIGAGLFAITPAGERGMCCKAIKLGNARVFPVTTLANWSSTAVAAALELVDPPGCRNSISLSIESVWNGQYKDVKPECNMLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107197 - protein, 46 aa, Glycine max
  Coding DNA Sequence Number=SeqID_15512
MATAMKSISLKPLGRDGTVRRHLVEEIPIVVPRYTVKPLATGAKAG

SEQ ID NO: 107198 - protein, 125 aa, Glycine max
  Coding DNA Sequence Number=SeqID_15513
MVEEPRRLTLEDYSSSKAKRWIHSLKGNSLKNCDEVVEKFLNKDQDGPSNRPPQQGPSLYDQTMKLEETLAQFMQVSMSNHNSTESAIKIWKSKWDSWLSNWQTVLLAALELILRKIQRRKVRME

SEQ ID NO: 107199 - protein, 134 aa, Glycine max
  Coding DNA Sequence Number=SeqID_15514
MSGFTRDSPQISASPHQLDLAPYASEPYNAQWNAPGLLRDKHTLRSNHILGEMEVDEPWLGLWLPLNYQVDMGASQHRTLELGWCSSDFVVDLGVTFVDNWAVGKEKVPLELPGLSTLGRILLKDSCPLFAHVL

SEQ ID NO: 107200 - protein, 82 aa, Glycine max
  Coding DNA Sequence Number=SeqID_15515
MVKVGTSYVADSTSHFEAPKVDVYAHFPGSSGVHGFYQLFPPVQLLKRGGVIRNSAKAYRRTSALASVKRCTMSERNHHTRG

SEQ ID NO: 107201 - protein, 168 aa, Glycine max
  Coding DNA Sequence Number=SeqID_15516
MELGLASSLSQFYRKNWICVHSLSAWLSRLAHESFFLRHAKRVTCAKCPMASRKRKATALVSHAELIRRNWHKQLTNLTKGSIDVAIVKEFYTNLYVPDDKFPKQVRVRGHLIKFDVDSLNTFLEIPVVMEQRESLPSYSRFSRLRPDPQELAAWLCIPRRGFVFNAE

SEQ ID NO: 107202 - protein, 226 aa, Glycine max
  Coding DNA Sequence Number=SeqID_15517
  Gene Ontology: Mol. function=zinc ion binding; Cellular component =intracellular
  Homolog annotation: Hit_ID=A8GDM7; Match level="QueryCoverage=74%, HitCoverage=40%, E-value=2e-75, Identity=81%"; Hit description =Integral membrane protein, PqiA family
  Pfam annotation: Domain name=PqiA; Domain location=26-221; Score =239.2; E_value=9.1e-69; Accession=PF04403.4; Description=Paraquat -inducible protein A
AGLCRAGGRLRAGRLYRADHYEPADADSSQRGGAVGTLLPAVGAARTARAVAGLPELPPYRLQKSWAALIASIVLLIPANLLPISVVYVNGARREDTIFSGILGLASGNVPVAAVVFIASILVPFTKVLVMLTLLLSIHFKCEQGLKTRIRLLRAVTWVGRWSMLDLFVIALTMSLVNRDQLLAFTMGPAAFYFGAAVILTIMAVEWLDSRLIWDAHATGNADYTD

SEQ ID NO: 107203 - protein, 142 aa, Glycine max
  Coding DNA Sequence Number=SeqID_15518
  Homolog annotation: Hit_ID=UPI00005A9633; Match level="QueryCoverage =75%, HitCoverage=21%, E-value=3e-08, Identity=39%"; Hit description =PREDICTED: similar to Copia protein (Gag-int-pol protein)
MQMRLNWHKMKILTLISVTFEVKSTTQKKTMLICGILAQAITNHMTGHKEWFVNIDDKVKSKIKFGYSMQMEDSQLKMFDSIKRLILSPFVNEIDLIQDVKFRLDFNGPLEEEVYITQPPSYVVAGQEDKVYKLNKALYGLK

SEQ ID NO: 107204 - protein, 66 aa, Glycine max
  Coding DNA Sequence Number=SeqID_15519
MAGSRAIDTPPPPLEFTSAHPQRRLEALPSTHDRPIGDLSPKAEAKDVKEALLGGNLVPFESMLVI

SEQ ID NO: 107205 - protein, 34 aa, Glycine max
  Coding DNA Sequence Number=SeqID_15520
MAKEMIHEKAIWFRGCSPRQAGYLKLEVSACPDE

SEQ ID NO: 107206 - protein, 79 aa, Glycine max
  Coding DNA Sequence Number=SeqID_15521
MPFCGREKARLTGALSKGGKMRGVATNVEKSGALAPTYPPSKRKSDLRSPFLRVNHTISFYLKGDHLKVLDLKNDPLTW

SEQ ID NO: 107207 - protein, 76 aa, Glycine max
  Coding DNA Sequence Number=SeqID_15522
MWGRLAEVVEIQLLNNRLSWQVPAKPNRYRKASLSHRHLSKRMSVHPQKMNSLSAVGTLSEFFRERIYSMNTDELA

SEQ ID NO: 107208 - protein, 145 aa, Glycine max
  Coding DNA Sequence Number=SeqID_15523
MAAIDIAILRDRAHIPTKKSLLELTSQDALLAHNKLLSKQLEALTETLRCAICGGAHNSGCCIPNEEPTHEVNYMRNQPRQNFNAGGYSGFQHGQPYNSQQGQWRNHPGNQFNKDQGGPSNRPKQQGPSLYDRTMKLEETLAQFM

SEQ ID NO: 107209 - protein, 54 aa, Glycine max
  Coding DNA Sequence Number=SeqID_15524
  Homolog annotation: Hit_ID=UPI0000ECBAF8; Match level="QueryCoverage =72%, HitCoverage=45%, E-value=2e-14, Identity=100%"; Hit description= UPI0000ECBAF8 related cluster
VDGIDKLDPSFYNVVTGKTLALPNLIALQHIPLSPAGVIAKRPAPIALPNSCAA

SEQ ID NO: 107210 - protein, 136 aa, Glycine max
  Coding DNA Sequence Number=SeqID_15525
  Homolog annotation: Hit_ID=A0PAV3; Match level="QueryCoverage=27%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATEGWCVTAKAPPDISAGRCSGHAARNHHTRRAKCAATGRVPFAIQAAQLLGRAIGAGLFAITPAGERGMCCKAIKLGNARVFPVTTL

SEQ ID NO: 107211 - protein, 164 aa, Glycine max
  Coding DNA Sequence Number=SeqID_15526
MAQLISDVIYCLQGSRPQDAQWTRRSPIGPWGFQLWDRAHKTPNGPEEVQQGLGVSNSGYGPLTVLQGARSPSEESHPQRHPVDPEKSNRALGFPALVTGLCSPTGCPFHPARSHHHDIGIAPARHPVDPKKSNRVLELPSSNYGPLSVLRSACRPQQGHQAPY

SEQ ID NO: 107212 - protein, 142 aa, Glycine max
  Coding DNA Sequence Number=SeqID_15527
LRAQLVARTTVLLAEFYVISDNTIIVTQRIIKKLPIEANFRLTNCKSTLAKPPPYTLANLVVDVEASIGGRDSDLEGERKRGRRTTCHRGCHGGERRGQGQEGFGVEIETAKGREREGREVRIIGLERERERERKSRIVSGF

SEQ ID NO: 107213 - protein, 126 aa, Glycine max
  Coding DNA Sequence Number=SeqID_15528
  Subcellular localization annotation: CTP_CleavageSite=14; ConfidenceScore=5.35e-01
MVKVGTSYVPINVSFSPKVGPGLPVGKPVVPFAAFNESAQLLREGRSGGLCVLRQGAKRSVHTGLLCWHCNAGCPVNASCGRRKKAARASVEYVNTTHYRANWSSTAGGRSELTPPRVRIRLRDGI

SEQ ID NO: 107214 - protein, 99 aa, Glycine max
  Coding DNA Sequence Number=SeqID_15529
MRTCISKETKLPTDQSNICFLDEKQGVYRGRRETLGSTKIEENHSKCIDLTQGKVYGELGLWLKACRMDGHDICQGVGLASGSGIKGMSHIISMTHMQQ

SEQ ID NO: 107215 - protein, 182 aa, Glycine max
  Coding DNA Sequence Number=SeqID_15530
MAPTRHPLDPDKSNRALGFPSLITELCQSFGVPVTPSKVIRPPITRAFVEKYCTQRQVQGDAPQAADAPPPHQAGPAGLFDTEQYLRHLVRQQAANHRAHVQTHDCLYQMSLSLQSQGFTSFPCPTPDQFRAEVALPGDWPKAQAGEAPAEAPAEAPDEADEAREDEEMTDLLDFLGGSGAT

SEQ ID NO: 107216 - protein, 134 aa, Glycine max
  Coding DNA Sequence Number=SeqID_15531
  Pfam annotation: Domain name=G-patch; Domain location=1-42; Score =29.9; E_value=9.4e-06; Accession=PF01585.14; Description=G-patch domain
MVARVMLGYGYEPGMGLGKNNGGRTSLVSTRENRRMFGLGYKPTQVDIRKCIAERKNRGQGSRLGQQAEGAPPCHISRSFISAGLRHKGQVAAICEDDSPRRSDDESLEGTNTQDPAVDFEQEVRRMQSEEDED

SEQ ID NO: 107217 - protein, 98 aa, Glycine max
  Coding DNA Sequence Number=SeqID_15532
MGPKSTLRLMRTQGPSLASLAQSSWSLLSNVLEGGLHVLAFRGLHVLAFRGLHTLVFRGLHALAFKGLHGLTFIKLHALTLRGLLDKWPQISKKGGLN

SEQ ID NO: 107218 - protein, 318 aa, Glycine max
  Coding DNA Sequence Number=SeqID_15533
MAPRKLASKRSRKDKVAEGTNSAPEYDSHRFRSAEHQQRFKAIKGWSFLRERRVQLRNDEYTDFQEEIVRRRWASLLLGYPLVLEEGQECEYGQRRNRFDGFDEEAIAQLLCIPGQDFARTAAGRQVRIMCTNMTTLTQIWMTLLLNNIQPSDHNSDLPLPKCQLVYAILTWMSIHVAQLIVDAIYIFAGMAPTRHLLDPDKSNRALRFPALITGLCQSFGVPIAPSKVIRPPITRAFIEKYCTQRQVQGDAPQAADAPPPHQAGPAGLFDKEQYLWHLVRQQVANHRAHPAEPGFYFFSVPYSGPVQGRGRMAWRLA

SEQ ID NO: 107219 - protein, 86 aa, Glycine max
  Coding DNA Sequence Number=SeqID_15534
MARAGDNGGIYHQLDEYQRLFLDAWTTQMQRLLNRNKEEPYRRIAKSSSFALKPLSPKEEFKDVFPKEIPHGLPPSRSINIKLISF

SEQ ID NO: 107220 - protein, 47 aa, Glycine max
  Coding DNA Sequence Number=SeqID_15535
MIGTSKPYTGAMRGIVHEPQVPSYKVMMKDNNWYLKALRWGNEGHRA

SEQ ID NO: 107221 - protein, 224 aa, Glycine max
  Coding DNA Sequence Number=SeqID_15536
MIMRGQDIYSSQEETISSPSFSGSEDEVRGEDSSEEVYPCEEKENKAKNSSKKIVKKENHFATKGDIKRALLLKQSFYLLLSRETSHNTAIPVELEVIPQVKELLDGGLVRKSLTLCALLVPKIGIMRHRIPMIGGMINVLSGATLFSKITYASNIFMIHIHRDSLGSDQRVPTNPKRIKIIPEWPTPPSVEGRSPEFQEPLDLRSNPFQGGRNDVILPSKGIG

SEQ ID NO: 107222 - protein, 122 aa, Glycine max
  Coding DNA Sequence Number=SeqID_15537
AQGDAPQATDAPPPPHQADPTGPFGMERYLQHLVHQQAANHRGQVQIHECLYQLSLNQQSQGFAPFACPTLDQFRAKVAWPGDWPEAQVGEAPAEAPGGAEEARMDEEMTDLLGFLGGSGAT

SEQ ID NO: 107223 - protein, 116 aa, Glycine max
  Coding DNA Sequence Number=SeqID_15538
  Subcellular localization annotation: CTP_CleavageSite=49; ConfidenceScore=5.68e-01
MKDQINTSSGDVSSTSRTSQSLTDSSHALKMASSSSSVLCQSSHSLADRCKRRKSGALNGWLAKPTDWLSEQIKISTSQTYLINLKLKEEVRHKTDIKESSLNHSLMANVYSSTSV

SEQ ID NO: 107224 - protein, 144 aa, Glycine max
  Coding DNA Sequence Number=SeqID_15539
MRLHCDQASRRPNMTTDQPPLLMAHIDPVPSGVVNYRNLPFGEGTKRPLRWAKGASPIEGKRVELPPTFIQGKHRENQNGKVEGLRILKMRGNFNGGLPESAPDHQPKLLNPRSLVKLNIQASSTDPSFKTPPDLDNPLRFRIT

SEQ ID NO: 107225 - protein, 97 aa, Glycine max
  Coding DNA Sequence Number=SeqID_15540
  Subcellular localization annotation: CTP_CleavageSite=32; ConfidenceScore=5.09e-01
MMRCCTLIDWPDSLKTVPSGVANCLNLPFIGRAMRGSRVRLPREEGTRSRHQRLFKENVGKTGMCGPRTLIVKGSRVFFTHGEGISTHASVTRDDNL

SEQ ID NO: 107226 - protein, 179 aa, Glycine max
  Coding DNA Sequence Number=SeqID_15541
MASLEGLDWLSKLKVIDEENFEASEEDEEVRALKLELGKARLAKEKFKSAATHIRKECTDLQEENAATTKALEQETKRARKEEYGREKFRGALWGSNNELNLRREERDRSQVHGMILKEELVACVRSKRSLAQHLEATEQSMLAIIVQYKEELNQSMAHEQKLVEDFAQVYAEKKQEGG

SEQ ID NO: 107227 - protein, 210 aa, Glycine max
  Coding DNA Sequence Number=SeqID_15542
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=24%, HitCoverage=50%, E-value=3e-23, Identity=98%"; Hit description=LacZ protein
MHPPPKEFGAMLHDCLSVDPLVQSSILPFFSEPYECHCLSLSMLPPPKEFGAMLHDCLSVDPLVQSSILHFFRSPTNVIAKRCSCILHPKSLELCFMIAKVWTLYPGDPLVLERPPPRWSSNSPYSESYYNSLAVVLQRRDWKNPGVTQLNRLAAHPPFASWRNSEEARTDRPSQQLRSLNGEWDAPCSGAFKRGGCGGYAQRDRYTCQR

SEQ ID NO: 107228 - protein, 221 aa, Glycine max
  Coding DNA Sequence Number=SeqID_15543
  Homolog annotation: Hit_ID=Q6WAY6; Match level="QueryCoverage=95%, HitCoverage=41%, E-value=4e-08, Identity=23%"; Hit description =Putative uncharacterized protein
MGSNQAPSFKKRFYHVKIKSLKVSNLQELGQRMDQLQRQAFRKTYGKIWDLVMVEVFVEAIASLTQYYDQPLRCFTLYPSMAKIAKVVKVSVQELDRVKQNRNGVVGIPKKNLEEKAKFLVDQGEWASFIDVLALLVFEVVLFPNVDGLVDLAAIDAFLAYHHSKESPVVTVLVDAYDTFDQRCEKSSTRIVCCTTALCVWMVSHIFSPESRPICPLQGHG

SEQ ID NO: 107229 - protein, 109 aa, Glycine max
  Coding DNA Sequence Number=SeqID_15544
MMQSYPTRALDRRLQEDWARDAREIPRVLKALEQETKRARGEEHDRNKFRGALWGSNSALKLQREEMDQSRVDSLILKDELKACSRSKISLPQRLCETETNMLAIISKY

SEQ ID NO: 107230 - protein, 53 aa, Glycine max
  Coding DNA Sequence Number=SeqID_15545
MAPKTCSRPTSVPDRTSSIKRTLESDQFSLLNDPNKACIYVIKVPTGKIQQRI

SEQ ID NO: 107231 - protein, 99 aa, Glycine max
  Coding DNA Sequence Number=SeqID_15546
  Homolog annotation: Hit_ID=A5BEV8; Match level="QueryCoverage=86%, HitCoverage=10%, E-value=2e-16, Identity=46%"; Hit description =Putative uncharacterized protein
MSLLVDGLTKVTMDKWMDITDMVYVIASRYNVILVSLSQQQSITFFPLRSQPLADSSVHRIICIGHIYGNHFVQVYLKDCCPLPPLALLWSSNCHPQAK

SEQ ID NO: 107232 - protein, 98 aa, Glycine max
  Coding DNA Sequence Number=SeqID_15547
MACTHIPVKAKIFQNCPMCGVACQCRDSYAILLKFQPARINWTLHLMLQGHTVLNGMPQGSSMICTCCVQVVSSENGGGGNLAEVVFVIGSALGRLYG

SEQ ID NO: 107233 - protein, 163 aa, Glycine max
  Coding DNA Sequence Number=SeqID_15548
MTQELVARGDTLWLFAPFCHPEAAGPVTSRDQVWSFCTHDTRRYLTVIRTPLPFRHSRVRWHAETKFGHSAPMIRGDTLRRVRWHAETKFGHSAPMIRGDTLRLSHPFVHSRAAGPMAQAETKFGHSAPMIRGDTLWLFAPLLSFRGGGPDDKQRPSLVILHP

SEQ ID NO: 107234 - protein, 173 aa, Glycine max
  Coding DNA Sequence Number=SeqID_15549
  Subcellular localization annotation: CTP_CleavageSite=16; ConfidenceScore=5.17e-01
MAFPYMSATIAFHGIVGTTIKETSSHLRQRNTLLSSGSERTAPGGYFLVVSTYCLMPHRSKQSMLSHVLVVLLYCITIAAMPEIESSMSGRSRVGASRDNPWSQGWQIICISHLIPSYPRFYVVYLATPSKIRPVKWFFKIGYSQAFRNNPVVADIYFFTKPSDHHTSETSFP

SEQ ID NO: 107235 - protein, 296 aa, Glycine max
  Coding DNA Sequence Number=SeqID_15550
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDSQKTIWMWISDLMGLDSDVHLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 107236 - protein, 281 aa, Glycine max
  Coding DNA Sequence Number=SeqID_15551
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSRPGPAAAPAPRPLALAGGALAPLRGGAAGDPEERLVSLEAFALLRPWVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107237 - protein, 196 aa, Glycine max
  Coding DNA Sequence Number=SeqID_15552
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=50%, E-value=9e-24, Identity=100%"; Hit description=LacZ protein
MTMITPSSKLTLTKGNKSWYRAPPRGPQQGEGLEAHEALLRVASSAAAQRSESAAGQGQRSRRRGSGGAWARSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107238 - protein, 139 aa, Glycine max
  Coding DNA Sequence Number=SeqID_15553
MTPVNRKAGTGERTREPPGGNAGIFIVLSGFATTDLSVRFRDACQGGGAYGKTALPRPSHFPVKYLPGIFQEISAPFPFFSCHMKHFTDTLISANIETMFLAAQKMGKARISAGSNYLQPGGSTSSRAAATAVELQFAL

SEQ ID NO: 107239 - protein, 105 aa, Glycine max
  Coding DNA Sequence Number=SeqID_15554
TGLGDAPQAADALPPHQAGPAGSFDTEQYLRHLVRQQAANHRAHGFTSFPCPTLDQFRAEVAWPGDWPEARAGEAPAEAPDEADEAREDEEMADLLDFLGGSGAT

SEQ ID NO: 107240 - protein, 305 aa, Glycine max
  Coding DNA Sequence Number=SeqID_15555
  Gene Ontology: Mol. function=protein transporter activity; Cellular component=nuclear pore; Biological process=intracellular protein transport
  Homolog annotation: Hit_ID=Q6UUU1; Match level="QueryCoverage=19%, HitCoverage=40%, E-value=4e-18, Identity=78%"; Hit description =Putative uncharacterized protein
  Pfam annotation: Domain name=Arm; Domain location=122-162; Score =24.8; E_value=0.00033; Accession=PF00514.14; Description =Armadillobeta-catenin-like repeat
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLFLVSQGCIRPLCDLLICPDPRIVTVCLEGLENILKVGDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107241 - protein, 82 aa, Glycine max
  Coding DNA Sequence Number=SeqID_15556
MERYLQHLVRQQAANHRGQGQGFTPFACPTPDQFRAEVAWPEDWPEAQAREAPAGAPSDAEEARMDEEMTDLLGFLGGSGAT

SEQ ID NO: 107242 - protein, 130 aa, Glycine max
  Coding DNA Sequence Number=SeqID_15557
MERSMIDAASGGALGDMTPTEARNLIKKMASNSQQFSARNDAIVLRGVHEFAMNEKSAHVARVCGLCSFADHHTDLCPSLHQFGVNEQPEAYPANIYNRPPQQQNQQQQNNYDLSSNRYNPGRRNHPNLR

SEQ ID NO: 107243 - protein, 135 aa, Glycine max
  Coding DNA Sequence Number=SeqID_15558
MAKPRNILLTLKEHNANSYNTYCQNKTWVVRLPLLDFVGVTLDWDDILLTGFAYVEDALIMVGLYNALRPCFLKLMPSLGVEFAHSSLKRLLQNSIGDLCNVWDAMNNMITLQHTEIKASFETSTHVVGHVFQKT

SEQ ID NO: 107244 - protein, 155 aa, Glycine max
  Coding DNA Sequence Number=SeqID_15559
MGDIEEVQEQMKADMVALIDQMASMMEAMLTMKRMMKSNTATIVAASAATEVLGSISGPYIGYNRNAYPYGLPPNYTPPTMHMPNEKANHAILVEGQQPQPMGGTRGPPPTVEGREKIDRINDRLRAIEGFGDYPFTDMTKFCLVPDVVIPPKFK

SEQ ID NO: 107245 - protein, 276 aa, Glycine max
  Coding DNA Sequence Number=SeqID_15560
  Homolog annotation: Hit_ID=Q6WAY6; Match level="QueryCoverage=90%, HitCoverage=41%, E-value=1e-27, Identity=34%"; Hit description =Putative uncharacterized protein
MGWLGIPRKCLEAKARILAGKGEWAPFIDILALLIFGGVLFPNMDGLVDLAAIDAFLAYHNHKESPVVAMLADLYDTFDRRCEKSSTRIVCCTLALYVWLVSHFFCQVVRHACPLEGHRSCTEKGGANWDQILSNKEGASVNWFPRWKEGRTRVLVSCGGFSNVPLMGTRGCISYNPVLTIRQLGYPMRGAPQEEELAPIISRAFSETNMETLRKVRKAWEVVQKKEKELRGSNNGPIGGYHKWLKAHVQGLDWLPSLRTAKREEVEAPEEDEEVQ

SEQ ID NO: 107246 - protein, 79 aa, Glycine max
  Coding DNA Sequence Number=SeqID_15561
FIALLEHKISCSSLPLPSFISFFLQALIHGLLWCGVSSLASFSLPLPFIFQEAKESIDEGDPRPRSSNGAYINLKRLVL

SEQ ID NO: 107247 - protein, 36 aa, Glycine max
  Coding DNA Sequence Number=SeqID_15562
MTCGGTLWLSAPFFNQGERVRWCYFRHPKTFKSDDA

SEQ ID NO: 107248 - protein, 163 aa, Glycine max
  Coding DNA Sequence Number=SeqID_15563
  Gene Ontology: Mol. function=oxidoreductase activity, acting on single donors with incorporation of molecular oxygen, incorporation of two atoms of oxygen
  Homolog annotation: Hit_ID=A6TA92; Match level="QueryCoverage=58%, HitCoverage=78%, E-value=4e-43, Identity=87%"; Hit description =Putative glyoxalase/bleomycin resistance protein/dioxygenase
ALAPLGVTLAGEGEPAYGAELAGANDASLCLYQSEDKPAPLHIAFCAESREQVDAFWHAALAAGGKDNGAPGLRPNYPANYYAAFVIAPDGHNIEAGRAVGADGKVIALGAEQIFPPIAEVHAGQQRKFQAVILRRAVKAQPFDADHRRRRLTDADPLARAAP

SEQ ID NO: 107249 - protein, 37 aa, Glycine max
  Coding DNA Sequence Number=SeqID_15564
MAAYGGHRWSWVGEKKDICLTKRDVKGFISQIPTVKV

SEQ ID NO: 107250 - protein, 151 aa, Glycine max
  Coding DNA Sequence Number=SeqID_15565
MVFWEVSDPNFVRGLPFTDVLILDSRIAVFDTNPSSPKLASGSPGPWNYLLAKQPARLGELKPPQGDYFPINRHDGGCFKGLGGSTLKGIERIERKEEEKRKRRRRKKRKRSQDATKLQPRSVPTSFLILCSSCGVPLVIMCTFISSIYHR

SEQ ID NO: 107251 - protein, 78 aa, Glycine max
  Coding DNA Sequence Number=SeqID_15566
MVSKVWSFDGGFNGEEEEGNSNMRSLAFLCTRRGLFSKVSNIYIKTEWRRKKDDWRCHFKEKMSQEQAHHHRKSWIRA

SEQ ID NO: 107252 - protein, 64 aa, Glycine max
  Coding DNA Sequence Number=SeqID_15567
MVTYYSHLMALEEIMLKVLSQRALLRASEGEAHGCAFQRRKDARSRHQRLFVENVGKTEGNRSK

SEQ ID NO: 107253 - protein, 184 aa, Glycine max
  Coding DNA Sequence Number=SeqID_15568
AASEFDSHRFRCVEHQQRFETIKGWSFHRERRVQLREDEYPNFQGEISRRHWARPVTPMAKFDPEIVIEFNANAWPTEEGVRDIAHGQFLGDPLILKEDQQCEFSQRRSQADSFGEEVIAQLLCIPGQDFARTAAGRRVRIMRTSMTTLTQIWMTLLHSNVLPSDHNSDLPLPKCQLEYASSHR

SEQ ID NO: 107254 - protein, 117 aa, Glycine max
  Coding DNA Sequence Number=SeqID_15569
ELVGEVGGLRGGFFVVFFRHGNPSVGSLIEPGARRTGVARRERGVDMASPRCKPWRNTSALRIRFPSVRSPLCGRRIQDRPSSAARLPSGCRARWLRRAGLPLRRRPSHKSDTSKYA

SEQ ID NO: 107255 - protein, 62 aa, Glycine max
  Coding DNA Sequence Number=SeqID_15570
MSVQAIKVGGLYTAETASVAAQVAADYSQVPLVLHLGQRAQVPADAADEDEADDLLAAVLEL

SEQ ID NO: 107256 - protein, 346 aa, Glycine max
  Coding DNA Sequence Number=SeqID_15571
  Gene Ontology: Mol. function=motor activity; Cellular component=cell projection
  Homolog annotation: Hit_ID=UPI00006A16D8; Match level="QueryCoverage =99%, HitCoverage=95%, E-value=1e-18, Identity=25%"; Hit description =UPI00006A16D8 related cluster
GHHALSYRGLHVLAIGGLQTLTFRGLHVLVSRRLHTLIIRGLHVLAIRGLHTLAFRGLHVLALTFKGQHVLTIRGLHALSFRGLHVLDIGGLQDLTFRGLHVLAIRGLHTLPFRGLHVLAIRGLHSLAFRGLQVLAIRGLHALTFKGQHVLTIRGLHALSFRGLHVLAIGGLQDLTFRGLRVLAIRGLHTLPFRGLHVLAIRGLHALTFKRQHVLAIRGLHAITFRGLHVLAIRGLHTLPFRGLHVLAIRGLHALTFKRQHVLTIRGLHALSFRGLHVLAIEGLHALTFQGLHLFAIRGLHVLACRGLHVLAIRGLHALTSRGLHVNAIRGLHAFALRGLHVLAIR

SEQ ID NO: 107257 - protein, 111 aa, Glycine max
  Coding DNA Sequence Number=SeqID_15572
MHLTKTSMRAGNSNVYGFLEPQSIQRFGQSQFESESYMKSWMQSSQRDVYLGAYLNGGHWQMVVILPEENLVVWFCSLHNRLDNYLKGIINSVIDKKEALSAAITSSTGCP

SEQ ID NO: 107258 - protein, 57 aa, Glycine max
  Coding DNA Sequence Number=SeqID_15573
KFRALLSLSLHSSPSSFKLLSMASYGEAKESIDEEDPRPTSSNGACISPFSTHRACK

SEQ ID NO: 107259 - protein, 89 aa, Glycine max
  Coding DNA Sequence Number=SeqID_15574
MAASDQAILRDGAHIPTKRNLLELSSQDALLAKNKLLSVKKRLSFEFSKSSSWAKRISTAKCSFNALSARENLAEHQHQSCALSVRSVC

SEQ ID NO: 107260 - protein, 136 aa, Glycine max
  Coding DNA Sequence Number=SeqID_15575
MLESFQQQEQMSVLELYIKKDVAGGSMFHFANSLTSCENNLSNIETQPPTNVSNLHGDKDNDYDDDYYFVSNSYVEESLDEDDSVDGISDTDDEVTDMIQPVYKEFKIHFGMMLCIITISIGVILMRRTFAVWRCR

SEQ ID NO: 107261 - protein, 125 aa, Glycine max
  Coding DNA Sequence Number=SeqID_15576
MKADMEAMKEQMTTMMEAMMSMRRMMEVNAATIVASSTATEVDPTHPPSFNQVNHPALDVVGQGGKTLGSAGDPHFVQVQNKHSFPLYGLPPNYTPPNVAHTPDENVDNPHPYPLRANNPNLIMH

SEQ ID NO: 107262 - protein, 77 aa, Glycine max
  Coding DNA Sequence Number=SeqID_15577
EHEMELQRLNQNEETDKRKRSIALKASSSMQEEYEDEESEDEEDFSLFVKKFHKFVKNRRSERRQNFNHGKDSKKAL

SEQ ID NO: 107263 - protein, 35 aa, Glycine max
  Coding DNA Sequence Number=SeqID_15578
MEGGDVPLSEMLGTFSLSVGAVGGFSPMYFDFLGR

SEQ ID NO: 107264 - protein, 147 aa, Glycine max
  Coding DNA Sequence Number=SeqID_15579
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=4e-25, Identity=55%"; Hit description =Putative uncharacterized protein
  Subcellular localization annotation: CTP_CleavageSite=41; ConfidenceScore=5.20e-01
MTMITPSSKLTLTKGNKSCLGVISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107265 - protein, 67 aa, Glycine max
  Coding DNA Sequence Number=SeqID_15580
MTGGCIFAEHVLPMAELCLMPGQVSADYMEWFFRISHTFMIPTQASDQPRDAPAADPESTIQPPSPQ

SEQ ID NO: 107266 - protein, 210 aa, Glycine max
  Coding DNA Sequence Number=SeqID_15581
  Homolog annotation: Hit_ID=UPI000065F7CF; Match level="QueryCoverage =74%, HitCoverage=21%, E-value=1e-10, Identity=31%"; Hit description =Homolog of Homo sapiens "Leucine-rich repeats and IQ motif containing 1
TLTVERTTRPRLEGTTCPHHQRAARPHLQRTTCPRLERATRPHLGGLHALTSRGLHLLALRGLHALTLGITYPHRQRTTCPRLQRAARPHLQRTTPPRLERATRPHLGYYLPSPLRGLHVLTLRGLHVLTIRGLHALTSRGLHVLALRGLHVLTLGTSYPHCQRTTRPRLERTTRPRQQRAARPHLQRTTLPRLRKATRPELQRATRSRL

SEQ ID NO: 107267 - protein, 71 aa, Glycine max
  Coding DNA Sequence Number=SeqID_15582
MDHNFLISPSSPKSLNHPLGGAGGAGGGGIISTSEEAGGSTTGRCDSAGAGSVLVGMGLGGTTSGDLPNGS

SEQ ID NO: 107268 - protein, 95 aa, Glycine max
  Coding DNA Sequence Number=SeqID_15583
  Homolog annotation: Hit_ID=A0PAV3; Match level="QueryCoverage=40%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVVAQMLGRAIGAGLFDITPSGERGMCCKAIKLGNARVFPVTTS

SEQ ID NO: 107269 - protein, 83 aa, Glycine max
  Coding DNA Sequence Number=SeqID_15584
MSLHSSSSVNGRHRSHLRPHSHRREKERKPQEAYINLPYFHGKDNVEANLDWKIRVENNLKGSLLQNLKALTLVQRKTKVKAS

SEQ ID NO: 107270 - protein, 198 aa, Glycine max
  Coding DNA Sequence Number=SeqID_15585
  Homolog annotation: Hit_ID=Q6WAY4; Match level="QueryCoverage=84%, HitCoverage=30%, E-value=5e-21, Identity=37%"; Hit description =Putative uncharacterized protein
MMRTNQNGKRFYQVKVKGLDVTSLKELGRLMGPLQRQAFRKVYGKILDLTVAEVFTEAVVSLAQYYDQLLRCFTFGDFQIVPTIEEFEEILGCPLGGRKPYLFSGFLPSLSKIAAVIGDSAKELDRMKQIWNGIVGLPRKYLEGKARDMASQEKWGPFADILASLIFGVVLFPNVDNLIDLAANDAFLAYHHSKESPM

SEQ ID NO: 107271 - protein, 111 aa, Glycine max
  Coding DNA Sequence Number=SeqID_15586
MEAISKWFEELDICVKVILKSKLREIVYPNLNWMCAPSENVKTKGMDEDSWSLVRNHLLKELGQWPDEYIYLLDGINKYEDLEQSLLVDGLSMVTMDKWMNISDMGYVIAS

SEQ ID NO: 107272 - protein, 91 aa, Glycine max
  Coding DNA Sequence Number=SeqID_15587
MEVVSAQRLLEVVKRRSHADKQWSRYLGSRICLEEKRDEYHRRCSSDKNSVDDENDGGIDVGGAPVAPRHQIIVAEAEVYEPLRFLDDSTI

SEQ ID NO: 107273 - protein, 243 aa, Glycine max
  Coding DNA Sequence Number=SeqID_15588
  Pfam annotation: Domain name=zf-CCHC; Domain location=14-31; Score =21.5; E_value=0.00084; Accession=PF00098.14; Description=Zinc knuckle
  Subcellular localization annotation: CTP_CleavageSite=54; ConfidenceScore=5.03e-01
QPLKASMQEKTTSMKCFKCLGRGHFTSQCPTKKTMIMRGQEIYSSQDEASTSPSSSESEEVKGEESSKEIYPQEEGQPLMVKEECKETLVSIATPLGLEFIPQVKELFDEGLVRKSLNPCALLVPKIGIIRHQIPMIGVMMNVLSSATLFMICVHRDSLGLPMDPKRIKVIPEWPTPPSPLIELVRNYVLSWEDGQERGFQSLPYSNIPNITESLKFQEPRDLWSNPFPGGENDAILPGKGIG

SEQ ID NO: 107274 - protein, 112 aa, Glycine max
  Coding DNA Sequence Number=SeqID_15589
  Subcellular localization annotation: CTP_CleavageSite=49; ConfidenceScore=5.65e-01
KSTAGTSALASVAVTLRVTTTPAALNAPLQGASHSPFRLRNCWEGRSVRASSLLRQLAKGGCAARRLSWGELELHRGGGRSRTSGSPGLQEFDATWEAEEGKSFEPRRWSLQ

SEQ ID NO: 107275 - protein, 98 aa, Glycine max
  Coding DNA Sequence Number=SeqID_15590
GANIEEEELTDLRSNPLQGEGDNAILPRKGPVTRAMSKRLQEDWARAAEEGPRVLMNLRVIDAIFPRKGPVTRAMSKRLQEDCARAAEEGPRVLMNLR

SEQ ID NO: 107276 - protein, 159 aa, Glycine max
  Coding DNA Sequence Number=SeqID_15591
  Gene Ontology: Mol. function=chloramphenicol O-acetyltransferase activity; Biological process=response to antibiotic
  Homolog annotation: Hit_ID=UPI0000ECD485; Match level="QueryCoverage =20%, HitCoverage=28%, E-value=2e-12, Identity=100%"; Hit description= UPI0000ECD485 related cluster
VKVGTSYVPINVSFSPKVAPGFPGINGDTRIYFFWEVISRHGGFCFYPAVPPVQLLTGWCVTAKAPPDISAGKCSGRVPFAIQAAQLLGRAIGAGLFAITPAGERGMCCKAIKLGNARVFPVTTLNSIYSQDVACYGENLAYFPKGFIENMFFVSANPW

SEQ ID NO: 107277 - protein, 136 aa, Glycine max
  Coding DNA Sequence Number=SeqID_15592
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
  Subcellular localization annotation: CTP_CleavageSite=30; ConfidenceScore=5.02e-01
MYVTSKTKFRTKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107278 - protein, 200 aa, Glycine max
  Coding DNA Sequence Number=SeqID_15593
MVKVGTSYVPINVSFSPKVGPGLPGINRDTRIYLFTANYLPHHRLQWRIMVSISCPPVQLLTGWSAPIRTQAYRAGHQRGKARPLSHSGNCGNCLMERHAIGRRAFALLRQRRKGGCAHTGDYYVGLMNAHALELVVIPRARNCPIDGQDQTSTGKTIKIPAFPPGGSLVRSPVPAFRFTGVIPLLWPRLSHSTPDTQFR

SEQ ID NO: 107279 - protein, 101 aa, Glycine max
  Coding DNA Sequence Number=SeqID_15594
  Subcellular localization annotation: CTP_CleavageSite=63; ConfidenceScore=5.65e-01
CLSCSATDGVVRNGKSTARTSALASVAVTLRVTTTPAALIAPLQGASHSPFRLRNCWEGRSVRASLLLRQLAKGGCAARRLSWVTPGFSQSRRCKTTATEL

SEQ ID NO: 107280 - protein, 76 aa, Glycine max
  Coding DNA Sequence Number=SeqID_15595
PTGCPSPRQGHVIIGIAPARHPVDPKKSNRVLELSSSNYESLQAQGETPQQPEDGRQRATDAPPSPLEFTSAHPQK

SEQ ID NO: 107281 - protein, 199 aa, Glycine max
  Coding DNA Sequence Number=SeqID_15596
MWSICPFPEMSHLPVETFSSLTSYLELRRSEFLIGGYVGARALLLSDRPIIFAILTLRGGGPDDMRRQNLVILHPFSIQTQSCPMARRDKIWSFCILLSSRGSGPDDTRRQNLVILHPFAIQTQPCPMARKDKIWSFCTLLSSRGGGPDDTQGQNLVIPHPFAIQTQPCPMARRDKIWSFCILLSSRGGGPDDTRRQNL

SEQ ID NO: 107282 - protein, 221 aa, Glycine max
  Coding DNA Sequence Number=SeqID_15597
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=72%, E-value=5e-24, Identity=68%"; Hit description=LacZ protein
MTPVNRKAGTGERTREPPGGNAGIFIVLSGFATTDLSVRFRDACQGGGAYGKTALPRPSHFPVKYLPGIFQEISAPFPFFSCHMKHFTDTLISANIKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107283 - protein, 162 aa, Glycine max
  Coding DNA Sequence Number=SeqID_15598
MPQNVLYDAIGIYQRCWNLLRADQRLIALGCSPKVLAQGFPDQQGHRIFFCEVIFRITGILLAQYRASGDAAELYDLVYEGYLSAPVASVSISCSSCSATDGNCGSVTAKAPPDISAGKCSRVRRARNHHTVNCCRYRARPIRHSAAQLFGKRRSVRASSLL

SEQ ID NO: 107284 - protein, 57 aa, Glycine max
  Coding DNA Sequence Number=SeqID_15599
MRDTSDLHFSGTIPSQLIGQTLFPPVQLKLGWYPRPIRHKAYRPDIAASVKRVPTCS

SEQ ID NO: 107285 - protein, 137 aa, Glycine max
  Coding DNA Sequence Number=SeqID_15600
MQDKIDCNKINEIREERNANSIYTGSTTSRAYVQSSSNPLEIFHSLYKTPFKKSKPHVATYPSAGGRRVTRGMRVPRKEYARSRHQRLFEENVGKIGKDAIYELLSERFGSCIYARGRVFPFAPTYSSIWDEKIRPT

SEQ ID NO: 107286 - protein, 309 aa, Glycine max
  Coding DNA Sequence Number=SeqID_15601
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIFKTTILKPHIDAINAKTELTVEFKALKKEGRKASHVNFNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107287 - protein, 30 aa, Glycine max
  Coding DNA Sequence Number=SeqID_15602
RVDFVADLGVAFVADWVFLVGRVMGNGLCG

SEQ ID NO: 107288 - protein, 106 aa, Glycine max
  Coding DNA Sequence Number=SeqID_15603
MSLATLFGKLQEHEMELMRLNHHEENDNKKKGIALKASSSTQEGSDKEDSIEIDEDDDLSLFVKRFNKFLRVRGNHRRSNFKSQKRAEDSSFTPKCYECNQPGHLR

SEQ ID NO: 107289 - protein, 284 aa, Glycine max
  Coding DNA Sequence Number=SeqID_15604
  Gene Ontology: Mol. function=transferase activity, transferring glycosyl groups; Biological process=metabolic process
  Homolog annotation: Hit_ID=Q2HT79; Match level="QueryCoverage=44%, HitCoverage=34%, E-value=1e-34, Identity=54%"; Hit description=UDP -glucuronosyl/UDP-glucosyltransferase
TSVSKTTQILTKFVSANNGTYDVINAYLHRASASFNELNHLHKDLGSCDSHNKHKMHRTENGNDSGKVVGNFVQSVDINKELSLRHVKFDQFKRQQSGSGNADGENFSQQEEQENVDGGEMHKKKKKKKEADGKHVSSRNPTIEKCSSMLLMESMLVLGWGLPDSKKPFLWIIRPDLVIGGASVEPSLVDSSLIVDGTQPLKVFVLEYQYQPTNCRYICNEWEIGIEIDTNVKREEVEKLVNDLMVGEKGKKMRQKIVELKMKAEEATTPSGFSFMNLDKFIKE

SEQ ID NO: 107290 - protein, 107 aa, Glycine max
  Coding DNA Sequence Number=SeqID_15605
  Homolog annotation: Hit_ID=A5C070; Match level="QueryCoverage=85%, HitCoverage=8%, E-value=5e-07, Identity=34%"; Hit description =Putative uncharacterized protein
MEVRDKVKLLPYRNLDDLVQPCIRVEQQLKRKPTSKSYGSHYYPKKYQGQGILGAAPSKPKDDKGKTVEKQTPKASIGHIASQCPTKKTMIMRGQDIATTSPSSSES

SEQ ID NO: 107291 - protein, 183 aa, Glycine max
  Coding DNA Sequence Number=SeqID_15606
  Homolog annotation: Hit_ID=UPI00006A2D9E; Match level="QueryCoverage =97%, HitCoverage=94%, E-value=6e-15, Identity=16%"; Hit description =UPI00006A2D9E related cluster
GLHVLVFRGLLALTVRGLRVLAIRGLHALAIRGLHALTFRGLHIVAFRGLHALAFRGLPDLTFIMLHALAFRGLHALAFKGRHILNFRGLHALIFRGLHALTFRGLHALTFRGLHVLTFRGLHALTFRGLHVLTFRGLHALAFKGRYILNFRGLHALAFSGLRVLTFSGLHIHTLREFKVLCP

SEQ ID NO: 107292 - protein, 211 aa, Glycine max
  Coding DNA Sequence Number=SeqID_15607
  Gene Ontology: Mol. function=motor activity; Cellular component=cell projection
  Homolog annotation: Hit_ID=UPI00006A2D9E; Match level="QueryCoverage =99%, HitCoverage=85%, E-value=2e-14, Identity=17%"; Hit description =UPI00006A2D9E related cluster
ALHVLAIRGKHPLTIRGQHVLAIRGLHDITFRGLHVLAIRGLHALSFRGLHVLAIRWLHALTIRGLHVLAIRGLHALIFKGLHVLTIEGLHALTFRGLHVLAIRGLHVLACRGLHVLTIRGLHTLTFRGLHVLAIRGLHALNFGGLHVLAIKGLHALSFRGLHVLAIGRLHALTFRGLHVLVIRGLHVLAYRGLHVLAIRELYALTFRGQH

SEQ ID NO: 107293 - protein, 368 aa, Glycine max
  Coding DNA Sequence Number=SeqID_15608
  Gene Ontology: Mol. function=chitin binding; Cellular component =extracellular region; Biological process=chitin metabolic process
  Homolog annotation: Hit_ID=Q9FGV1; Match level="QueryCoverage=22%, HitCoverage=12%, E-value=9e-35, Identity=73%"; Hit description=Auxin response factor 8
MVEEKVGECLCNGLKQIEGEKQKKVKLDYMKLSTSGLGQQGHEGTRGVYFPQGHSEQVAATTNKEIDGHIPNYPSLPPQLICQLHNVTMHADVETNEVYAQMTLQPLTPDIYDVDVFMKSMEGVVRVLRDLPSHVSTHKIAAMKMRACSPLQMRACNPLMARTCSPLKGRACSPLMVRTCSPLKVRACNPVMARMSSPLQVRACSHLVASTYSPLQVRACSPLMARTCSPLQVRACSPLRARTCSPLKARACSPLMVRTCSPLKVRACNPLMVRTCIPLKVRACSPLMARTCSPLKLRACSPLMARTCCPLRVRACSPLIVRTCSPLKVTVCSPPIVRTCSPLKVRACSPLMARTCSPLKVRACSPPM

SEQ ID NO: 107294 - protein, 128 aa, Glycine max
  Coding DNA Sequence Number=SeqID_15609
MASSTLHPIRRHVKWKMAHTKKTGEMTTEATKEIAEKIDVLTTAIGCPEHLGRVRVAGAGVTIKQYFGSAPRTSRSSSSLPPEELQQLTQQIRDQLEESITEKVMRQLMASFSQMQSQMQSQGLALPP

SEQ ID NO: 107295 - protein, 57 aa, Glycine max
  Coding DNA Sequence Number=SeqID_15610
MAAHGGHRWSWVVENKLWAAQRNSHRLELRLARHTRLAGDQNLLFSRSQQSDCRNIS

SEQ ID NO: 107296 - protein, 223 aa, Glycine max
  Coding DNA Sequence Number=SeqID_15611
  Subcellular localization annotation: CTP_CleavageSite=71; ConfidenceScore=5.50e-01
MAKPSKKRKGVSTSSAVTGTRSHGASKAHTTQIPPSISSPMLFSSKEQCIRDGVPFEGTLDDEWKFNFSVSDARRMVCTNQADMIGRLLGGSLAFELCIMHYLIMHILLPRSSNLAQVSEEDLIIMWVFLTGHQIDSDHLVRYRMHKALRSNAPLLYPHSITLFLQHLNVPLDSEAFVKVKRSFSIGANVISSFGYRKERDGSWVKKDAPAQAAEDRSPSPHP

SEQ ID NO: 107297 - protein, 63 aa, Glycine max
  Coding DNA Sequence Number=SeqID_15612
MACTHIPVKVEIFTRDSPQISASPHQLDLAPYALGPYNAQWNAPGLLHDKHTLQSQSIKNLKI

SEQ ID NO: 107298 - protein, 51 aa, Glycine max
  Coding DNA Sequence Number=SeqID_15613
MDPKRIKVIPEWPTPPCVEERIPEFLEPMYFRSNPFQGGRNDTILPNKGIG

SEQ ID NO: 107299 - protein, 306 aa, Glycine max
  Coding DNA Sequence Number=SeqID_15614
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMCASAGVTRLYLEPVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGSERAAAKPFFHRLRPPDKHHEI

SEQ ID NO: 107300 - protein, 168 aa, Glycine max
  Coding DNA Sequence Number=SeqID_15615
MEKTKKLKSGEWINDKSFEFVEKYQHRQEEILQHLTKESTSTQDSPNIVTSVNDNEIYLNVVVGLNYKGNVYVLGTLSKRFRCSKSAPSTSIAPVEDQIEEMRETINKLNVEFLAKTNKERTLKEKMLQLIENHDHQSQEMRQQMQEQNEQICQQNEQVQRILQHLHV

SEQ ID NO: 107301 - protein, 95 aa, Glycine max
  Coding DNA Sequence Number=SeqID_15616
MDNCDGVVSSEVVVAFCGVVLIYSNGKFIKVFFRRFGFCTEAKMEHLHVAANSLQVVMLIDDFMHSKGQFHEIISKNMEDEGEFHKLHFWPYWQR

SEQ ID NO: 107302 - protein, 112 aa, Glycine max
  Coding DNA Sequence Number=SeqID_15617
QMEVGNRGWWVYARIVDVENLLCTIARPPPKWYLEICRGGQDLWDVRRAPGSQQIKGTKTTKRGGLWWLASCEFWVICGLWPLLIDYQGVENEASGNRLPACVIDYTEGWVT

SEQ ID NO: 107303 - protein, 69 aa, Glycine max
  Coding DNA Sequence Number=SeqID_15618
  Gene Ontology: Mol. function=microtubule motor activity; Cellular component=microtubule associated complex; Biological process =microtubule-based movement
  Homolog annotation: Hit_ID=P46864; Match level="QueryCoverage=75%, HitCoverage=6%, E-value=1e-15, Identity=76%"; Hit description =Kinesin-2
METSGRAIDLAQNGQKHSFTFDKVFTPEASQEEVFLEISQLVQSALDGYKSCETHVYLLDLVLDVAFLA

SEQ ID NO: 107304 - protein, 167 aa, Glycine max
  Coding DNA Sequence Number=SeqID_15619
MEPESTIHVLKGCPWASGIWLLCPLALHTQQMQALNFSDWVKEMGKCLDEEQLELMLVVAWALWSDRNLLLFQDIQNYPVDVVNKAISFFEEYKKEKLKIVQTPIGWQAPPHGVYKINTDAAIFNQQGIGCLLHPALPSLTSRAIDLDELAVAALFSFLKQGISFHS

SEQ ID NO: 107305 - protein, 84 aa, Glycine max
  Coding DNA Sequence Number=SeqID_15620
  Homolog annotation: Hit_ID=A5AWG3; Match level="QueryCoverage=100%, HitCoverage=16%, E-value=3e-08, Identity=39%"; Hit description =Putative uncharacterized protein
MNIEESIHVTFDEFNAILSRKNMLDDIADSLEHMNIQDQDSKGNDKGNNEDPPEEVKSNDELPREWKASRDHPLDNIIGDISKG

SEQ ID NO: 107306 - protein, 227 aa, Glycine max
  Coding DNA Sequence Number=SeqID_15621
  Homolog annotation: Hit_ID=Q5QJQ3; Match level="QueryCoverage=46%, HitCoverage=82%, E-value=5e-57, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLVTPGFPSHDVVNDGQCQACMPAGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTRISRARYVGGATEFLKWWPNY

SEQ ID NO: 107307 - protein, 73 aa, Glycine max
  Coding DNA Sequence Number=SeqID_15622
MWHTLPMRMSMTPLPILIESQQPQSNHAPIPQPLGGTHEIPHNNLANFEPGLEYATEGKEVDGVPLPNTLEGP

SEQ ID NO: 107308 - protein, 88 aa, Glycine max
  Coding DNA Sequence Number=SeqID_15623
  Subcellular localization annotation: CTP_CleavageSite=73; ConfidenceScore=5.21e-01
MYPPLELIHKRFTLSCSQSTNQVDVPSTCTTKDVPSNVLRQSSQAGKGRHKRIQAISPSFFWKREKRDTKRIQAVSPWQILFGKGRRE

SEQ ID NO: 107309 - protein, 135 aa, Glycine max
  Coding DNA Sequence Number=SeqID_15624
  Homolog annotation: Hit_ID=A6BLN7; Match level="QueryCoverage=78%, HitCoverage=20%, E-value=1e-07, Identity=34%"; Hit description =Putative transposase
MAPFTYACSKYNKEVVLRYRLEVMINHGDENTKFLLWDRECSELIGQSADAVNKLKIEDGNVDLNASPQALDKLLGYELAFKIKVQPKFKNSPVLKCSTDSSLINVVMDMLADVETSSKMNIPISDSNHSAQHES

SEQ ID NO: 107310 - protein, 277 aa, Glycine max
  Coding DNA Sequence Number=SeqID_15625
  Gene Ontology: Mol. function=helicase activity; Cellular component =nucleus; Biological process=viral genome replication
  Homolog annotation: Hit_ID=Q2A9E0; Match level="QueryCoverage=99%, HitCoverage=18%, E-value=7e-73, Identity=50%"; Hit description =Putative uncharacterized protein
  Pfam annotation: Domain name=DUF889; Domain location=1-209; Score =269.3; E_value=8.1e-78; Accession=PF05970.5; Description=Eukaryotic protein of unknown function (DUF889)
MRLQNNMQATDQEETAAFAQWIIDIGDGIIGDENDGYATIEIPQELLITEYNDPIHSIISSTFPDLSHHHNDPEYFQTRAILASTNETVQQVNDYMLTMIPGEQMEYLSSDSVDKSETIESCHFRSLTTEFLNSLTTSGLSNHCLKLKIGTPIMPLRNLDQTQGLCNDTRLIITRLAKHVIAADIISGTNIGDHVYIPRMSMSPSQSPWPFKLLRRQFPIMLSYAMTINKSQGQSLSSVGLYLPKPFFSHGQLYVALSRVKSKKGLRILIHDQDKRK

SEQ ID NO: 107311 - protein, 64 aa, Glycine max
  Coding DNA Sequence Number=SeqID_15626
RKRKSAQYANHLSPRVVRFINAVGTTGFPTGKRAVSATQLIGYQFHTGNSYDHDYEFELGTNVN

SEQ ID NO: 107312 - protein, 133 aa, Glycine max
  Coding DNA Sequence Number=SeqID_15627
  Homolog annotation: Hit_ID=A0ST23; Match level="QueryCoverage=33%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNAREMDGTELEFVIMVIAVSFGKPVVPAALMNRPTRGERRFAYWALFRFLAH

SEQ ID NO: 107313 - protein, 88 aa, Glycine max
  Coding DNA Sequence Number=SeqID_15628
MVGYAPSSFADLVFAGKRIEAGLKRGKFDHPALMNEKTGANQDDENEEGTHVEVAIPTWPNFPSAQQCHYSANISSSHYPPGYPSSNS

SEQ ID NO: 107314 - protein, 131 aa, Glycine max
  Coding DNA Sequence Number=SeqID_15629
MNIHHLVTLFLQHFNIPLDFEPYVPMKGSFLIGASVIASFGYQKEHDGSWVKKGARHVGEEGHDGEDSSLISKILDRFDGLQTFVGERFDTLELQVDMRFNEMESRITKVEEDVSYIRSSFDLPPSPPPSF

SEQ ID NO: 107315 - protein, 127 aa, Glycine max
  Coding DNA Sequence Number=SeqID_15630
EDNVIGHRLKGKLPNFTSRRCDQTNHNIRSYKNIGVPIRPKKYVAPPTSNEDDHLLSQDKQALNEAEEVAAHVQQDLVEINVSQPNWSQDSDMELMVSATIVPPIARNKLNITRAKQRKVADKNDAV

SEQ ID NO: 107316 - protein, 83 aa, Glycine max
  Coding DNA Sequence Number=SeqID_15631
MEIRMDKSYNLFDPFIGAHNVRQSIKTKPRGYIESDHVQHDVPYQVEEMSHVNKVIEVESISGLQDLVEGVEEVNPANLLRNE

SEQ ID NO: 107317 - protein, 99 aa, Glycine max
  Coding DNA Sequence Number=SeqID_15632
LEGGPYCLEGLDLGGYSDLTRKWTLAADQDGVDDTDVQKKAQAIQKHNTSPHILSRGGYEYLEQKLLAEKTKKKLEEAAQSGSVDGVIDPPSPVRRHVK

SEQ ID NO: 107318 - protein, 224 aa, Glycine max
  Coding DNA Sequence Number=SeqID_15633
  Gene Ontology: Mol. function=cysteine-type endopeptidase activity; Cellular component=endoplasmic reticulum; Biological process =proteolysis
  Homolog annotation: Hit_ID=Q6Y1E6; Match level="QueryCoverage=100%, HitCoverage=100%, E-value=1e-63, Identity=43%"; Hit description =Cysteine protease 8
  Pfam annotation: Domain name=Peptidase_C1; Domain location=69-223; Score=115.3; E_value=1.9e-31; Accession=PF00112.14; Description =Papain family cysteine protease
MVAKNHFYHIAFAMLLCMAFLAFQVTCRTLQDASMYERHEQRMTRYSKGHMCSSIIRITTFKFENVTATPSTVDCRQKGAVTPSRTKVNVGVDQGCEGGLTDDAFKFIIQNHGLNTEANYPYIRVLMESAMQMKQTRMLLLLITGGSDFQFYKSGVFTGSCGTELDHGVTAVGYGVSDDGTEYWLVKNSRGPEWGEEGYIRMQRGVDSEEALCGIAVQASYPSA

SEQ ID NO: 107319 - protein, 244 aa, Glycine max
  Coding DNA Sequence Number=SeqID_15634
  Gene Ontology: Mol. function=cysteine-type endopeptidase activity; Cellular component=endoplasmic reticulum; Biological process =proteolysis
  Homolog annotation: Hit_ID=Q6Y1E6; Match level="QueryCoverage=100%, HitCoverage=100%, E-value=2e-86, Identity=52%"; Hit description =Cysteine protease 8
  Pfam annotation: Domain name=Peptidase_C1; Domain location=82-243; Score=204.9; E_value=1.9e-58; Accession=PF00112.14; Description =Papain family cysteine protease
MVAKNHFYHIAFAMLLSMAFLAFQVTCRTLQDASMYESHGQRMTRYSKRDINQFAPKKRFKGHMCSSIIRITTFKFENVTATPSTVDCRQKVAVTPIKDQGQCEQELVDCDTKGVDQDCQGGLMDDAFKFIIQNHGLNTEANYPYIRVLMETVANNPVSVAIDASGSDFQFYKSGVFTGSCGTELDHGVTAVGYGVSDDGTEYWLVKNSRGTEWGEEGYIRMQRGVDSEEALCGIAVQASYPSA

SEQ ID NO: 107320 - protein, 296 aa, Glycine max
  Coding DNA Sequence Number=SeqID_15635
  Gene Ontology: Mol. function=transferase activity, transferring glycosyl groups; Biological process=biosynthetic process
  Homolog annotation: Hit_ID=Q48483; Match level="QueryCoverage=98%, HitCoverage=77%, E-value=1e-125, Identity=74%"; Hit description =Galactosyltransferase
  Pfam annotation: Domain name=Glycos_transf_1; Domain location=160 -296; Score=42.7; E_value=1.3e-09; Accession=PF00534.11; Description =Glycosyl transferases group 1
MAARDEGYEIQIISHFVDDNVLNKFKTFGFKCHNIPLEAQSFNVLTFLRAFLASRKIIKKINPDILHCITIKPCLIGGVLSRYDERPVIVSFVGLGRIFSGGTCILKLLRYITVMAYKYIANNKRSIFMFEHNKDREKLVGFVGINYHQTIVIDGAGINPEIYKYSLEQEREIPVVLFASRMLWSKGLGDLIKAKKILKSRDIHFTLNVAGILVENDKDSISLSDIQQWHSEGLINWLGKSSDVYDLIQKSNIVALPSSYSEGVPRILLEASSVGRACIAYDVGGCDSLIIDKGIL

SEQ ID NO: 107321 - protein, 257 aa, Glycine max
  Coding DNA Sequence Number=SeqID_15636
  Gene Ontology: Mol. function=hydrolase activity, hydrolyzing O -glycosyl compounds; Cellular component=cytoplasm; Biological process= cell wall organization and biogenesis
  Homolog annotation: Hit_ID=Q1H075; Match level="QueryCoverage=100%, HitCoverage=73%, E-value=1e-115, Identity=78%"; Hit description=Beta- hexosaminidase
  Pfam annotation: Domain name=Glyco_hydro_3; Domain location=4-200; Score=98.6; E_value=1.9e-26; Accession=PF00933.12; Description =Glycosyl hydrolase family 3 N terminal domain
MREFGYIWDQNPRKAKELAVEAGYVLAAELRAHGVDFSFTPVLDMDYGDSLVIGDRAFHRDPQAINELAFSLMQGLKKAGMAAVGKHFPGHGFVVADSHVSIPVDEREFDQIAQNDMQPFVRMIDEGLHAVMPAHVIYPKVDDKPAGFSPRWLQKVLRERLGFNGVIFSDDLSMEGATVAGDVTARTLAALNAGCDMVLLCNRPDLADELLANLDWKISAQSIARLARMHGGHHPQDMVGLRESAYYVDAVKRVAMV

SEQ ID NO: 107322 - protein, 96 aa, Glycine max
  Coding DNA Sequence Number=SeqID_15637
MSLLGILWLACWLVSPVLLPGDQAISQVWGSQSIIKAYRVEVMVTQNNESSKFLLWDRECAELIGQIANDVNKVKIEDGDLDLNGSPQALDKLLGH

SEQ ID NO: 107323 - protein, 195 aa, Glycine max
  Coding DNA Sequence Number=SeqID_15638
  Homolog annotation: Hit_ID=Q2HW90; Match level="QueryCoverage=73%, HitCoverage=35%, E-value=8e-11, Identity=27%"; Hit description =Putative uncharacterized protein
MGQLQRQAFRKAYGKIWDLAMAEVSIEAIASLAQYYDQPLRCFTFGDFQLSPMVEEFEEILGCPLGGRKPYLFSGFYPSLARISKIVQISAGEWAPFIDILALLIFGGVLFLNVDGLVDLEAINAFLAYHDRKESLVVAILAYLYDTFNRRWVASVTIPILAIRQLGYPMRGAPLEEELAPTIARGFNNTNVGAL

SEQ ID NO: 107324 - protein, 165 aa, Glycine max
  Coding DNA Sequence Number=SeqID_15639
  Gene Ontology: Mol. function=protein dimerization activity; Biological process=regulation of transcription, DNA-dependent
  Homolog annotation: Hit_ID=A5ALS3; Match level="QueryCoverage=38%, HitCoverage=18%, E-value=9e-13, Identity=53%"; Hit description =Putative uncharacterized protein
  Pfam annotation: Domain name=hATC; Domain location=1-63; Score=28.7; E_value=2.1e-05; Accession=PF05699.5; Description=hAT family dimerisation domain
MWWKLNELKYPTLQAIARDLLAIPISTVASKLTSSIGGQILTPHHSRLHYTTLEALALSYPNFIWGQLFIDMRIIAGHVELLKANCPLGPSRPIRKLQHEATGSPAVRTLGYYLLVWMRNLPASAPGCQVLGPFTEQIDAIKDVSLIKDVSMFYVNAQVLNTDVS

SEQ ID NO: 107325 - protein, 79 aa, Glycine max
  Coding DNA Sequence Number=SeqID_15640
MMNGNYRLKGTLLSFRVFWTGLMDFKPMLVKGLMLWNDKWTRDSTKWTQGSQRLKKMSPSFATALIYLHHYHQFRHYYY

SEQ ID NO: 107326 - protein, 50 aa, Glycine max
  Coding DNA Sequence Number=SeqID_15641
MAKTESQAMPSKPTRKGRKWLKAQVEKDEGLSGEGQSPRVEKDEGPSGEG

SEQ ID NO: 107327 - protein, 118 aa, Glycine max
  Coding DNA Sequence Number=SeqID_15642
  Subcellular localization annotation: CTP_CleavageSite=32; ConfidenceScore=5.32e-01
MAEPSKKRKGSSSRSQQHSEAQDTPIPSSISSSSLFSSKEQRIRYTNLFSSRSIIDPKFIDMDFFSDESFECIQAFQNSNLIPFMSLKFPVYSELVKAFYSNLEIQEDFRSLWDKDGH

SEQ ID NO: 107328 - protein, 170 aa, Glycine max
  Coding DNA Sequence Number=SeqID_15643
MPASVRKPPFMHRERKPRPTNWDQYGVKGFQLTIPIAAIKQWLPDERSTYSAPRGRDHGLLYCHEVSMANMETLQKVPQGMGACMVQKTRTIRAQRHLRTTKREEVEAPEEDLEDGRHVELRDVNVVRLEQTQEGPSSLNREEHGRNKFRGALWGSNNELNSGGRKGTNR

SEQ ID NO: 107329 - protein, 108 aa, Glycine max
  Coding DNA Sequence Number=SeqID_15644
MEETLAQFMQVSTSNPKSTESAIKNLEVQVGQLANQLAERPSNNFIANTEKNPREECKAVMTRSKMVIQAEESKANQKVEGFKQQLADELALEPVDDLVELEEIVEEV

SEQ ID NO: 107330 - protein, 34 aa, Glycine max
  Coding DNA Sequence Number=SeqID_15645
MACMDTNIVTASIKAIVSGINRCSVQPMVMEKIA

SEQ ID NO: 107331 - protein, 133 aa, Glycine max
  Coding DNA Sequence Number=SeqID_15646
WPLGRGKQLPPNLGNLMTLHALYQRSLRSDMNKMNASLYVTEYDEFRRELERRSWHKALTRKPEGHIDVALVKEFYANLFDPEDKSPRQVRVRGKLIKFDAETLNTFLETPIVLEPGERYSAYSRFCHSHPHP

SEQ ID NO: 107332 - protein, 152 aa, Glycine max
  Coding DNA Sequence Number=SeqID_15647
  Subcellular localization annotation: CTP_CleavageSite=44; ConfidenceScore=5.39e-01
MATQLNQAQSQNSNKLPSQIVQNPKNVSAITLRSGNQIQVPPPVAAPAREPIKLHSTHEKEDEIVAQKRKLPNKNFHAGGPSSSNSDLPQPPIRLPFPPRAIPNKKIEEAEKEILEIVATYPSAGGRRVTRGMRVPRKEYARSRHQHLFEEN

SEQ ID NO: 107333 - protein, 85 aa, Glycine max
  Coding DNA Sequence Number=SeqID_15648
  Homolog annotation: Hit_ID=P03851; Match level="QueryCoverage=90%, HitCoverage=91%, E-value=2e-33, Identity=87%"; Hit description =Uncharacterized 9.4 kDa protein
VGRSKLGCVHEPPVHPDRCALSGNYRLESNPVRHDLWPLDSATGNRISRSRYVGGATEFLKCWPNYGCTRRTVFGICALLKTVNF

SEQ ID NO: 107334 - protein, 285 aa, Glycine max
  Coding DNA Sequence Number=SeqID_15649
  Homolog annotation: Hit_ID=Q6WAY6; Match level="QueryCoverage=84%, HitCoverage=43%, E-value=7e-14, Identity=24%"; Hit description =Putative uncharacterized protein
MGWLEYQGNVWKQKQESWQAAIDAFLAFHDCKESPVVAILADLYDTFNRRCEKNSTRIVCCTPTLYVWLVSHLFCQEVRLACPLEGHRSCIEKKEASWDRLLASKEGVFVNWFPRWKEGRTRIVISCGGFPNVPLMGTRGCINYNPILAIRQLGTNAEALQKVRKAWEMVQKKDKELRGSSNGPIGCYHRWLKAYTQGVDWLPNLRTTKGVEVEAPKEDEEVQALRTELEKAQIVKEKFKSTNIRIRKENTELRDINIASTKALEQETKRARREEHGQNKFPRGL

SEQ ID NO: 107335 - protein, 91 aa, Glycine max
  Coding DNA Sequence Number=SeqID_15650
  Subcellular localization annotation: CTP_CleavageSite=50; ConfidenceScore=5.03e-01
MYHRLFSVTTTQVDVPSTCTTKDVPSNVLRQSLQAVSPLKLCEGETKDISGDMTTVQGTWDPWPSLAQDTPLPAQDAPSSPQDDPTPAQEE

SEQ ID NO: 107336 - protein, 49 aa, Glycine max
  Coding DNA Sequence Number=SeqID_15651
MSNSLGIKIGEKLVELLSTKGLDRFQRNNPPSFNGGYNPNGAQNCDKGN

SEQ ID NO: 107337 - protein, 71 aa, Glycine max
  Coding DNA Sequence Number=SeqID_15652
  Subcellular localization annotation: CTP_CleavageSite=38; ConfidenceScore=5.05e-01
TYQGNPCGVYPDLSSLTGSGVYPDLSSFTGSGVYPDLSSFTGSGVIQTFVACIKRSAPTQVHIIWYQSFGS

SEQ ID NO: 107338 - protein, 121 aa, Glycine max
  Coding DNA Sequence Number=SeqID_15653
  Gene Ontology: Mol. function=galactosyltransferase activity; Cellular component=membrane; Biological process=protein amino acid glycosylation
  Homolog annotation: Hit_ID=Q8LCV8; Match level="QueryCoverage=100%, HitCoverage=99%, E-value=6e-19, Identity=39%"; Hit description =Putative uncharacterized protein
MTNSIIKILNIILFLALVSKGYSQCSLHDIHISQKQTGATIHGKKEWSVTIANWCSCYQSNVMLNCKGFQSVEPIDPQFLKISGNVCLVSNGQPLFRGVTVFNYAWDKPFPFIPISSKITC

SEQ ID NO: 107339 - protein, 209 aa, Glycine max
  Coding DNA Sequence Number=SeqID_15654
  Homolog annotation: Hit_ID=Q6WAY6; Match level="QueryCoverage=88%, HitCoverage=32%, E-value=1e-21, Identity=35%"; Hit description =Putative uncharacterized protein
MGTNQTGKRFYQVKIKGLDITSIKELGRLMGPLLMQAFCKAYRKILDLTIAEISTEAIASLTQYYDQPLRCFTFGDFQLVPTVEEFEEILGCPLGGRKSYLFSRFLPSLSKISVVVRDSGRGLDRVKQTRNDVVGLPRKYLEGKARDMANQEEWAPFMDVLALLIFGVVLFPNMDGLVDLAAIDAFLAYHHSKESPVVAVLADLFDTFD

SEQ ID NO: 107340 - protein, 72 aa, Glycine max
  Coding DNA Sequence Number=SeqID_15655
  Gene Ontology: Mol. function=protein binding
  Homolog annotation: Hit_ID=Q2HVB4; Match level="QueryCoverage=77%, HitCoverage=13%, E-value=9e-19, Identity=76%"; Hit description =BTB/POZ; MATH
  Pfam annotation: Domain name=BTB; Domain location=1-72; Score=-11.0; E_value=0.036; Accession=PF00651.22; Description=BTBPOZ domain
DEESFDVTFSVGGERFHAHKLVLAARSTMFETQFFNAMKKDDQEIVVIDMEPKVFKVSHSVPYKIAGLTAVR

SEQ ID NO: 107341 - protein, 214 aa, Glycine max
  Coding DNA Sequence Number=SeqID_15656
  Homolog annotation: Hit_ID=UPI00016621D1; Match level="QueryCoverage =78%, HitCoverage=41%, E-value=1e-13, Identity=32%"; Hit description =UPI00016621D1 related cluster
DYTSSPSEDYASPLQRATYLHLRRGHALTVRGLHVLPFRGIHVLPFRGLHVLAIRGLHVLTFKGLDIFTFRELHALTFRGLHVRTFRGLHVLAFRGLHVVTFRGLHVLPFRGIHALTFVGLHTLTLRGLRVLAFRGLHVLTFRGLHALAFIGLHALAFIGLHICAFKELKGSPPQDTQWTRRSPTGPWGFQLWLWASVSPTGCSSPQQGHAIVT

SEQ ID NO: 107342 - protein, 108 aa, Glycine max
  Coding DNA Sequence Number=SeqID_15657
  Homolog annotation: Hit_ID=UPI0000ECBAF8; Match level="QueryCoverage =37%, HitCoverage=48%, E-value=1e-16, Identity=100%"; Hit description= UPI0000ECBAF8 related cluster
  Subcellular localization annotation: CTP_CleavageSite=31; ConfidenceScore=5.19e-01
AQYANRLSPRVGRFINAAGTTGFPTGKRAVSATQLMAGLMESNGNSVKDAEKQITRMQAWHWPSFYNVVTGKTLALPNLIALQHIPLSPAGVIAKRPAPIALPNSCAA

SEQ ID NO: 107343 - protein, 151 aa, Glycine max
  Coding DNA Sequence Number=SeqID_15658
MVGYAPSSFANLVFARERIEVEGEDEGETHAVTVIPIRPSFPPNQQCHYSANNKPSPYPPPSYPQRPSLNQPQSLSTALPMTNNTFSIDQNTNQEMNFAAKKPVAITPARFPQPPFFRGYDSNTVCVYHGGAPGHSIEHCMTLKHKVQSLN

SEQ ID NO: 107344 - protein, 144 aa, Glycine max
  Coding DNA Sequence Number=SeqID_15659
  Homolog annotation: Hit_ID=Q2HTC4; Match level="QueryCoverage=47%, HitCoverage=9%, E-value=2e-29, Identity=95%"; Hit description =Conserved oligomeric Golgi complex component 4, related
GGGAYGKTPATRPFYGSWPFAGLLLTCSFLRYPLILWITVLPPLSELIPLAAAERPSAARNSYDHDYEFELGTQLGEDYTEFMISKIKALTSVDPELLPRATKAFRSGSFSKVAQDLTGFYVILEGFFMVENVRKAIKIDEGIL

SEQ ID NO: 107345 - protein, 75 aa, Glycine max
  Coding DNA Sequence Number=SeqID_15660
MCGISCQCQDSTSDSPQISASPHPLDFAPYASGSYSAQWNAPGLLHDMHMLRSSRILRKMEVVFVIGSAVDRLCG

SEQ ID NO: 107346 - protein, 77 aa, Glycine max
  Coding DNA Sequence Number=SeqID_15661
  Homolog annotation: Hit_ID=UPI0000ECBAF8; Match level="QueryCoverage =53%, HitCoverage=48%, E-value=1e-16, Identity=100%"; Hit description= UPI0000ECBAF8 related cluster
MNEVKWPPPHMRWPHMKANQSRPAGMQAWHWPSFYNVVTGKTLALPNLIALQHIPLSPAGVIAKRPAPIALPNSCAA

SEQ ID NO: 107347 - protein, 120 aa, Glycine max
  Coding DNA Sequence Number=SeqID_15662
MQFAGQLCLVPGQVFVDYIEWFFRISHPFMILTQAGDQPRDAPAADPEDYIQPPSPQVPVAFVPPSHVDDYDGYETIAQRSERVLNLRIVTACTELYDIMHDCQTIARGGPSADGTVRAR

SEQ ID NO: 107348 - protein, 143 aa, Glycine max
  Coding DNA Sequence Number=SeqID_15663
  Subcellular localization annotation: CTP_CleavageSite=38; ConfidenceScore=5.39e-01
MPARHTASATPRPVNNTVPGASYNNAQRPPPKDNFSPVPMAYSGPSLLENHLVVAIPERLSFQEEGPNVKTNPLASHGGASVNAIKEDGPSRAKRLGEVATSRRFIYQSLLAACMVSPRGVTRHGNLSRGGRIASAAHGLGAA

SEQ ID NO: 107349 - protein, 220 aa, Glycine max
  Coding DNA Sequence Number=SeqID_15664
  Gene Ontology: Mol. function=motor activity; Cellular component=cell projection
  Homolog annotation: Hit_ID=UPI00006A2D9E; Match level="QueryCoverage =94%, HitCoverage=100%, E-value=1e-21, Identity=18%"; Hit description= UPI00006A2D9E related cluster
MSSPLEGCTPSPVLTFRGLHVLTFGGQHILAFRGLHALAFRGLHVLTFRGLHVLTFRGLHALAFRGLHILAFRGLHILTFRGLHVLTFRGLHAFAFRGLHILAFRGLHAFAFRGLHVLPFRGLHVLAFRGLHALAFRGLHVLAFKGLHVLTFRGLQALAIKGLHILAFRGLHAIAFSGLHILTFRGLHALARPHLQRVARPRLQRTTRPHLQRATRPRLK

SEQ ID NO: 107350 - protein, 102 aa, Glycine max
  Coding DNA Sequence Number=SeqID_15665
  Homolog annotation: Hit_ID=A5AZ88; Match level="QueryCoverage=75%, HitCoverage=7%, E-value=4e-11, Identity=37%"; Hit description =Putative uncharacterized protein
EPVLYVSEDGRAGDNANQNDFAHFTFPADFVVMDIEEDVDIPLILGRPFMLTTSYVVDMGKRKLEMGIEDQKISFDLFDEEKQLLDQNVCLQVKEFEEKVLK

SEQ ID NO: 107351 - protein, 122 aa, Glycine max
  Coding DNA Sequence Number=SeqID_15666
  Homolog annotation: Hit_ID=A5B7R4; Match level="QueryCoverage=90%, HitCoverage=33%, E-value=3e-08, Identity=29%"; Hit description =Putative uncharacterized protein
MLANNQDQPWSRILISKYGGWKELICGGRRNFTSQWWQDLKSIFQQHHNECLTDNLKWRVGRGSSINFWKHKWMEDNCTLQGKYPQLYLISKQQNSSINYMGDFVEGSGNGSYHGEGLPNAL

SEQ ID NO: 107352 - protein, 75 aa, Glycine max
  Coding DNA Sequence Number=SeqID_15667
  Homolog annotation: Hit_ID=A6FJQ2; Match level="QueryCoverage=50%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGTAPIGDSSPRFGHWSMGDMLYSCINECH

SEQ ID NO: 107353 - protein, 50 aa, Glycine max
  Coding DNA Sequence Number=SeqID_15668
MVPSKDENSVEDDKEGGIGAGDAPVAPGRGVRVAATEVDEPLHFLDNSSI

SEQ ID NO: 107354 - protein, 25 aa, Glycine max
  Coding DNA Sequence Number=SeqID_15669
MTVVMNRAKYNLKHIDFKVFIADMP

SEQ ID NO: 107355 - protein, 94 aa, Glycine max
  Coding DNA Sequence Number=SeqID_15670
MGAKYLKVVKRGSHPNKRMGDQENFREDCAAKQEKIGVPGWMMLFGHIGLPTKHPIGMSPYWVVFGKACHLPMEIEHKTILGSEDLQLLYGSSW

SEQ ID NO: 107356 - protein, 379 aa, Glycine max
  Coding DNA Sequence Number=SeqID_15671
  Gene Ontology: Mol. function=transporter activity; Cellular component= cell outer membrane; Biological process=transport
  Homolog annotation: Hit_ID=A7K6P0; Match level="QueryCoverage=99%, HitCoverage=36%, E-value=0.0, Identity=88%"; Hit description=FecA
  Pfam annotation: Domain name=TonB_dep_Rec; Domain location=57-378; Score=39.9; E_value=9.1e-09; Accession=PF00593.15; Description=TonB dependent receptor
MRTNTRLGVRYETTDVMSTSVIAVPESIEWQANNDFRIVLSDEQQPFTEKARYSYILPNLDFSIDLTEELKGRVSFGKSIARAPYGNLYAGPGAQQPFGSVLIDPSSRASGNSQNPSLKPLESDNLDLGLEWYFADASYVSLTYWNKSVSNFIGNTVVQESLYGLTDPTSGPDARAALDFLTSGACVAQVGPANAAACSANDTSLFTALALLRNNPAGLGAYNGTDAQVLATEAAYDLYGQANDPLYQFNVNRPINQNKSKLHGWELGGQYFFGDTGFGVLANYTVVKGDVGYNNGGDPGIDQFSLTGLSDTANAMLMYEKYGWSVRLAWNWRDQYLILANQGSSRNPYYVEPYEQWDLSVNYALDDHWSFSLEAINLT

SEQ ID NO: 107357 - protein, 123 aa, Glycine max
  Coding DNA Sequence Number=SeqID_15672
MPGSRQARQGASAGVGGCRGWLNYAASEQIVLRVHHMRCEIPHRCVRRKYRIRRHSPFRLRNCWEGRSVRASSLLRQLAKGGCAARRLSWVTPVFSQSRRCKTTASAKLACLQVDSRGSLPFG

SEQ ID NO: 107358 - protein, 176 aa, Glycine max
  Coding DNA Sequence Number=SeqID_15673
MEPMKEQMPTMMESMMSMRKMIEVNTVTVVAASTATEVDPTHPSSINQASHLVPDMIGQGGEALGSTGSPHFVQVQSKHSFRPYGLPPNYTPPNVAHAPDENVDNSAPIPIESQQHKSGHAQVPQPMGERPEVPRDHTLANFEPHLGYATKGQAFGGMPLPNPLGGPQYRPQPHLQ

SEQ ID NO: 107359 - protein, 221 aa, Glycine max
  Coding DNA Sequence Number=SeqID_15674
  Gene Ontology: Mol. function=transaldolase activity; Cellular component=cytoplasm; Biological process=carbohydrate metabolic process
  Homolog annotation: Hit_ID=Q3Z606; Match level="QueryCoverage=100%, HitCoverage=69%, E-value=1e-109, Identity=89%"; Hit description =Transaldolase 1
  Pfam annotation: Domain name=Transaldolase; Domain location=13-221; Score=354.0; E_value=2.6e-103; Accession=PF00923.10; Description =Transaldolase
MTDKLTSLRQLTTVVADTGDIAAMKLYQPQDATTNPSLILNAAQIPEYRKLIDEAISWARQQSSNKEEQLALVSDKLAVNIGLEILKLIPGRISTEVDARLSYDTEASIAKARSLIKLYNDAGISNDRILIKLASTWQGIRAAEQLEKEGINCNLTLLFSFAQARACAEAGVFLISPFVGRILDWYKQNTDKKEYAAHEDPGVVSVSEIYNYYKQHGYETV

SEQ ID NO: 107360 - protein, 175 aa, Glycine max
  Coding DNA Sequence Number=SeqID_15675
MTGPLDESISCFLIRVDPWVLVPIFFRGLRVLTSLILEGANCANTTREGGYHVVTMHTMARFHSCHCKETSADRAYQHDHSYTDIGRAHKTPSGPKEVQQGPGSPALVMGLYQSYRVPVPPGKVMPLRHRIAHAGHPMDPKKSNRVLGFPALITGLCQFYGVPVIPNKVIRPPTN

SEQ ID NO: 107361 - protein, 224 aa, Glycine max
  Coding DNA Sequence Number=SeqID_15676
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=29%, HitCoverage=65%, E-value=6e-33, Identity=100%"; Hit description=LacZ protein
MRKRHAPRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTLCSAEAFRLPVEKVPRVDFGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 107362 - protein, 148 aa, Glycine max
  Coding DNA Sequence Number=SeqID_15677
KKTSKARWPCLWHRDAFMIWQTLIVKELTYLKDPAKRILAIKTWHIEFHMWLIQMGWQWMGGDGVGVWGRWLNGKGGEMFKHGVHFLVHGRLCLGQGSVFVGEGGLSLRKLGDGILQAFEGGLAGMMFRHGGRWWRGRSDQNDRNRYI

SEQ ID NO: 107363 - protein, 233 aa, Glycine max
  Coding DNA Sequence Number=SeqID_15678
WIPFDADALSQFLGDLLVLEEGQQCEFSQRRNRADGFDEEAIAQLLCTPGQDFTRTAAGRRVRIMRTSMTTLTQTWMTLLLSNVLPSDHNSDLPLPKCQLVYAILTRMSVHVAQVIVDAIYLFAGMAPTRHPLDPDKSNWALGFSALITGLYQSFGVPITPSKASSHRGQGQGSALFACPTPKQFGDEVAWPADWPEAQAGEEPVGSLGEADESHMDEEMTDLLDFLGGSGAK

SEQ ID NO: 107364 - protein, 58 aa, Glycine max
  Coding DNA Sequence Number=SeqID_15679
MRKRTLPEGERRTGGRSLWKNASNAAFLRFLAFCWPFAHMFFPALSPDSVDNRITAFE

SEQ ID NO: 107365 - protein, 331 aa, Glycine max
  Coding DNA Sequence Number=SeqID_15680
  Gene Ontology: Mol. function=RNA-directed DNA polymerase activity; Biological process=regulation of transcription, DNA-dependent
  Homolog annotation: Hit_ID=A5C5U6; Match level="QueryCoverage=90%, HitCoverage=14%, E-value=8e-45, Identity=34%"; Hit description =Putative uncharacterized protein
MASESDEDSETDLQKQIQKAKQTKTVCNQKPSQLLTQQESTPQPNNSYISKNKFFNVLQMEPEYWDKNPFKATAKVFPPGFHYRPIATNKTRKFYEFILIDTNSVSIKHFKDPKDPNLNTHSTIQILKVMQPRHYGSNLNQPKKFSAPFDLAGYNYWDYIDAWTNVFWHQNSKFKHSWLIYFKNNTVYNFPNWFLQWWNYFGPIPQIFPEEVQQGFQQFNKLYNSKESRIPADLKYFSSFALSWIFSCKQYPPLQRHAFVKWWSQFDTSKAAPDQVKNWFQSNPEFLKPADPETSLFLNQKSQLAEFLASSKSKESLAQNLKEVLQLLQQE

SEQ ID NO: 107366 - protein, 127 aa, Glycine max
  Coding DNA Sequence Number=SeqID_15681
  Homolog annotation: Hit_ID=Q97WP1; Match level="QueryCoverage=90%, HitCoverage=29%, E-value=3e-59, Identity=99%"; Hit description =Putative uncharacterized protein
MEKDGIVGLLEVYSNPEKPEILCSLIDDKGNRKEIMLIKLQDNGVHIYKTEEHYILPPIPQIDSLIKDVIEEVAEELKVDSIVYNYGNIDTNSETLRLSKEWFDMERLALASSKHVALSSDSILGIL

SEQ ID NO: 107367 - protein, 138 aa, Glycine max
  Coding DNA Sequence Number=SeqID_15682
MDSCKRKAIASVSQAGYDRSRFISQKAWDRYSDNVLARNILPKRNVKLYITEFDDFKRELIRRNWHKQLTNLTEGSIDVAIVKEFYANLYVPEDKEPKQVRVRGHLIKFDVDSLNTFLETQRSWSKGRACPLTPGLLD

SEQ ID NO: 107368 - protein, 115 aa, Glycine max
  Coding DNA Sequence Number=SeqID_15683
MGLRITLENGDLTNNARQSIRGAPDSMIENGKLANSARESIRGAPDSMVEDASNSARQSIHGSPNKIENGELANSAGNAILTGSRPDGGGRMNSARQSIHGSPNKIGEWRIGEQR

SEQ ID NO: 107369 - protein, 676 aa, Glycine max
  Coding DNA Sequence Number=SeqID_15684
  Gene Ontology: Mol. function=protein binding
  Homolog annotation: Hit_ID=A7PGP2; Match level="QueryCoverage=99%, HitCoverage=99%, E-value=0.0, Identity=68%"; Hit description =Chromosome chr17 scaffold_16, whole genome shotgun sequence
  Pfam annotation: Domain name=DENN; Domain location=153-336; Score= -75.1; E_value=0.069; Accession=PF02141.12; Description=DENN (AEX-3) domain
  Pfam annotation: Domain name=DUF1630; Domain location=14-642; Score =994.0; E_value=5.6e-296; Accession=PF07792.3; Description=Protein of unknown function (DUF1630)
  Pfam module annotation: Pfam domain module=DENN::DUF1630; Domain location=153-336::14-642
MSQSPSFKVKEELSPSLDPESLQRWIVALCAIRFDLEQGQLVEVCYPPGCLTHDEELEIAYSSFPDSISQQQNRSTIHDCIFFFRFRRHLKCQTSNATHSKITEVDKEFSLKSIDKNSVSKRLSSTSSGNVSKYMYGFVFNRQRHDERLKRGGEQKSVVILSHSPYSSVFRPLLQIVGPLYFDIGKIALEHIAAYVSTWPAPVPGKLMDLPIGNTMLKVNLPPAHSLPMENGVSLDESAAPVAPFLPNNQYIPQGLFHDSDLFGAFRGLLLQLWLLWELLLVGEPILIIAPTPPQCCEAVASLVSLVAPLLCSVDFRPYFTIHDPEFACLNSIREGETFPPMVLGVTNIFFLKALRKIPHIVSVGSPPPSSNRVPLSTRSSTGKVSNRPESLGLQQLSLQKFSPSSLLNAIKLRREGPLCLMTQHKEAIWTTYSATTKPDTSILNRLIDAGMSPRVEESMSVVNNEILRRHFLELTINFLAPFGLYFRTTAPLEGSSPYVDPPSLPPFNADEFLASLSARGPGKFILKRMKSNWLDFYRRFLNGPNFMPWFQRRHAVAEQEQDRLWRHARMKTDIQHLISKMSELEVVDSFCVIERLLLRELLLQQPGNGGIDSTATCHKLMGDLQAVFNALTKDMQQLMISNPQRASLLQGSPELTKLSAHSLVQAGDASSTSPT

SEQ ID NO: 107370 - protein, 361 aa, Glycine max
  Coding DNA Sequence Number=SeqID_15685
  Gene Ontology: Cellular component=mitochondrial matrix
  Homolog annotation: Hit_ID=A7PEV1; Match level="QueryCoverage=90%, HitCoverage=98%, E-value=1e-27, Identity=32%"; Hit description =Chromosome chr11 scaffold_13, whole genome shotgun sequence
MGSRRDEAPAINSTNVFAALGSLKKKKKKPEKDHQGPSKPKDKKDVFWAPAPLTSKSWADVDDEDDDDYYATTAPPESVWAAPTVTQNDAAAAETVDWFNCMDITAIPKSESESELEGLDDADDDAEDEQENENDLEVTEEAEPVLRKPPEPPVVTKEAERQLSKKELKKKGLEELEAVLAELGYTPKEPTGQEDDSNGAEKKEEDPNGAVEKKENATGESKNAKKKKKKDKSSKEQKESQDQPHGVDAGTGNATSETAETEKAEDASAIDVKERLKKVASMKKKKSSKEMDAAARAAANEAAARNARLAASKKKEKAHYNQQPVRNGLVLEALSIALGFEFQFVHDVSLPPGSKLKIVQQ

SEQ ID NO: 107371 - protein, 129 aa, Glycine max
  Coding DNA Sequence Number=SeqID_15686
  Gene Ontology: Mol. function=mismatched DNA binding; Cellular component=MutSalpha complex; Biological process=mismatch repair
  Homolog annotation: Hit_ID=A7PGN9; Match level="QueryCoverage=89%, HitCoverage=91%, E-value=5e-41, Identity=72%"; Hit description =Chromosome chr17 scaffold_16, whole genome shotgun sequence
MFLLYCGLLEGQVEPGACDQSFGIHVAEFANFPESVVTLAREKAAELEDFSPSATSLNHTTQEVGSKRKRAFEPDDMSQGAAKARQFLEAFVALPLETMDKMQALQEVKKLTDTLEKDAENCNWLQQFL

SEQ ID NO: 107372 - protein, 88 aa, Glycine max
  Coding DNA Sequence Number=SeqID_15687
  Subcellular localization annotation: CTP_CleavageSite=29; ConfidenceScore=5.24e-01
MGREPTTTTWQISPSGTLTGVSEQPATPSGDMTVQSLSRRGAGACFSEKGVATAIGELPASCNSHWRVAQEEIAITNGDLLAINTSAH

SEQ ID NO: 107373 - protein, 380 aa, Glycine max
  Coding DNA Sequence Number=SeqID_15688
  Gene Ontology: Mol. function=transcription factor activity; Cellular component=nucleus; Biological process=regulation of shoot development
  Homolog annotation: Hit_ID=Q1WK55; Match level="QueryCoverage=94%, HitCoverage=97%, E-value=7e-59, Identity=46%"; Hit description=CYC5
  Pfam annotation: Domain name=TCP; Domain location=112-353; Score =177.4; E_value=3.7e-50; Accession=PF03634.4; Description=TCP family transcription factor
  Subcellular localization annotation: CTP_CleavageSite=38; ConfidenceScore=5.10e-01
MYSSNTFLNGNDLISYPNQPFCFRPFSFESNPTYNFSKEEANSNYALPPPPPPPPLSFFQSPFDENIFLEHHHHDLLLLHQYSLTDSGVSKNLEVVAEISPIPCPEQGGIAMEHTPRKRSSKRDRHSKINTARGLRDRRMRLSLEVAKRFFGLQDMLGFDKASKTVEWLLNQAKGEIKQLAREKTSVVGGGGKSASSTSECEGVSSLDEVAVSTGGVNNEEQERETVPNMMKRRKSKVCRKSAFNAIDKESREKARERARERTREKMRTRRVLVSDASNLNRLSSWNPFETVEDSAGTTHHPSLDVHLHEADQEPISSHNVKEHNLGEDMAHEDNSLALMNKWSPTMLFNSLHNSGILQEHQFAEFQSLGKQWEAYSNQI

SEQ ID NO: 107374 - protein, 901 aa, Glycine max
  Coding DNA Sequence Number=SeqID_15689
  Gene Ontology: Mol. function=metallopeptidase activity; Cellular component=barrier septum; Biological process=regulation of transcription, DNA-dependent
  Homolog annotation: Hit_ID=A7PGN6; Match level="QueryCoverage=84%, HitCoverage=74%, E-value=0.0, Identity=73%"; Hit description =Chromosome chr17 scaffold_16, whole genome shotgun sequence
MAVSSLSLGASMSVFSSQVLFDEKVIDQTIDTRVKLAYALARQWFGVYITPEAPNDEWLLDGLAGFLTDFFIKKHLGNNEARYRRYKANCAVCKVDNGGATALSCSASCKDLYGTQCIGLYGKIRSWKSFRHFANKVGNLERPFLKDFFPRWVGSCGCPVLRKNMVELAVLRGCTALQTSNTSILDINPDTETRDGDTGWPGMMSIRVYELDGMYDHPILPMAGDAWQLLEIQCHSKLAARRFQKPKKGLKLDGSDDNGDVPSMDMRSNTESPLLWIRADPDMEYLAEVHFNQPVQMWINQLEKDKDVIAQAQAIAALEASPQLSFSIVNALNNFLSDSKAFWRVRIEAAFALANSASEETDFSGLLHLMKFYKSRRFDTDIGLPKPNDFHDFAEYFVLEAIPHAVAMVRAADKKSPREAIEFVLQLLKYNDNNGNPYSDVFWLAALVQSVGELEFGQQSHAKLQWNLDYQLYPDIDPDCIKAFRVHSSCKYLVIEIQTAVQRHPTLHGIPRENRMLHMSLTEASNYQKNMLALDSESKPLDLPSSIDDLTQNLGPTMEGLRDALDEAPKDQPCEAPTQVHLEALKEASLEKPKEVFTEFPQEAPIEAPNEISKEADTVSNSHERKRPIKIKVKQSSATSRADTDNQVVERSLGGRNEMDHGASSSVSVDAPQRNFAETVSISNHNIDEVNSWHDRGSRMTASIGSAKFLSDGDELVKELQCTADSSIVYSQPQPEDPSSSSIIQDNNIDADARRYASLQTLSVARFDPDGEPLGKEISARGKEKHKSKEKKRKRESNKGHHDDPEYLERKRLKKEKKRREKELAKLQSDEAKRSSIDMSSKKEEPVVDVVARQVTSVEPTGYDSKLEIKKIDTTKPEPSEGTSGAPKIRIKIKNRMLSKP

SEQ ID NO: 107375 - protein, 109 aa, Glycine max
  Coding DNA Sequence Number=SeqID_15690
MGLDPLEQGVSQHHNVDQSRFPLTPARDSGGGGADDDHDGGGGETGQRELKLVVGEDGVVIIVGFGTKPDILKEYQEEEEPKNEAYLKVLSMHKKYCYGSLTWGSACFH

SEQ ID NO: 107376 - protein, 651 aa, Glycine max
  Coding DNA Sequence Number=SeqID_15691
  Gene Ontology: Mol. function=zinc ion binding; Cellular component =nucleus; Biological process=anti-apoptosis
  Homolog annotation: Hit_ID=A7PGM6; Match level="QueryCoverage=82%, HitCoverage=89%, E-value=1e-118, Identity=45%"; Hit description =Chromosome chr17 scaffold_16, whole genome shotgun sequence
  Pfam annotation: Domain name=zf-C3HC; Domain location=76-204; Score =193.3; E_value=6e-55; Accession=PF07967.4; Description=C3HC zinc finger-like
  Subcellular localization annotation: CTP_CleavageSite=65; ConfidenceScore=5.19e-01
MAQDSEKRFHSIMDKLYHPPKPPSASSSSGVQLPGNSKKRPYQSGVMELNRRGDVAEGQQSSSASATALQGSLCRPWDRGDFTRRLATFKSMSWFAKPKVVGAVNCASRGWINVDIDTIACEACGVRLLFSTPASWNQQQVEKAALVFSLKLDNGHKLLCPWIDNACNETLARFPPATPPVLVDNFRERCFALLQLSALPRISSSAIDYMQSQSPLLEDFLGQSLMLEYGNGSAENSGIGDVSSQEELKLYYQAQKLISLCGWKLHPLPYVVDWKDMSDLSLNNSTNLVVHSAGTNENSKTDENSKDSIGEQMDPYSAVLDCTLCGATTGLWAFCTAPRPVESIRLVGYAEVNGGNANLENRKGVNNTMPDVANSSKDTSSSLNMTIAGGPPPTRQNFKAIISLPIIGQNLRARLSYDSDFRDHVFVDRGGIQSDLQKEKTDNTVNASIGQLVPVSSEIREISNFETGSQASLHDSDVIAGQSSGLKDKMHVHTDADKLNSSTAGYPSTSQKDSTEGEAPLVSHKTLDGEVGSLENYGVKDREENPINRDNVHSSLGKLKNPTVSNKLMEFDPIRQHRHFCSWIASIHDGEPGWKQTLSALYHQKNHLPHSPNRFPSSMPIVKKMGGYWITPWARVLGVPLPYFYNMQSVH

SEQ ID NO: 107377 - protein, 193 aa, Glycine max
  Coding DNA Sequence Number=SeqID_15692
  Gene Ontology: Biological process=response to stress
  Homolog annotation: Hit_ID=A7PGM8; Match level="QueryCoverage=85%, HitCoverage=77%, E-value=1e-48, Identity=62%"; Hit description =Chromosome chr17 scaffold_16, whole genome shotgun sequence
  Pfam annotation: Domain name=Usp; Domain location=2-135; Score=45.8; E_value=1.5e-10; Accession=PF00582.17; Description=Universal stress protein family
MDVRNIAVVVEDVDAARTALQWALDNIIRYGDIITLLHVYPLSRSKSKSKARLLRLRGFQLALSFQDICNNFSNTKVEIVVTEENKEGMKIVAAVREIGASMLVVGLHDQSFLYSLAMVHSNIANYFNCRILAINQPPESPLSPMVGVQGSSTNMDFSQIDISGLQVPEPPPPKVKEKKMKEKSTPLASLEAD

SEQ ID NO: 107378 - protein, 114 aa, Glycine max
  Coding DNA Sequence Number=SeqID_15693
MENRSTSFLWESFELFKLSGLDLIESNDEWITEEGYNDEDEQPQGEGDGDNVELVGDVGGSSNDLVVNAFDRDNLIFMEPNDDAQSEKDLDDGNGDESYDIHGDDPIRGLNMIF

SEQ ID NO: 107379 - protein, 788 aa, Glycine max
  Coding DNA Sequence Number=SeqID_15694
  Gene Ontology: Mol. function=RNA binding; Cellular component =intracellular; Biological process=RNA processing
  Homolog annotation: Hit_ID=A7PGL0; Match level="QueryCoverage=97%, HitCoverage=72%, E-value=0.0, Identity=55%"; Hit description =Chromosome chr17 scaffold_16, whole genome shotgun sequence
  Pfam annotation: Domain name=DUF1604; Domain location=36-124; Score =186.1; E_value=8.7e-53; Accession=PF07713.4; Description=Protein of unknown function (DUF1604)
  Pfam annotation: Domain name=G-patch; Domain location=159-200; Score =3.8; E_value=0.065; Accession=PF01585.14; Description=G-patch domain
  Pfam annotation: Domain name=Surp; Domain location=424-467; Score =52.9; E_value=1.1e-12; Accession=PF01805.11; Description=Surp module
  Pfam module annotation: Pfam domain module=DUF1604::G-patch::Surp; Domain location=36-124::159-200::424-467
MESDEDDFVFYGTPIEREDDSISRKKKAIAESSGQLRALPAWKQEVRDEEGRRRFHGAFTGGYSAGYYNTVGSKEGWAPQSFKSSRKSRAEFKEQNILNFLDEDEKTELEGCFLGTTSQFDTFGFTAAEIARKQAEKEQKQRPSIIPGPAPDEIVVPATESVGVKLLMKMGWSRGRSIKDSHSEALYDARRQARRAFLAFSSDDPKLKITGSEPIEGDVEIFPEEPVNGDAQFSKSTPVYVLNPKQDLHGLGFDPYKHAPEFREKKRSRLASKGGGPGYSKNFSTRDSLFGLKFDLTLSVLSSAGKAAPGFGIGALEELDVEDEDVYATGYEFEDAYVQEVEEPSTLRLENQRTKEQKDQGDLRGFRVASNSDFKMERFEAPLIPKDFVPHHEFSGPLNINRKSCEVTPPDVPPPGDGNLKLLIEGVANLVAKCGKLYEDLSREKNQSNPLFNFLSGGTGHEYYARKLWEAQQKHKTSRQLDGKMPPSVQRLTAESRGQILGEKPLEKSSQDLSSSVSSTDIHLQFNLTDTFTESASLIVPSTQIIPLTRFLDSVPWNLNDKGIAEPLIARLWAQCQSELVNVEKPFKDDPTKQERFEQFLKEKYKGGLRSASSSLASDMSEAARAQERLSFEAAAEAIEKGRQGRGSKPLIPSSMDFIPGGVMQFTSGEVKPKKDLLAEDILKKKMYPKREEFQWRPSPLLCKRFDLIDPYMGKPPPAPRIRSKMDTLIFTSDSVKGTKVDGPVTSKKDISSLQQPTNKDITKSITEMKLKRMWKSKILKGQLTYTR

SEQ ID NO: 107380 - protein, 104 aa, Glycine max
  Coding DNA Sequence Number=SeqID_15695
MVPPPLRLPVMVVTTNLGHAEAYATFIPSQHLYAKLPLLVPPQFPLGFAKLDHCGRRRRKPKGREGSQERYRGRRRDEEAGETLKEDVIEEDATKEDDYENFGK

SEQ ID NO: 107381 - protein, 97 aa, Glycine max
  Coding DNA Sequence Number=SeqID_15696
  Homolog annotation: Hit_ID=A7PGK6; Match level="QueryCoverage=62%, HitCoverage=29%, E-value=9e-07, Identity=42%"; Hit description =Chromosome chr17 scaffold_16, whole genome shotgun sequence
MNTTHEEDCSILGKNPRAYQLLKHAVMKNNHALYSTVMPWKNQIMVRDEFDTLVEETIVCSIPEQGSGCCGISFGSSKLIPANGDDGYIGPSQCAHS

SEQ ID NO: 107382 - protein, 79 aa, Glycine max
  Coding DNA Sequence Number=SeqID_15697
MVRLIQKGRWSAEREMMTRLASGDSRKLMFATIALRRFIADQKNNANVGALVKSGIGIDTVGVKAEVLIFFFHNLRCTT

SEQ ID NO: 107383 - protein, 343 aa, Glycine max
  Coding DNA Sequence Number=SeqID_15698
  Gene Ontology: Mol. function=hydrolase activity
  Homolog annotation: Hit_ID=A5CB22; Match level="QueryCoverage=94%, HitCoverage=91%, E-value=1e-158, Identity=80%"; Hit description =Putative uncharacterized protein
  Pfam annotation: Domain name=Metallophos; Domain location=36-285; Score=57.3; E_value=5.1e-14; Accession=PF00149.19; Description =Calcineurin-like phosphoesterase
MEKKDKGIIRSLRRLETYTMGSANGLTAINGKQPLFSFGLISDVQYADIPDGRSFLGVPRYYRHSIVVLQRAVKEWNTSKRHKFVINFGDIVDGFCPKDQSLSTVKKLVDEFEMFNGPVYHLIGNHCLYNLPRSKLLPLLKIKSFESHAYYDFSPVPEYRFVVLDGYDISAIGWPQDHPKTLEALKFLREKNPNEDKNSPTGLVGLERRFLMFNGAIGKEQMEWLNNVLQEATKLKQKVVVCCHLPLDPGASSKEALLWNYAEVMNLIHKYTCVKLCLSGHDHKGGYSLDSHGVHHRVLEAALECPTGTDAFGYADVYDDRVSLYGTDRMQSTDMYFHPKADL

SEQ ID NO: 107384 - protein, 68 aa, Glycine max
  Coding DNA Sequence Number=SeqID_15699
MAEHVFHTSLLVPFKPGKYTTIAQRFFAMRRYGGGILYAALPLHMQRGCFRIRTHDQQVTKAQLLPLY

SEQ ID NO: 107385 - protein, 546 aa, Glycine max
  Coding DNA Sequence Number=SeqID_15700
  Gene Ontology: Mol. function=protein binding; Cellular component=pre -autophagosomal structure membrane; Biological process=protein transport
  Homolog annotation: Hit_ID=Q9FGS2; Match level="QueryCoverage=95%, HitCoverage=91%, E-value=0.0, Identity=62%"; Hit description=Genomic DNA, chromosome 5, TAC clone:K6A12
  Pfam annotation: Domain name=ATG16; Domain location=17-174; Score =21.9; E_value=5.1e-07; Accession=PF08614.2; Description=Autophagy protein 16 (ATG16)
  Pfam annotation: Domain name=WD40; Domain location=274-312; Score =32.2; E_value=1.8e-06; Accession=PF00400.23; Description=WD domain, G-beta repeat
  Pfam annotation: Domain name=WD40; Domain location=316-354; Score =18.6; E_value=0.024; Accession=PF00400.23; Description=WD domain, G -beta repeat
  Pfam annotation: Domain name=WD40; Domain location=358-397; Score =39.7; E_value=1e-08; Accession=PF00400.23; Description=WD domain, G -beta repeat
  Pfam annotation: Domain name=WD40; Domain location=401-438; Score =26.9; E_value=7.2e-05; Accession=PF00400.23; Description=WD domain, G-beta repeat
  Pfam annotation: Domain name=WD40; Domain location=442-480; Score =26.1; E_value=0.00013; Accession=PF00400.23; Description=WD domain, G-beta repeat
  Pfam annotation: Domain name=WD40; Domain location=488-526; Score =17.5; E_value=0.05; Accession=PF00400.23; Description=WD domain, G -beta repeat
  Pfam module annotation: Pfam domain module=ATG16::WD40::WD40::WD40::WD 40::WD40::WD40; Domain location=17-174::274-312::316-354::358 -397::401-438::442-480::488-526
MAKARKSQEEIASEAIKHALKALRKRHLLEEAAHAPTVLALSRPIVSQGSEWKEKAENLQMELQQCYKAQSRLSEQLVVEVAESRASKTSLQEKENALADLQKELTELRDECSQLKVDLEEKIKSLELVVSENSELKAQLEQMTTKANKAEAENKMLIDRWMLEKMKDAERLNENTSLWPMAPPSQIAYGRRMVEYGRTPHCGPWHRHHKLPIAVGKKSTTHSAMAAMANTLYEEMVEKLRASGLEQLARQQVDGIVRRSEEGAEFFFDSNIPSTCKYRLRAHEGGCASMLFEYNSSKLITGGQDRLVKMWDANTGSLSSTLHGCLGSVLDLTITHDNQSVIAASSSNNLYVWDVNSGRVRHTLTGHTDKVCAVDVSKISSRHVVSAAYDRTIKVWDLVKGYCTNTVIFRSNCNSLSFSMDGQTIFSGHVDGNLRLWDIQTGKLLSEVAAHSLAVTSLSLSRNGNVVLTSGRDNLHNLFDVRSLEVCGTLKAMGNRVASNWSRSCISPDDNHVAAGSADGSVYIWSISKGYKDLAAVGTDRNEAPD

SEQ ID NO: 107386 - protein, 108 aa, Glycine max
  Coding DNA Sequence Number=SeqID_15701
  Homolog annotation: Hit_ID=A6FJQ2; Match level="QueryCoverage=35%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPDKNKEPKDLIGIRI

SEQ ID NO: 107387 - protein, 973 aa, Glycine max
  Coding DNA Sequence Number=SeqID_15702
  Gene Ontology: Mol. function=DNA-directed DNA polymerase activity; Cellular component=DNA polymerase III complex; Biological process =DNA replication
  Homolog annotation: Hit_ID=A7PCL7; Match level="QueryCoverage=99%, HitCoverage=98%, E-value=0.0, Identity=51%"; Hit description =Chromosome chr17 scaffold_12, whole genome shotgun sequence
  Pfam annotation: Domain name=AAA; Domain location=327-517; Score=2.6; E_value=1.1e-05; Accession=PF00004.20; Description=ATPase family associated with various cellular activities (AAA)
  Pfam annotation: Domain name=DNA_pol3_delta; Domain location=368-637; Score=-77.6; E_value=0.0074; Accession=PF06144.4; Description=DNA polymerase III, delta subunit
  Pfam module annotation: Pfam domain module=AAA::DNA_pol3_delta; Domain location=327-517::368-637
MDGRRHSVDIPISKTLMALRRVRSLRDPSTNGVSRLSPLIDDGDWEDGSSNGVSLSLRFLNGSHACDSNGNGLLRSSSLDFKGQREQDTAEFELDMWNSKMNHCGISCQEGQQDDGLVYSNPKQQCISGDKSSNESCCSNHEGRGLDLVSIMPSSNHLKDGESCYLSTATRVEHSKSARKSLRKNQVKPSEVIGDIASHVGSQQCLSVFDAPSARSASEHITQDEDVLDNYHGCGLRSCWSKSPRFRESNHYSEIEGLPLILQHVSETDLNGHRNMRHIGGEISPTLETPRSLSMKFRPKSFSDLVGHNVIGKSLLGAISTGRISSFYLFHGPRGTGKTSASRIFAAALNCLSPLEQKPCGLCRECVLFFLGRSKHVKEIDSLRINRADKVKSLVKNACIPRVSSCFKVFIVDECQLLHAETWACLLNSLENVSPHVVFVMITPDLDKLPPSALSRAQRYHFAKIKDVDIAIRLEKICVEEGLESEQVALDFIAARSCGSLRDAETMLDQLSLLGKKITISLVHELTGVISDDELLDLLDLALSTDTSNTVIRARELVRTRIDPLQLISQLANLIMDILAGKFELGDSEIRRFCNRYTSEADLQKLSRALRILSETEKQLRISKNQTTWFTAALLQLSSVEYSSADTNDTKLCARSASNRGDGDICSTSPKGDSLEHLATTGQCDDKSDTLGLGVREDHRRTLDSIWYKATEMCQSNRLKTFLRKQGKLSSVCISQVAELEFHHRDYVSRAEKSWRLIASSLQFILGCNLELRINCVPSCTSDSIYAKLKRTSFSFFGCSRRIRWKSISSNEQGSESDYADYTSQRPMMKTQTLTCSSNREPRVPSFESYNGMQVVTTLRSSEGNLLSSGKMFLNRPDQETPRISCSGVDSLKEEGCNYELLAPSTLDLDNQSDCFPRTRWLHKKFSSSYASQEKNFVLSIPKFKCSEAYGYDLEPRVFSHSSNNCINAIEEK

SEQ ID NO: 107388 - protein, 553 aa, Glycine max
  Coding DNA Sequence Number=SeqID_15703
  Gene Ontology: Mol. function=nucleic acid binding; Cellular component= nucleus; Biological process=RNA metabolic process
  Homolog annotation: Hit_ID=A7PCK0; Match level="QueryCoverage=70%, HitCoverage=70%, E-value=1e-127, Identity=47%"; Hit description =Chromosome chr17 scaffold_12, whole genome shotgun sequence
  Pfam annotation: Domain name=zf-CCCH; Domain location=154-180; Score =34.3; E_value=4.3e-07; Accession=PF00642.15; Description=Zinc finger C-x8-C-x5-C-x3-H type (and similar)
  Pfam annotation: Domain name=zf-CCCH; Domain location=216-242; Score =33.4; E_value=8e-07; Accession=PF00642.15; Description=Zinc finger C- x8-C-x5-C-x3-H type (and similar)
  Pfam annotation: Domain name=zf-CCCH; Domain location=264-290; Score =47.7; E_value=4.1e-11; Accession=PF00642.15; Description=Zinc finger C-x8-C-x5-C-x3-H type (and similar)
  Pfam annotation: Domain name=zf-CCCH; Domain location=439-465; Score =38.4; E_value=2.6e-08; Accession=PF00642.15; Description=Zinc finger C-x8-C-x5-C-x3-H type (and similar)
  Pfam annotation: Domain name=zf-CCCH; Domain location=485-511; Score =42.2; E_value=1.9e-09; Accession=PF00642.15; Description=Zinc finger C-x8-C-x5-C-x3-H type (and similar)
  Pfam module annotation: Pfam domain module=zf-CCCH::zf-CCCH::zf -CCCH::zf-CCCH::zf-CCCH; Domain location=154-180::216-242::264 -290::439-465::485-511
MGGSESVSVPLSISNGEEPQLGASSSPAAPPEPSDLNHAAEEEALSRELQSKLDLKDGDESEERVSDLNDGRGVCDEETGKPDGDSRGWETNSWNEEVGVDAEVHVFGDGDVHDAGDGDVHDVGDGDVDVDVDDEVEKKEGGNSGLAQHYPLRPEAEDCAFYIKTGNCKFGFNCKFNHPIRRKSQWNCWVEKKGVLPLLKAVKEKAGEREETTERSGMTECKYYQRSGGCKFGKSCKYNHTRGKISTAPAPLLELNFLGLPIRLGERECPYYMRTGSCKFGANCKFNHPDPTAVGGVGGDPASGYGNGGSISLQGVSQTSVPSWSSPRTLNESSPFVPMMLSPTQGVSTQSSDWNGYQTCHLSYVFCYRHIKESCRLSNAHLALCPGAILLIPKKASVYLPERNMHPPSTFVMNNPAIDTNVYMHHQKQMPVDEFPERPGEPECSYFLKTGDCKFKSNCKFNHPKNRVARLPPCNLSDKGLPLRPDQSVCSHYSRYGICKFGPACKFDHPINLQPVMIPGLGQQSYSNSASVEVAGIFGSTGVVTDATIQQSV

SEQ ID NO: 107389 - protein, 380 aa, Glycine max
  Coding DNA Sequence Number=SeqID_15704
  Gene Ontology: Mol. function=hydrolase activity, acting on ester bonds; Cellular component=cellular_component; Biological process =lipid metabolic process
  Homolog annotation: Hit_ID=A7PCJ3; Match level="QueryCoverage=90%, HitCoverage=89%, E-value=1e-139, Identity=67%"; Hit description =Chromosome chr17 scaffold_12, whole genome shotgun sequence
  Pfam annotation: Domain name=Lipase_GDSL; Domain location=43-359; Score=126.9; E_value=5.9e-35; Accession=PF00657.13; Description=GDSL- like LipaseAcylhydrolase
  Subcellular localization annotation: CTP_CleavageSite=95; ConfidenceScore=5.05e-01
MASSVSSMVSTTLLLITICTLSSLLSVASAATEEGRTRPFKRVYAFGDSFTDTGNTQNAEGPSGFGHVSNSPYGTTFFNHSTNRYSDGRLVIDFVAEALSLPYLPPYRHSKGNDTFGVNFAVAGSTAINHLFFVKHNLSLDITPQSIQTQMIWFNRYLESQDCQESKCNDFDDTLFWFGEIGVNDYAYTLGSTVSDETIRKLAISSVSGALQTLLEKGAKYLVVQGLPLTGCLTLSMYLAPPDDRDDIGCVKSVNNQSYYHNLVLQDKLQEFRKQYPQAVILYADYYDAYRTVMKNPSKFGFKETFNVCCGSGEPPYNFTVFATCGTPNATVCSSPSQYINWDGVHLTEAMYKVISSMFLQGNFTQPPFNFLLGKKERVG

SEQ ID NO: 107390 - protein, 121 aa, Glycine max
  Coding DNA Sequence Number=SeqID_15705
MNEEASKDTLGSTRKEKGGIYKSYLTSSRLLGSFGSLGTWSFSKTRCGTHGTPSLKLIIWLGRSKWPLPNPSPSPPDPNTIKINTDGSSFGNPGISGYGGVFRNEHGHVASWFLGQQWVYD

SEQ ID NO: 107391 - protein, 76 aa, Glycine max
  Coding DNA Sequence Number=SeqID_15706
LLDIGPLSTSEDEDLENKNYKYSMVEITFSGPMEVFGVRAVPALSNNLFGFSGLAAVADSVLVVAFACSSSLLLPL

SEQ ID NO: 107392 - protein, 704 aa, Glycine max
  Coding DNA Sequence Number=SeqID_15707
  Gene Ontology: Mol. function=hydrolase activity; Cellular component =nucleus; Biological process=mRNA processing
  Homolog annotation: Hit_ID=A7PHF3; Match level="QueryCoverage=100%, HitCoverage=80%, E-value=0.0, Identity=70%"; Hit description =Chromosome chr17 scaffold_16, whole genome shotgun sequence
  Pfam annotation: Domain name=RMMBL; Domain location=257-295; Score =34.6; E_value=3.7e-07; Accession=PF07521.3; Description=RNA -metabolising metallo-beta-lactamase
MELIRKRLKDHGIFVPSRLKVFRTRKKFMAGPFEVEPITVTHSIPDCCGLVLRCSDGTILHTGDWKIDETPLDGRVFDREALEELSKEGVTLMMSDSTNVLSPGRTTSESVVADALLRNISAAKGRVITTQFASNIHRLGSVKAAADLTGRKLVFVGMSLRTYLDAAWKDGKSPIDPSTLVKAEDIDAYAPKDLLIVTTGSQAEPRAALNLASFGSSHSFKLTKEDTVLYSAKVIPGNESRVMEMLNRISEIGSTIVMGKNECLHTSGHGYRGELEEVLRIVKPQHFLPIHGELLFLKEHELLGKSTGIRHTTQLMRFMLQVIKNGEMLGVSHLRNRRVLSNGFISLGKENLQLMYSDGEKAFGTSSDLFIDERLKIALDGIIVVNMEIFRPQNLDSPVENTLKGKIRITTRCLWLDKGKLLDALHKAAHAALASCPVSCPLAHMEKIVSEMLRKMVRKYSGKRPEVIAIAIENPAAVLANEINTKLSGKLNVDGMSALRKVVDGHEKENQRTEMQIRDRIDVGGLLPTKDNAISSGAEDGLSDAEDPNDYFKPFVESSPVEKSIKTNNGYVPRKEKSSPLKDDCSEDTEECNSVNTSDSEPKSSKSAKRNKWKHEEVKKLIDMRGELNDRFQVVKGRMALWEEISQNLLANGISRSPGQCKSLWTSLLQKYEEVKNEKKNKKKWPYFEDMERILADNKTLETK

SEQ ID NO: 107393 - protein, 62 aa, Glycine max
  Coding DNA Sequence Number=SeqID_15708
MMMVIMLGVAVTIEIYVDSDGVMVTKVVTNDNNISGSDKGDINSNGDDSETVMTANDDNNDK

SEQ ID NO: 107394 - protein, 290 aa, Glycine max
  Coding DNA Sequence Number=SeqID_15709
  Gene Ontology: Mol. function=ATP binding
  Homolog annotation: Hit_ID=A5AG95; Match level="QueryCoverage=72%, HitCoverage=14%, E-value=1e-75, Identity=65%"; Hit description =Putative uncharacterized protein
MVLFEMQNMWDSTPDTDLLLELPEEYTFETALADLIDNSLQAVWSNGEDKRKLIRVNLGKSKISIFDNGPGLDDTDENSLVKWGKMDASLHRSSKSKAIGGKPPYLMPYFGMFGYGGPIASMHLGRRASVSYKTKHVKKVYTLHLEREALLNTSSSQLTWKTGGGIRDPLANEIRDSHGSFTKVEIYEPKIKDVHINRLPSHLKDLYFPYIQCLHQAIGDKKSDEWLEIGSFPTSSHDGLTHLIIGHKLNGQNYTQCVRSVKIFLRGKGKEDYISGDSECPKKGDTNVQK

SEQ ID NO: 107395 - protein, 46 aa, Glycine max
  Coding DNA Sequence Number=SeqID_15710
MADIGSMTKYFLFCGLQALIVTAMSEIDGDELKDRQLTNGSLDGRL

SEQ ID NO: 107396 - protein, 721 aa, Glycine max
  Coding DNA Sequence Number=SeqID_15711
  Gene Ontology: Mol. function=identical protein binding; Cellular component=extracellular region; Biological process=negative regulation of catalytic activity
  Homolog annotation: Hit_ID=A7Q9H4; Match level="QueryCoverage=99%, HitCoverage=94%, E-value=0.0, Identity=58%"; Hit description =Chromosome chr19 scaffold_66, whole genome shotgun sequence
  Pfam annotation: Domain name=PA; Domain location=322-425; Score=99.8; E_value=8.5e-27; Accession=PF02225.13; Description=PA domain
  Pfam annotation: Domain name=Peptidase_S8; Domain location=73-552; Score=30.0; E_value=2.3e-08; Accession=PF00082.13; Description =Subtilase family
  Pfam annotation: Domain name=Subtilisin_N; Domain location=2-62; Score=43.6; E_value=7.1e-10; Accession=PF05922.7; Description =Subtilisin N-terminal Region
  Pfam module annotation: Pfam domain module=PA::Peptidase _S8::Subtilisin_N; Domain location=322-425::73-552::2-62
MSHYDILESYVGSTEKALEAIFYSYKRYINGFAAILDEDEAANVSMHPNVISVFLNKERKLHTTNSWNFLGLERNGVFPHDSVWKKTKGEDIIIGNIDTGVWPESKSFSDEGFGPIPKRWRGICQTEDKFHCNRKLIGARYFYKGYEAGSGIKLNASEVSVRDYEGHGSHTLSTAGGNFVAGASVFGFGNGTASGGSPKARVAAYKACWPDTFFGGCFDADILAAFEAAISDGVDVISMSLGSEDPPEYFQSSISIASFHAVANGITVVGSGGNSGPSPGTVSNNEPWMLTVAASTTNRDFASHVTLGDKKILKGASLSEHHLPSNKMYPLISAVDAGTKYAAVNDTPFCLNKTLDPEKVKGKILVCLRGVNGRIEKGVIAASLGAVGMILANDKDSGNEVLSDPHVLPTSHVNFASGSYIYNYINHTKSPVAYISKAKTELGVKPAPFVASFSSRGPNLLEPAILKPDVTAPGVDIIAAYTEAVSPTDEASDTQRTPYYAFSGTSMSCPHVAGLVGLLKAFHPDWSPAAIKSAIITSATTKGNNRRPILNSSFVNEATPFDYGGGHIRPNHAVDPGLVYDLNTADYLNFLCSRGYNSSQLKLFYGKPYTCPKSFSLADFNYPTITVPRIHPGHSVNVTRTVTNVGSPSMYRVLIKAPPQVVVSVEPKKLRFKKKGEKKEFRVTLTLKPQTKYTTDYVFGWLTWTDHKHRVRSHIVVNIQH

SEQ ID NO: 107397 - protein, 454 aa, Glycine max
  Coding DNA Sequence Number=SeqID_15712
  Gene Ontology: Mol. function=catalytic activity; Cellular component =cytoplasm; Biological process=metabolic process
  Homolog annotation: Hit_ID=A7PHH5; Match level="QueryCoverage=85%, HitCoverage=92%, E-value=1e-164, Identity=75%"; Hit description =Chromosome chr17 scaffold_16, whole genome shotgun sequence
  Pfam annotation: Domain name=MoeZ_MoeB; Domain location=265-355; Score=-17.7; E_value=0.055; Accession=PF05237.4; Description =MoeZMoeB domain
  Pfam annotation: Domain name=ThiF; Domain location=121-259; Score =149.6; E_value=8.6e-42; Accession=PF00899.12; Description=ThiF family
  Pfam annotation: Domain name=ketoacyl-synt; Domain location=123-315; Score=-99.3; E_value=0.057; Accession=PF00109.17; Description=Beta -ketoacyl synthase, N-terminal domain
  Pfam module annotation: Pfam domain module=MoeZ_MoeB::ThiF::ketoacyl -synt; Domain location=265-355::121-259::123-315
MEVVLKELHADLQSLSQSLPDPSHHDLLRKVFLPLQFSLHIPIPSMKPKIPSCFAHENFIRLSDSVMIQLRVEDLAKLAEAAPVRRSKVEDMSAEVVDSNPYSRLMALQRMGIVDNYERIRDFSVAIVGVGGVGSVSAEMLTRCGIGRLLLYDYDKVELANMNRLFFRPDQVGMTKTDAAVQTLSDINPDVVLEASFETFMSSLKNKSLRPNKQGSGVDLVLSCVDNYEARMAVNQACNELSQTWMESGVSEDAVSGHIQLLIPGETACFACAPPLVVASGVDERTLKREGVCAASLPTTMGVVAGLLVQNTLKLLLGFGQVSPYLGYNSLKDFFPTMQMKPNPQCSNVACLERQEEYMLAKPARDAAAKAKMEAEAPSTEEVPLHEENEWNISVVDDIELDSPDTRSSDVLPEGLTHELPTADEFHKATLDAPLVDNDDLEDLRRQLEAINSA

SEQ ID NO: 107398 - protein, 438 aa, Glycine max
  Coding DNA Sequence Number=SeqID_15713
  Homolog annotation: Hit_ID=A5AR08; Match level="QueryCoverage=99%, HitCoverage=96%, E-value=7e-91, Identity=44%"; Hit description =Putative uncharacterized protein
  Pfam annotation: Domain name=IQ; Domain location=106-126; Score=17.2; E_value=0.06; Accession=PF00612.18; Description=IQ calmodulin-binding motif
MGKASKWFRGLLGLKKTEYATSPAKPPKEKRRWSFVKSSYTEKDNTTAATCPPLRNNNNHAMAVAAATAAVAEAAVAAAEAAAVVVRLTSNSGRCADGGPTRIRQHWAAVKIQAAFRGCLGLVKLQALVRGHIERKRTAEWLKRLQALLHAQTQVSAGLTLHASPSSSKLSSHLQGPETPEKFESPIRSKSMKHEHSPILKRNGSKSCALINGYQEICGSRSESQGNEQLWNSGRSMNRAHGSNDERNGKVLEVDSGKPHFTLKRRNLSYSTGSDLYSKSLNSTKESTSLQSAQSPCCEVQSHSYSSQKVNNEVEESPFCTADNSPQYLSASSKDDGFKRSPFTPTRSDGSRSYIRGYPDYPSYMACTESSKAKARSLSAPKQRPQSERSGSSDRYSLNGFDMSRLATQRAMQASFTNKAYPGSGRLDKLGMPVGYRF

SEQ ID NO: 107399 - protein, 442 aa, Glycine max
  Coding DNA Sequence Number=SeqID_15714
  Gene Ontology: Biological process=regulation of transcription
  Homolog annotation: Hit_ID=A7QKJ3; Match level="QueryCoverage=69%, HitCoverage=47%, E-value=8e-57, Identity=45%"; Hit description =Chromosome chr2 scaffold_112, whole genome shotgun sequence
MNIRTPTPLRNGHISPTSLNGHITPYLCTVGCESDDEKRGTTTYGDGDSARVDHGVVKKKKKKKKCIPQHGANACLKREVGLFNVYPLQMKDLFNVSTANMAFTISPQDYYYYYYFCHKLQVKKKQAALQKPKPQTMLAGCSSSTLLSPRHRLRSEAPAQFQACHFQLPSSMSTQRLDLPSCTTATFTRNNKDHHHHQPLRPVGLSVDQKHIEAKTSTCSLKQHIRLPPLAITASATPLVEESSIINDNNNKSLKKRLAAEHHDDSFAKRKKSSSTTECDWFQPDVVETTTLGGFNNNNTSLVSFSSEEQERVCFLPSEVVSHSAPFPLNPWLESCVTKITNFGEGSHRHPHHHHHPHHHNDHASGSVSNASSESQSLRLNDNVSEHEVGNGSGNPYYHHRKVEAGEEDDHHGFELVSLLTGCVDAIGSRNVTAINHFIAKL

SEQ ID NO: 107400 - protein, 585 aa, Glycine max
  Coding DNA Sequence Number=SeqID_15715
  Gene Ontology: Mol. function=pyridoxal phosphate binding; Biological process=metabolic process
  Homolog annotation: Hit_ID=A7QKE0; Match level="QueryCoverage=98%, HitCoverage=98%, E-value=1e-154, Identity=49%"; Hit description =Chromosome chr2 scaffold_112, whole genome shotgun sequence
  Subcellular localization annotation: CTP_CleavageSite=53; ConfidenceScore=5.52e-01
MHPSRAEAAASQPCFNGCFPSPLLASEKSHRTTSSKPKVVNNNNVTSSHDDFVAATSSTLHPHTNFTNHESLPSLQDSYISFTKAFPQFSTTTSEVDQIRALEYHHLSNHSNACFDYTGYGLFSYYQQQRISYSYPTIASSSSSSFPYFRSDASFFDISYKSVNLQSQVLYGGHESELESRIRKRIMSFMNVSEAEYTLVFIANEVSAFKIVADSFQFQNNRQLLTVYDHSSEALDVMIESCKKQGVHVLSAEFSWPNLRLEWRKLKKMVTKNKREKRSKGGLFVFPIHSRVTGAPYSYVWMSMAQENGWRVMLDVCGLKPKEMGTLDPGYATSIGIISLVPAYRHETDEQVVIETDEADHQQQDGASSATEIEELNIIPFDSSRDTNRLGTKNEGFEIHCRGLDHADSVGLLLISSRTKYLVNWLVNALMSLKHPHHENSISLIRIYGPKISSIRGPAVAFNVFDWKGEKCDPALVQKLADRNNISLGSSYLRNIRFSDKNEEERHWASETTRGCSEVEGLGLSKKKTRSHEPGIFVVTAALGLLTNFEDIYRLWAFLSRFLDADFVEKERWRYMALNQKTIEV

SEQ ID NO: 107401 - protein, 460 aa, Glycine max
  Coding DNA Sequence Number=SeqID_15716
  Homolog annotation: Hit_ID=A5AMK8; Match level="QueryCoverage=99%, HitCoverage=99%, E-value=1e-30, Identity=36%"; Hit description =Putative uncharacterized protein
  Subcellular localization annotation: CTP_CleavageSite=70; ConfidenceScore=5.35e-01
MASTGGKSHSLITTSKRSVLLKDYLRDDLSSCSSNGFKSLTRQQCCTTVGFFMEKDLQLQRKRRNTFTPRSTTSSSSSTILALQRASGAIINAIKSLPLSQKSGVAGVLSRSFSRKVLSRRFFWRKAAAREEGSEGVPRRRKSFRELIMLDHEEHRKATSSLNEDTDTTVFAAHAPSVTTSSGRGSESWGDSEFTFASNAASSSSESSNENYLVLEDTKEGAPHHKLEQVVTKEYWPNDEKEQFSPVSILDCPFEDEEDNYKSHINSTSIILSFSEGRKHKHMHKRCHFESVVPLEPVVLEKKFARLELEDEPHKHSTKQCSTVLAPTFRRDNNNNIEENARDLLNLVKRSIAPNVLITKAENLLFDFFKKSIEENKDIDYSKKLQLCKVAEDWIHGQPQEPYLGWEVQGGKCVYIREMDKCEEWKNSYQEIQQLGQELANEVFTNLVNEFIFELTTRAS

SEQ ID NO: 107402 - protein, 136 aa, Glycine max
  Coding DNA Sequence Number=SeqID_15717
MSNTGSSGNIPEEGVLLERSSGNLKVIPEVLPEEVFFRKTFGYFRKNPSSGNFPKNVLPELPEEPLTGLPEGSAVSLLSPFFPASSPLVFYPKVTILRGVRETNLVRGEEEDEVRACLAEKKKQFTEKGEEASRKE

SEQ ID NO: 107403 - protein, 339 aa, Glycine max
  Coding DNA Sequence Number=SeqID_15718
  Gene Ontology: Mol. function=catalytic activity; Cellular component =soluble fraction; Biological process=cellular metabolic process
  Homolog annotation: Hit_ID=A7QKD6; Match level="QueryCoverage=88%, HitCoverage=100%, E-value=1e-153, Identity=86%"; Hit description =Chromosome chr2 scaffold_112, whole genome shotgun sequence
  Pfam annotation: Domain name=Epimerase; Domain location=16-212; Score= -1.6; E_value=4.9e-07; Accession=PF01370.12; Description=NAD dependent epimerasedehydratase family
  Pfam annotation: Domain name=RmlD_sub_bind; Domain location=14-292; Score=-132.5; E_value=6e-05; Accession=PF04321.8; Description=RmlD substrate binding domain
  Pfam module annotation: Pfam domain module=Epimerase::RmlD_sub_bind; Domain location=16-212::14-292
MGFPANGASAAQPLNFLIYGRTGWIGGLLGSLCRAQGISFHYGSGRLENRASLETDIALLKPSHVFNAAGVTGRPNVDWCESHKVETIRTNVVGTLTLADVCRDHGLILINYATGCIFEYDSDHPLGSGIGFKETDSPNFTGSFYSKTKAMVEDLLKNYDNVCTLRVRMPISSDLLNPRNFITKITRYEKVVDIPNSMTILDELLPISIEMGKRNLTGIWNFTNPGVVSHNEILEMYRDYVDPNFTWNNFTLEEQAKVIVAPRSNNELDAAKLKKEFPELLSIKDSLIKYVFEPNQKGDDACLDSLTGFVTEKVRKGKPFSRKRLHTLMLNSVVIHWEI

SEQ ID NO: 107404 - protein, 42 aa, Glycine max
  Coding DNA Sequence Number=SeqID_15719
MLVFNAFEKKADMLIRRVQSNPSGPQVQQVKTKKLTGPKSRN

SEQ ID NO: 107405 - protein, 410 aa, Glycine max
  Coding DNA Sequence Number=SeqID_15720
  Gene Ontology: Mol. function=bile acid:sodium symporter activity; Cellular component=integral to membrane; Biological process=organic anion transport
  Homolog annotation: Hit_ID=A7PEW7; Match level="QueryCoverage=100%, HitCoverage=99%, E-value=1e-125, Identity=57%"; Hit description =Chromosome chr11 scaffold_13, whole genome shotgun sequence
  Pfam annotation: Domain name=SBF; Domain location=151-310; Score =106.8; E_value=6.5e-29; Accession=PF01758.7; Description=Sodium Bile acid symporter family
MSTIILRDHRVAAGAYDALLKPSFRTPTWKKLHNSHLVKGHFYLTKSGGSCAIRRKLRGPVVAVLELPLSLQASRRSANDLFVAMFRNSKILCNATTDISGDIPESAGELSQYEKVIEILTALFPVWVILGAIVGIYKPTAVTWLATDLFSLGFGFLILSMGLTLTFEDFRRCLRNPWTVGVGFLAQYLIKPMLGFAIAMEKWKILDQYVALIGAHDLFNFGISRCSTIGAIIMTPLLTKLLAGQLVPVDAVGLALSTFQVVLVPTIVGVLANELFPKFTSKIITVTPLIGVILTTLLCASPIGLASDVLKAQGAQLVLPVVFLHAASFALGYWVSRISFGESSSRTVSIECGMQSSAFGFLLAQRHFTNPLVAVPSAVSVVCMALGGSALAVFWTNRPIPLDDKDDFKK

SEQ ID NO: 107406 - protein, 148 aa, Glycine max
  Coding DNA Sequence Number=SeqID_15721
MLEWFSPLAWWRMKLKQILDIERQRGILEDNIENLVSILARHLCEINDYSYKTVDPNLSSSSQRPKESYPTNRIIPQNTDDGQIRTEFYVPEPVFQKAEDLADDYSSLNRDWEDYNAQLMEDLLHKKRCRYHHPVYGSLTRSEVQNYN

SEQ ID NO: 107407 - protein, 33 aa, Glycine max
  Coding DNA Sequence Number=SeqID_15722
MNRGVRGRVRADARPVISRSSSRVRLRTIKKHY

SEQ ID NO: 107408 - protein, 62 aa, Glycine max
  Coding DNA Sequence Number=SeqID_15723
  Subcellular localization annotation: CTP_CleavageSite=31; ConfidenceScore=5.30e-01
VSKLTYSKASKETSQSLKISSKAPQDGFLVKLSYLSVSPRPKLKPNSLKSSSPLQIWDFSFK

SEQ ID NO: 107409 - protein, 272 aa, Glycine max
  Coding DNA Sequence Number=SeqID_15724
MASRKRKAPASVSQARQCPWPEDRFAKECEAVHYKFDEFRREIDGNNWHKELTNFSEGSIDVALVKEFYANLYDLEDKSPKQVRVRGNLIKFDDDALDTFLNTLVVIEEGESSPSYFKFCRLRPDPQELAPRLCIPGRGFELNANELLLKILRKNLTTLAQTWSVISFSNLAPTSHTSYITLDRAKLIYGLVISPYPSSFYLSYSSRTSNSNSSGSFFLELRAILFYAVEPTSGPAPDRAKLTECGPLAAGVQPSPLGGGEASAAQEPQQDQ

SEQ ID NO: 107410 - protein, 156 aa, Glycine max
  Coding DNA Sequence Number=SeqID_15725
  Homolog annotation: Hit_ID=A0ST23; Match level="QueryCoverage=29%, HitCoverage=93%, E-value=3e-20, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVMHRLNILELVQLGVAKWASPTCFCPLTHINCVALTARFPVGKPVVPAALMNRPTRGERRFAYWALFRFLAH

SEQ ID NO: 107411 - protein, 68 aa, Glycine max
  Coding DNA Sequence Number=SeqID_15726
  Subcellular localization annotation: CTP_CleavageSite=28; ConfidenceScore=5.16e-01
MVPSGVANCRNLPFGGRATRGSQVRLPRKENARSCYQRLFKENVGKMGKVWSTNFNRERFGSCIYARG

SEQ ID NO: 107412 - protein, 82 aa, Glycine max
  Coding DNA Sequence Number=SeqID_15727
MARTRGLGRAIGRLIGRDRHDDHDATDVPERRRPTALARRQRVHQMIADACDMAKDVADMTEDVPDLAEEAPKMRADVQGAD

SEQ ID NO: 107413 - protein, 97 aa, Glycine max
  Coding DNA Sequence Number=SeqID_15728
  Homolog annotation: Hit_ID=Q6UUU1; Match level="QueryCoverage=88%, HitCoverage=58%, E-value=3e-32, Identity=80%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVSFRCMAAFVSFHADTQFR

SEQ ID NO: 107414 - protein, 68 aa, Glycine max
  Coding DNA Sequence Number=SeqID_15729
  Homolog annotation: Hit_ID=Q2HST2; Match level="QueryCoverage=77%, HitCoverage=10%, E-value=7e-09, Identity=60%"; Hit description =Peptidase aspartic, active site
MEDAPASPASPSRRRVTFQVMVINPTYSYLLGHSSIHSVGVIPSTLHQKLKFVMEGHWVIVSGEEDVL

SEQ ID NO: 107415 - protein, 59 aa, Glycine max
  Coding DNA Sequence Number=SeqID_15730
  Subcellular localization annotation: CTP_CleavageSite=35; ConfidenceScore=5.16e-01
MRKEKIPHQAPFAIQAAQLLGRAIGFSQSRRCKTTASAKLACLQVDSRGSPASFADVSC

SEQ ID NO: 107416 - protein, 128 aa, Glycine max
  Coding DNA Sequence Number=SeqID_15731
MWAFHKGLQIDWAHLVRYRMHKPLRLNAPLPYPHLVTLFLQHFNIPLDSEPYVPIKRSFLIGTLVIASFGHDGEDSSLLSKILDRFDTLELQVDMRFNEMESRITKVEEDVSYIRSSFDLPPPPPPSS

SEQ ID NO: 107417 - protein, 176 aa, Glycine max
  Coding DNA Sequence Number=SeqID_15732
  Homolog annotation: Hit_ID=Q8GEG1; Match level="QueryCoverage=57%, HitCoverage=75%, E-value=9e-53, Identity=94%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGSGPLTSITKIDAQVRGGETRQDYKDTRRFPLEAPSCALLFRPCRLPDTCPPFSLREAWRFLIAHAVGISVRCRSFAPSWAVCTNPPFSPTAAPYP

SEQ ID NO: 107418 - protein, 72 aa, Glycine max
  Coding DNA Sequence Number=SeqID_15733
MYYGCNLSMFQNMFGMGKKIGNYISDKLSPCLRVDGLPLIGPTNLNWADLCEKLLGVRPQEGEIKGSVVKLS

SEQ ID NO: 107419 - protein, 99 aa, Glycine max
  Coding DNA Sequence Number=SeqID_15734
MRMDRFALTLNRSQELPRLLDKAKAMADTYSAPEEIHRLLSYLRIKSLPHFISSMHCMLVSSFVTGSRKVHITFLTVHIGHCAPKCASKKRYFFGLSCP

SEQ ID NO: 107420 - protein, 286 aa, Glycine max
  Coding DNA Sequence Number=SeqID_15735
  Homolog annotation: Hit_ID=Q5QJQ3; Match level="QueryCoverage=36%, HitCoverage=81%, E-value=4e-56, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPSHDVVKRRPVPSLHACRSTLEDPHSLSFIPSNEEVGLGTELEFVIMVIAVSCSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTRISRARYVGGATEFLKWWPNYGYTRRTVFGICALLKPVTSEKEL

SEQ ID NO: 107421 - protein, 77 aa, Glycine max
  Coding DNA Sequence Number=SeqID_15736
MSYQAGFSGKGCAKRQHHSILKSLEVRLAHVVALSLNHSLLSTCCRNIFVVVESAKCHCCAKPQMLTGSYNFKLGLT

SEQ ID NO: 107422 - protein, 94 aa, Glycine max
  Coding DNA Sequence Number=SeqID_15737
MEMEKAHATLNMESFVVGDKRGGLAQSATNAGLCGRALHGAGRLAYPPLLVGLESSSSMDSFASWKMNGSGMEKEEREETPLQGEDESRRSSPP

SEQ ID NO: 107423 - protein, 155 aa, Glycine max
  Coding DNA Sequence Number=SeqID_15738
  Homolog annotation: Hit_ID=A0ST23; Match level="QueryCoverage=29%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTFDEEEEFQQLPIGIGATKLGTELEFVIMVIAVSFGKPVVPAALMNRPTRGERRFAYWALFRFLAH

SEQ ID NO: 107424 - protein, 136 aa, Glycine max
  Coding DNA Sequence Number=SeqID_15739
MDEAEEGYGESNNECLLGEEEDHDYNDLYNDVNFNEGFIQLLRKNDNSGFMLQLFGSRFLNFKILGVAFIEEAFVYSQDKIYDFEMKLMDIDSEHLGIPEAYHAISLLRCHPLSLLGSARISVVFVTLVIGFASLF

SEQ ID NO: 107425 - protein, 60 aa, Glycine max
  Coding DNA Sequence Number=SeqID_15740
MMMKDTYQLKGTLLFFGVFWTGLMDFKPMLVGHHQKGGDCRSKLHDDEPSNFDDAKSPSD

SEQ ID NO: 107426 - protein, 251 aa, Glycine max
  Coding DNA Sequence Number=SeqID_15741
  Homolog annotation: Hit_ID=P03851; Match level="QueryCoverage=29%, HitCoverage=88%, E-value=4e-37, Identity=97%"; Hit description =Uncharacterized 9.4 kDa protein
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRTIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTGFGICALLKP

SEQ ID NO: 107427 - protein, 235 aa, Glycine max
  Coding DNA Sequence Number=SeqID_15742
  Homolog annotation: Hit_ID=UPI0000ECA21E; Match level="QueryCoverage =24%, HitCoverage=15%, E-value=1e-26, Identity=94%"; Hit description =UPI0000ECA21E related cluster
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRTIKIPGVSPWKLPRALSCSDPAAYRIPVVRSKLGCVHEPPVQPDRCALSGNYRLESNPVRHDLSALAAATGNRISRARYVGSATEFLKWWPNY

SEQ ID NO: 107428 - protein, 80 aa, Glycine max
  Coding DNA Sequence Number=SeqID_15743
VFCLCPIFLGCDSLCCLNVELPGCWGSLGGLMGTRGWWAYARFVDVENLLCTIARPPPSTTCDGVVPGDMSRGSGDIGDV

SEQ ID NO: 107429 - protein, 126 aa, Glycine max
  Coding DNA Sequence Number=SeqID_15744
  Homolog annotation: Hit_ID=A6FJQ2; Match level="QueryCoverage=30%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPDRKGGKGYGVDHQGSAPIFSTKEAPTKIGCNH

SEQ ID NO: 107430 - protein, 94 aa, Glycine max
  Coding DNA Sequence Number=SeqID_15745
  Gene Ontology: Mol. function=thiamin pyrophosphate binding
  Homolog annotation: Hit_ID=A6TD15; Match level="QueryCoverage=68%, HitCoverage=11%, E-value=8e-29, Identity=93%"; Hit description =Acetolactate synthase III large subunit
MAIPVGSIAIIIAMQYKSGEQEMASTMALTWAKMRATGQQVPELVTCPHENAAIGMAHGYYLGSGKVQAVMVHTNVGLANAACGVINLANSNIP

SEQ ID NO: 107431 - protein, 156 aa, Glycine max
  Coding DNA Sequence Number=SeqID_15746
TLLSLVDVCIELIGGEDESNPREKPEETTTIRDDALRWLTMLRLGGILGTRVVPEDMSRGSGDLGDNAMAVQLIRDRVVMECLEGVWETLEGNERCQFRDTVRLTATSLVHPEQPARTLQQPVEWILPMPTPYRLVDPVQLIEVSSSEEDPEGDSE

SEQ ID NO: 107432 - protein, 107 aa, Glycine max
  Coding DNA Sequence Number=SeqID_15747
  Homolog annotation: Hit_ID=Q51617; Match level="QueryCoverage=37%, HitCoverage=57%, E-value=4e-12, Identity=87%"; Hit description =Putative uncharacterized protein
  Subcellular localization annotation: CTP_CleavageSite=48; ConfidenceScore=5.51e-01
MKIGVSRGPFVSRVSVMTVKTSDTCSSRRRSQLVCKRMPGADKPVRARQRMRKEKIPHQAPFAIQAAQLLGRAIGAGLFAITPAGERGMCCKAIKLGNARVFPVTTL

SEQ ID NO: 107433 - protein, 132 aa, Glycine max
  Coding DNA Sequence Number=SeqID_15748
  Homolog annotation: Hit_ID=Q51617; Match level="QueryCoverage=30%, HitCoverage=57%, E-value=4e-12, Identity=87%"; Hit description =Putative uncharacterized protein
  Subcellular localization annotation: CTP_CleavageSite=73; ConfidenceScore=5.25e-01
MLNTHTRRGSILLKHYQGYCLMSGYIFEGVSRGPFVSRVSVMTVKTSDTCSSRRRSQLVCKRMPGADKPVRARQRMRKEKIPHQAPFAIQAAQLLGRAIGAGLFAITPAGERGMCCKAIKLGNARVFPVTTL

SEQ ID NO: 107434 - protein, 102 aa, Glycine max
  Coding DNA Sequence Number=SeqID_15749
  Pfam annotation: Domain name=G-patch; Domain location=1-43; Score =10.1; E_value=0.011; Accession=PF01585.14; Description=G-patch domain
MVAREMLGNGYEPGMGLGKNNGGRTSLISTRGNRGKFGSFISVRLRHEGQVVAICEDDFPNGSDLVIIPGNRSSISSKKRIRRRVKRTKMWDFPGVGEDSRP

SEQ ID NO: 107435 - protein, 126 aa, Glycine max
  Coding DNA Sequence Number=SeqID_15750
  Homolog annotation: Hit_ID=A2Y1D2; Match level="QueryCoverage=85%, HitCoverage=18%, E-value=6e-08, Identity=35%"; Hit description =Putative uncharacterized protein
MMRANTKEEMVAQIPDPKVDPSQYHDLVHYWCSEKGQKISNINKRNRSKYEDLHCMGTKNLPRRIHEMKTKAKGVQPSQEEIYIDTQTRKDGSVVTEKAATVIDELKKKMVEEESSQNLQSTQDST

SEQ ID NO: 107436 - protein, 165 aa, Glycine max
  Coding DNA Sequence Number=SeqID_15751
  Homolog annotation: Hit_ID=A0ST23; Match level="QueryCoverage=25%, HitCoverage=89%, E-value=8e-12, Identity=79%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPVMDVKSTNYEDESFETLKKVELPNFDGKDHIGWLARAEKFGKPVVPAALMNRPTRGERRFAYWALFRFLAH

SEQ ID NO: 107437 - protein, 112 aa, Glycine max
  Coding DNA Sequence Number=SeqID_15752
MALPGTLDPISPTGPGISRFDHRTLPVVANHRAHVQTHDYLYQLSLSLQSQGFTSFLCPTPDQFREEVAWLRDWPEARAGEAPAEAPDEADEARENEEMTDLLDFLGGSGAT

SEQ ID NO: 107438 - protein, 38 aa, Glycine max
  Coding DNA Sequence Number=SeqID_15753
VAVGVSSDVYSSLSSGVASGSGCGSWAIGASPPPTGEG

SEQ ID NO: 107439 - protein, 322 aa, Glycine max
  Coding DNA Sequence Number=SeqID_15754
  Homolog annotation: Hit_ID=UPI00006A2D9E; Match level="QueryCoverage =97%, HitCoverage=86%, E-value=5e-10, Identity=18%"; Hit description =UPI00006A2D9E related cluster
LIVLALRGLYDLTFRGLHALTFRGLHVLAYRGLHVLTFIRLHVLAIRGLHVLTIRGLHVLPFRGLHALAFRGLHALAFRGMHALTFRGPHALSFRGLHVLAFRGLHDLPSEGYTPSPLEGYTPSPTEDYTSSPLEGYTPSPSEDYTLLTFKGVHALAFRGLCAITFQRTTRPRLQRTTRPHLQRATLPRHQKTTCPCLQRATRLIVLALRGLYDLTFRGLHALTFRGLHVLAYRGLHVLTFIRLHVLAIRGLHVLTIRGLHVLPFRGLHALAFRGLHALAFRGMHGLTFRGPHALSFRGLHVLAFRGLHDLAFRGLHALAFK

SEQ ID NO: 107440 - protein, 129 aa, Glycine max
  Coding DNA Sequence Number=SeqID_15755
MTMSKRFMKAEDEGSVLYKEQMGEKTSAKVKENDVKGKENQEKGKKIMVQNKEMKNQEKEKEGEKEIENEKNEKEKKKIFEKSRSGKVVEKGVEVPYPVEIEITMPFGEAQQQMPLYSKFLKDMLTRRH

SEQ ID NO: 107441 - protein, 97 aa, Glycine max
  Coding DNA Sequence Number=SeqID_15756
MVVIMRKVHLVVWFCSLHNRPDNYLKGIIISLNQRLLLGGLSSSVIDKKGSAECGYYVMHWMSTIILGSFRNNWKAYFNDARPLEPEGLKVLRIQWA

SEQ ID NO: 107442 - protein, 39 aa, Glycine max
  Coding DNA Sequence Number=SeqID_15757
  Homolog annotation: Hit_ID=A5AG41; Match level="QueryCoverage=100%, HitCoverage=3%, E-value=4e-09, Identity=71%"; Hit description =Putative uncharacterized protein
MEDYYKEMKIAMIRANVEEDRETTMARFIGGLKKEITDV

SEQ ID NO: 107443 - protein, 86 aa, Glycine max
  Coding DNA Sequence Number=SeqID_15758
  Subcellular localization annotation: CTP_CleavageSite=31; ConfidenceScore=5.12e-01
MTGPLDESISCFLIRRATRPRYQRTARPHLRRATRPHLQRATRHRLRRATRPHLPRTTCPHLQRATRPRLRRAIRPHLQRTTCPHL

SEQ ID NO: 107444 - protein, 141 aa, Glycine max
  Coding DNA Sequence Number=SeqID_15759
MERSMIDAASGGALGDMTPAEARDLIENMASNSQQFSARNDAIVIRGVHEVATNSSSSAKTKKLEGKLDALVNLNAAGSSRPYVPPPIQQQQQQQQQPQKQQTVEAPLQPSLEELVRQMTMQNMQFQQETRASIQSLTNQM

SEQ ID NO: 107445 - protein, 355 aa, Glycine max
  Coding DNA Sequence Number=SeqID_15760
  Subcellular localization annotation: CTP_CleavageSite=29; ConfidenceScore=5.08e-01
MTQGSFVPHGRDDILNMAIGKPEHLGRVRAAGSGMTLTQFYGRATRTSSSSSATLMQQQWVDIIGNIKEQVRNEYEEQHKRSLEEFKKELSSQIFIQLSQMGSQYSPLIEVDLQALAARLSTKGSNVETADVDPSGDKNVSLKPTMGLYVQRQHTTVLVALGKICEGGSAIHNVTDADDVVRVSVDKVIEGDAKVPFPTSEIQYESDTSPKKLPETNERGTNDFDHDLLRQLIKSLYFMYDTPVEFKWDGSKFGLSNVVASFFLTFSDVNEIVAGYKCLNISILQLWMLFLDEWGSTLGHASVYGFLEPQSIHNAKDRRAEYVDHAIIISSAMKSTNTTADGTNNPATPKWIEVK

SEQ ID NO: 107446 - protein, 152 aa, Glycine max
  Coding DNA Sequence Number=SeqID_15761
  Homolog annotation: Hit_ID=Q2HVA4; Match level="QueryCoverage=65%, HitCoverage=11%, E-value=4e-26, Identity=59%"; Hit description =Centromere protein, putative
MVVRELERKIVQLEQHNKELGDLLKELREAQINNGEANSVTSKLRNKLRRLEEVHKHCASIVKSKESQWGDQVAKMEADINEDMVLISAEQLRVKDKSIKTMAQAAQQHSLLEEELKQQKKKLEESSEGQLILEEQLLQMEYTVQYERSAAN

SEQ ID NO: 107447 - protein, 119 aa, Glycine max
  Coding DNA Sequence Number=SeqID_15762
MRGADFRDTIRFTATSLVHPEEPARTLQRTMEWILPTPTPYRLVELVQVIEVTSSEEDLEEDPEELPPEPAVDALDFPEGDEDPLPDVDSPEDVMSASEADSMEESGPGGIATSGDSSS

SEQ ID NO: 107448 - protein, 152 aa, Glycine max
  Coding DNA Sequence Number=SeqID_15763
MPQNVLYDAMGYINGVGTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIPTLPVPCGSSD

SEQ ID NO: 107449 - protein, 137 aa, Glycine max
  Coding DNA Sequence Number=SeqID_15764
MRQFGYTQTIPTPPADSWVSFDDIHDRWMHYSDHMAAADPRADGHATQPRVAPQDPDIDIHPVTKPAAPSTSARSDVAEPRHAVEACFAIAERLESHLNLEVVTPGTSTHVLIEECLKIAKSVTQDPLVYVRSRRRR

SEQ ID NO: 107450 - protein, 139 aa, Glycine max
  Coding DNA Sequence Number=SeqID_15765
MVGTKRLLVIIPKVLISLLMVSRDIIPFEKHIVAVGTTSNNMLSKRQTLDEGSLLSSKSETQHDHRFTSTPYVPIDPYRAPFQLTSPVESPTVATYPSAGGRHEGSRVRLPWEEDARSHHQRLFEENVENTGKGVVYEL

SEQ ID NO: 107451 - protein, 140 aa, Glycine max
  Coding DNA Sequence Number=SeqID_15766
  Homolog annotation: Hit_ID=A6FJQ2; Match level="QueryCoverage=27%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFAGYEDKNIELSEAWNEAELTKPKMKVKQKLHQAIDLLYSHGLGVPSSNS

SEQ ID NO: 107452 - protein, 180 aa, Glycine max
  Coding DNA Sequence Number=SeqID_15767
  Gene Ontology: Mol. function=O-methyltransferase activity
  Homolog annotation: Hit_ID=Q850G5; Match level="QueryCoverage=28%, HitCoverage=42%, E-value=2e-20, Identity=92%"; Hit description =Putative caffeic acid methyl transferase
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPVGIAFDMMLLAHNAGGKERTEENWKWLFKETGFARYNIIKINALPSIIEAFPI

SEQ ID NO: 107453 - protein, 219 aa, Glycine max
  Coding DNA Sequence Number=SeqID_15768
  Homolog annotation: Hit_ID=Q5QJQ3; Match level="QueryCoverage=14%, HitCoverage=24%, E-value=5e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTLISSTVQQMRTLGEEIKESQVVSKVLRSLTKKYDHVVAAIEESKDMEGRETCRASCINESANARGEAVCVLGALPLPRSLTRCARSFGCGERYQLTQRRSFAPSWAVCTNPPFSPTAAPYPVTIVLSPT

SEQ ID NO: 107454 - protein, 85 aa, Glycine max
  Coding DNA Sequence Number=SeqID_15769
  Homolog annotation: Hit_ID=UPI0000ECBAF8; Match level="QueryCoverage =48%, HitCoverage=48%, E-value=1e-16, Identity=100%"; Hit description= UPI0000ECBAF8 related cluster
MVVVHSPDVEVFKTEGSKDDFKPTDPGHSPGVGMQAWHWPSFYNVVTGKTLALPNLIALQHIPLSPAGVIAKRPAPIALPNSCAA

SEQ ID NO: 107455 - protein, 185 aa, Glycine max
  Coding DNA Sequence Number=SeqID_15770
  Homolog annotation: Hit_ID=A5B5G7; Match level="QueryCoverage=76%, HitCoverage=12%, E-value=3e-08, Identity=29%"; Hit description =Putative uncharacterized protein
MGNQQSQGYNQEGFLGFQQGLYNQQGQWISHPGNQFNKDQGGPSNKPPQQGPNIFQRTTKLEETLAQFMQVTMSNHKSTESTLKNLEIQVGQLVKLLAEKSSNSLGANTEKNPKEECKAIMTRSRKLVAAEDEDIVALKEQVVLKDTIDKNNDEKILPLKHKDPGSVTIPCSIGEVTVGKALIDL

SEQ ID NO: 107456 - protein, 195 aa, Glycine max
  Coding DNA Sequence Number=SeqID_15771
MKLCFYSLLDSIWGALTGPGLSFDFMIFRSPALGACCCVLPTREGRAAVWIHPDHSCSACRFMGVVSVPATTWTGSSASRMHPFMTPGHASDPLPDGHAPQPRVVPQAPQTDIPHVPEPGAPSTSARLTVEEPRHAMEVCHGIAERLERHLSLGVVTPGSSTHEVIEECLRMARSVTQDHLVYVRSRRRQRTDQA

SEQ ID NO: 107457 - protein, 151 aa, Glycine max
  Coding DNA Sequence Number=SeqID_15772
MATVVATTLIASAITTVINHHHLCHRDLRCHHCHHHYHHLPPLPLSITPRPTTKTVIVGGGGDNNDDNHDGGGADSRGDDDGLIINNGDLIGCDLFGESFRDIIVICCINESANARGEAVCVLGALPLPRSLTRCARSFGCGERYQLTQRR

SEQ ID NO: 107458 - protein, 144 aa, Glycine max
  Coding DNA Sequence Number=SeqID_15773
  Homolog annotation: Hit_ID=A5AK77; Match level="QueryCoverage=42%, HitCoverage=7%, E-value=8e-08, Identity=45%"; Hit description =Putative uncharacterized protein
MTRGNPSDLQPFDPKIDRTFHRLIRHSVHPDHSVHFEHSEYSVAGDFEHSDFEHSTTNFHTENMAQPPPHERTLREMAAPDFIYESLCIQYPDEDVPYVLKTGLIHLLPKFHGLAGEDPHKHLKEFHIVCPTMNPLMSRKIISF

SEQ ID NO: 107459 - protein, 55 aa, Glycine max
  Coding DNA Sequence Number=SeqID_15774
  Subcellular localization annotation: CTP_CleavageSite=9; ConfidenceScore=5.08e-01
VDSRGSPVHASSTHEFGVMRSDCLVQFSILNPSFRSPMNCVFVHASSTHEFGAMR

SEQ ID NO: 107460 - protein, 102 aa, Glycine max
  Coding DNA Sequence Number=SeqID_15775
MALVRANIEDESEDTMAHFLNSLNPEIRDVVELQEYTYQGNPCGIYPNLSSFTGSGVYPDLSSFTGSGVSLTYLASSEVASSKTLWPVSNVLPRKIHIRTLI

SEQ ID NO: 107461 - protein, 125 aa, Glycine max
  Coding DNA Sequence Number=SeqID_15776
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPLRKGG

SEQ ID NO: 107462 - protein, 192 aa, Glycine max
  Coding DNA Sequence Number=SeqID_15777
  Homolog annotation: Hit_ID=Q6WAY6; Match level="QueryCoverage=44%, HitCoverage=15%, E-value=2e-08, Identity=39%"; Hit description =Putative uncharacterized protein
MGTRGYISYNPVLAIRQLGYPMRGAPLEEELAPIISRGFNKTNVETLQKVRKAWEVVQKKDKELRGSNNGPIGDYRRWLKAHVQGLDWLPSLRTAKREEVEALEEDKEVQALRKELEQAQIVKERFKSAVLKIRKENAELRDINIATTEALEQETKRARREEHDRNKFRGAAIASLSSRERKETNHEYIAWS

SEQ ID NO: 107463 - protein, 70 aa, Glycine max
  Coding DNA Sequence Number=SeqID_15778
RKRKSAQYANRLSPRVGRFINAAGTTGFPTGKRAEWMKQNTLKIGDFDTGSPSHSRILETSSRTYGCKFH

SEQ ID NO: 107464 - protein, 177 aa, Glycine max
  Coding DNA Sequence Number=SeqID_15779
  Gene Ontology: Mol. function=N-acetyltransferase activity; Biological process=metabolic process
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
  Subcellular localization annotation: CTP_CleavageSite=67; ConfidenceScore=5.32e-01
NAAFLRFLAFAGPFAHMFCPALSPDSVDNRITAFEKRKSAQYANRLSPRVGRFINAAGTTGFPTGKRAVSATQLIMLTNRDIYDIAALCSGNERLFFEACGFGNDILGSTTMMYRRTAPLTIQEGMQAWHWPSFYNVVTGKTLALPNLIALQHIPLSPAGVIAKRPAPIALPNSCAA

SEQ ID NO: 107465 - protein, 102 aa, Glycine max
  Coding DNA Sequence Number=SeqID_15780
  Subcellular localization annotation: CTP_CleavageSite=17; ConfidenceScore=5.63e-01
MHTRSFTNPQFLKSRPNSQKVPSGVANCRNVPFAGERGRGSRMRFPKEERCAESPPMFICGKRRENRRKPVKMRILSSEVVFTLEEGISTSYVCLERQQPYF

SEQ ID NO: 107466 - protein, 120 aa, Glycine max
  Coding DNA Sequence Number=SeqID_15781
DAGSRQARQGASAVVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSP

SEQ ID NO: 107467 - protein, 86 aa, Glycine max
  Coding DNA Sequence Number=SeqID_15782
  Gene Ontology: Mol. function=chloramphenicol O-acetyltransferase activity; Biological process=response to antibiotic
  Homolog annotation: Hit_ID=A6P250; Match level="QueryCoverage=90%, HitCoverage=81%, E-value=6e-39, Identity=94%"; Hit description =Chloramphenicol acetyltransferase
  Pfam annotation: Domain name=CAT; Domain location=1-76; Score=34.4; E_ value=1.1e-15; Accession=PF00302.9; Description=Chloramphenicol acetyltransferase
MNAHPEFRMAMKDANPWVSFTSFDLNVANMDNFFAPVFTMGKYYTQGDKVLMPLAIQVHHAVCDGFHVGRMLNELQQYCDEWQGGA

SEQ ID NO: 107468 - protein, 87 aa, Glycine max
  Coding DNA Sequence Number=SeqID_15783
MREIIETAIMVHEYPFSVVEDSIWMWVFQYANPDFLKVTYKGRRIEMRVIWCNGTEKEGRKRKREVRYRYLPFVSLSASKHAAGFAR

SEQ ID NO: 107469 - protein, 119 aa, Glycine max
  Coding DNA Sequence Number=SeqID_15784
MEGEEEIREREALRDDERWERWQWRCHWIQRRRKREDEGEEADKKGENVHHHQSTLRQCTMDSDRGTVGGYGKGMKKKTTLLKTSLDYCSTLEKDIFTKVSKYKLVCLSVARYAQDNPS

SEQ ID NO: 107470 - protein, 200 aa, Glycine max
  Coding DNA Sequence Number=SeqID_15785
  Subcellular localization annotation: CTP_CleavageSite=66; ConfidenceScore=5.09e-01
MFLQKAVASGGSNLARLGELGGKLLPYFPINRGRSEENPSRGASVTFPWVISRRFSTVLRRSSVFNCETKAKINSQSQARPQKITKKDFKVRYLSFSHQVKMDHFKVQRLKRTTFQVLIPSSNVNTTLESGIFFMTGFLRFFRCFPQINIGGDSAYFPPLEDAPVSLASLARKRVGCDTYHPSRAIRGNFTRNVVLTMIE

SEQ ID NO: 107471 - protein, 89 aa, Glycine max
  Coding DNA Sequence Number=SeqID_15786
MGGTKRLLVITPKVVISLLMVSRGIIPFEKHIAAVRTTSNNMLSKRKTLDEGSLLSSKSETKHYHRFTSTPYVPMDPGIGPFFNSCVHK

SEQ ID NO: 107472 - protein, 207 aa, Glycine max
  Coding DNA Sequence Number=SeqID_15787
  Homolog annotation: Hit_ID=UPI0000ECBAF8; Match level="QueryCoverage =20%, HitCoverage=50%, E-value=3e-10, Identity=76%"; Hit description =UPI0000ECBAF8 related cluster
RRKPRWNELEIFQRRSAILSVLSDPIRCGNHVRHRGRNPIAPKHVRAVVDGHRQGSTVASQIGVRFGISVVVSESGPIIVIVVGVVGGGGERFAAEFDEAVEDVVDGAAVDEEGGEGHEGGAEQRGHGESHMHSVKTGEKNRRAERGSSIESRPAGRTYQWPSLLQRHMGKPMALPNLIALQHIPLSPAGVIAKRPAPIALPNSCAA

SEQ ID NO: 107473 - protein, 24 aa, Glycine max
  Coding DNA Sequence Number=SeqID_15788
DKAPVVEKDKAPVVEKDEGPSGEG

SEQ ID NO: 107474 - protein, 238 aa, Glycine max
  Coding DNA Sequence Number=SeqID_15789
  Homolog annotation: Hit_ID=A5FCH7; Match level="QueryCoverage=97%, HitCoverage=49%, E-value=6e-77, Identity=56%"; Hit description =Putative uncharacterized protein precursor
AKHPTLLKISENGRYIMTEDGKPFFWLGDTGWLLFNKMNRAEAEQYLEDRKQKGFNVIQAMVLHTVPSVNSYGDSSLVNKDISRPLVTEGNNPDNATAYDYWDHVDYIIDKAAEKGLYVALVPVWGSPVKDGKVSAEQAEKYATFLAERWKDRPNIIWLNGGDIKGSDKMEVWEKIGQTIKSIDHNHLMTFHPRGRTASSDWFHDRPWLDFNMVQSGHRTYAQDTSANEQKHYGEDNW

SEQ ID NO: 107475 - protein, 123 aa, Glycine max
  Coding DNA Sequence Number=SeqID_15790
RRCKDYYSKLVAHSQFKITLSPQNPQEFKIPETGPGHLESEPPPHLSDGKTGKSERATASPDKESERSAASLFGDLGGAAASLDGESKMIIKGGDGGTTSSSGEEDGFTTGDYGSTGAGSTRA

SEQ ID NO: 107476 - protein, 74 aa, Glycine max
  Coding DNA Sequence Number=SeqID_15791
MLASSKKVQMTTLASACQSNLGSPNDEVRITERCLRMLPDSWVMRAKGGVVDKSEAFAPTVCGKLGFWLKAGVL

SEQ ID NO: 107477 - protein, 231 aa, Glycine max
  Coding DNA Sequence Number=SeqID_15792
  Homolog annotation: Hit_ID=Q5CDC4; Match level="QueryCoverage=12%, HitCoverage=21%, E-value=3e-07, Identity=100%"; Hit description =LacOPZ-alpha peptide from pUC9
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKRRPVPSLHACRSTLEDPLTGEKSGAKTDKLKASDKDVTNVKGKVKDGDKSKDEKVTQERDGKDESKSKSSKEGTELEFVIMVIAVSCVKLLSAHNSTQHTSRKHKV

SEQ ID NO: 107478 - protein, 147 aa, Glycine max
  Coding DNA Sequence Number=SeqID_15793
  Homolog annotation: Hit_ID=Q51617; Match level="QueryCoverage=27%, HitCoverage=59%, E-value=5e-14, Identity=92%"; Hit description =Putative uncharacterized protein
MTVKTSDTCSSRRRSQLVCNRMPGADKPVRARQRVLPGVGAGLTYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPFPGTSI

SEQ ID NO: 107479 - protein, 105 aa, Glycine max
  Coding DNA Sequence Number=SeqID_15794
ADPAGSFDTERYLRHLVRQQAANHRAHVQTHDCLYQLSLSLQSQGFAFFPCPTPDQFRAEVAWPGDWPEAQAGEAPAEALGDADKARMDEEMIDLLDFLGGSGAT

SEQ ID NO: 107480 - protein, 196 aa, Glycine max
  Coding DNA Sequence Number=SeqID_15795
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPLRTKPNFLVTAFSCLFDSGTASISVPQFTSGNGAKQHGYSGCLIRATPSDNDRKICNLDGLLRQLRDCFFQVPPPS

SEQ ID NO: 107481 - protein, 99 aa, Glycine max
  Coding DNA Sequence Number=SeqID_15796
MCILTYVMTAQTNRYICRGRLALWSPGRLLLNSNVIHVRVVMLVRMIRTRLFAAAQGKSCPGMHSRRVIASLSGCARIVGHPPISGGGPGTDKRKLLAP

SEQ ID NO: 107482 - protein, 70 aa, Glycine max
  Coding DNA Sequence Number=SeqID_15797
MARKPRQDFSVSKLHTKLQPLAIILPQIVKGEHFRGREVRGYEWDFEISGLGGLLSLLIFVGMGFGRYDG

SEQ ID NO: 107483 - protein, 90 aa, Glycine max
  Coding DNA Sequence Number=SeqID_15798
  Homolog annotation: Hit_ID=B0HC01; Match level="QueryCoverage=38%, HitCoverage=74%, E-value=6e-11, Identity=94%"; Hit description =Putative uncharacterized protein
MPVAISRVLPGWTQYDSFRIRRSGRGERGGGGAFGKTPATRPLYGSWPFAGLLLTCSFLRYPLISWITVLPPLSELIPLAAAERPSAQSQ

SEQ ID NO: 107484 - protein, 83 aa, Glycine max
  Coding DNA Sequence Number=SeqID_15799
MRRYLMAIRTLFQLEASESVDMQRPTSSSASFPEMSTSSDRDYKKVLYAIRQTQGSEMSVSSGRDCRKVSFAIRQTQGSGSMQ

SEQ ID NO: 107485 - protein, 311 aa, Glycine max
  Coding DNA Sequence Number=SeqID_15800
MFFSRHKTARVPHEGSANGRESLTFPCERFRRARSQGYTKSSHARKDKELRGIRNGVIGGYHGWLRVHTRGLDWLSKLKVINEENFEAPEEDEEVQALKLELGKARLAKEKFKSAATHIRKECTELQEENAATARALEQETKRARKEEYGREKFRGALWGSNNELKLRREERDRSRVHGMILKEELAACARSKRSLAQHLEAMEQSMLAIIGQYKEELNQSMAHEQKLVEDFAQVYAEKEARGRVIDALHQEATMWMDRFALTLNGSQDLPRLLAKAKAMAEVCTAPEEIHGLINYCQHMIDLMAHIIRNR

SEQ ID NO: 107486 - protein, 54 aa, Glycine max
  Coding DNA Sequence Number=SeqID_15801
MEYLLVGDEQKRKTESKNAKKDDPRAANSSIPWGWLAQAFPACFAQRRATIGRS

SEQ ID NO: 107487 - protein, 181 aa, Glycine max
  Coding DNA Sequence Number=SeqID_15802
MTLKLSWNFMQMSGLLKKVLWISTPKCGANVNRLQEEVYTSFYGVLVTPTKHIQPLINKSFIEKYCKPRQPVADAPLPPAHQPPSLESISAHLQRMELQMHTYMRHLADQQAANHRGQMQLNENFYHYTLHQHCQDPGPYHWPTPEQFRAIVAWSGNRPIFAWGGRTCKCSRSCPRRWRKS

SEQ ID NO: 107488 - protein, 101 aa, Glycine max
  Coding DNA Sequence Number=SeqID_15803
MKLPMISEEVFQPLKPFLFMAIVATCPLAGAQNGLLCGPRIDFNQTKVVSGIGPLNDLLILERRELLRRWTLLDDLLIFEKRETLRRWTFNDLLFLKGEKR

SEQ ID NO: 107489 - protein, 56 aa, Glycine max
  Coding DNA Sequence Number=SeqID_15804
MAIYRKQPRSARKFARSSSSMESFGSSRSMATEWRRGKGDWRCHIKEKMSQRSSLP

SEQ ID NO: 107490 - protein, 143 aa, Glycine max
  Coding DNA Sequence Number=SeqID_15805
  Homolog annotation: Hit_ID=Q6WAY4; Match level="QueryCoverage=83%, HitCoverage=21%, E-value=4e-10, Identity=32%"; Hit description =Putative uncharacterized protein
MRSSQMPSLKKRFYLVKVKSLGITSLKELGQLMGQLQRQAFRKAYDKIWDLAMVEVSTEAIASLAQYYDQPLRCFTFGDFQLSPMVAKFEEILGCPLGGRRPYLFSGFYPSLARISKIVQISVQELDHKKQVENGVVGIPRKC

SEQ ID NO: 107491 - protein, 127 aa, Glycine max
  Coding DNA Sequence Number=SeqID_15806
AACNRLQHPVIDYQKAYWACNRLPIPVIDYNALSSINTHEIRAAAQPKHPPRFPPYLELQTFDSHSILHQITSQKLHQMAEPSKKRKGSSSTTIAAAHRRHGPSGAPTAPIPPSLSSPKIINTIFIR

SEQ ID NO: 107492 - protein, 137 aa, Glycine max
  Coding DNA Sequence Number=SeqID_15807
MEVEQLNVIELDRPCRSKPLKDVATPRRFIFEALQKGGIVATNDRSRLEEQYILMQSTDERSFGRPKPFVIYFTKDAARQKPRYPLATKPVPFPYQNSHAVPWRYTPPSEREEETTDVSSLSAKVTNITGLSGVTRN

SEQ ID NO: 107493 - protein, 143 aa, Glycine max
  Coding DNA Sequence Number=SeqID_15808
  Gene Ontology: Mol. function=receptor activity
  Homolog annotation: Hit_ID=UPI0000ECBAF8; Match level="QueryCoverage =28%, HitCoverage=48%, E-value=1e-16, Identity=100%"; Hit description= UPI0000ECBAF8 related cluster
  Subcellular localization annotation: CTP_CleavageSite=33; ConfidenceScore=5.01e-01
RKRKSAQYANRLSPRVGRFINAAGTTGFPTGKRAMVQSGVDALVLSIVPGDIAKVTTRLEKAAVRGGVCRWDNPAYETVKFVQEPKTGKFSMQAWHWPSFYNVVTGKTLALPNLIALQHIPLSPAGVIAKRPAPIALPNSCAA

SEQ ID NO: 107494 - protein, 118 aa, Glycine max
  Coding DNA Sequence Number=SeqID_15809
MFKSAALKIRKENKGWALWGNNNELKLRREERDQSRVDSFILKDELKACSRSKRSLTQRLCETETNMLAIITKYQEELNLATAHEHRVADEYAQVYAKKEARGRVIDSLHQEATMWMV

SEQ ID NO: 107495 - protein, 104 aa, Glycine max
  Coding DNA Sequence Number=SeqID_15810
DCITLALDLVAYWSAMCRRQRSNLFVDELGYSRGGGGASVAHCWPSPGCYGVSPCACLGAQYFLMKARHSVELTEARNQSWRPQDPIGLLWVHRVSCGRDSCKQ

SEQ ID NO: 107496 - protein, 148 aa, Glycine max
  Coding DNA Sequence Number=SeqID_15811
MLESFKQQDQMSVLELYIEKDVAGGSMFHSANSLTSCGNYLSNDDTQPATNMSNLHIDKDDDDDDDDYLVSNSYVEESLDEDDSVDGISDTDDGVTNIPQPVRIVHPAEGAQLIENSFWNDASHYNNINWSYPDEEDICGLEMPSTFN

SEQ ID NO: 107497 - protein, 366 aa, Glycine max
  Coding DNA Sequence Number=SeqID_15812
  Gene Ontology: Mol. function=nucleotide binding; Cellular component =cytoplasm; Biological process=mitotic chromosome condensation
  Homolog annotation: Hit_ID=Q937H2; Match level="QueryCoverage=97%, HitCoverage=24%, E-value=0.0, Identity=98%"; Hit description =Chromosome partition protein mukB
MVRGDASGERHGVERRLHRRELAYLSADELRSMSDKALGALRLAVADNEHLRDVLRISEDPKRPERKIQFFVAVYQHLRERIRQDIIRTDDPVEAIEQMEIELSRLTEELTNREQKLAISSRSVANIIRKTIQREQNRIRMLNQGLQSVSFGQVNSVRLNVNVRETHSTLLDVLSEQHEQHQDLFNSNRLTFSEALAKLYQRLNPQIDMGQRTPQTIGEELLDYRNYLEMEVEVNRGSDGWLRAESGALSTGEAIGTGMSILVMVVQSWEDESRRLRGKDISPCRLLFLDEAARLDARSIATLFELCERLEMQLIIAAPENISPEKGTTYKLVRKVFNNHEHVHVVGLRGFAAPVPEALPGTADAS

SEQ ID NO: 107498 - protein, 16 aa, Glycine max
  Coding DNA Sequence Number=SeqID_15813
STLEDPPDEPYSQEKP

SEQ ID NO: 107499 - protein, 27 aa, Glycine max
  Coding DNA Sequence Number=SeqID_15814
LAYGADSAAVPITTTDLVSKSVAIESL

SEQ ID NO: 107500 - protein, 370 aa, Glycine max
  Coding DNA Sequence Number=SeqID_15815
MVRTRGLGRALGRVIGRALSREDHHHSNDVPQRRRPTASAHRQQEVAPVTEDDTVVTKDVHTHAEEAIDDAEGFPGGSCDPLVLTDYGDHVAVIVRNGEERPELKLSSRGRKVQKFGRPAPEIEGLWTLAIENLYLPIKDAFHNFETLHVDEAVLMLVELLEVSGEEARAETAQCHGAYICLSWLQNIYQSKCEAGHWIVAARAYLLHLLESEWKLRMGSCHPSSYCWIYEHFPSVAESLSDPDYDEMSPHVCRWISTKASSKSLPTSVYRKHLDGLTIVDVCWMPYGDHCVVIYDGIPLSSDTDQRGWCGNLDMFRPFLHGFNPTDPAKHPPVTQDDTYMEPRILEVLVAPAAAPAHAPSDVEQPRHAV

SEQ ID NO: 107501 - protein, 110 aa, Glycine max
  Coding DNA Sequence Number=SeqID_15816
  Gene Ontology: Mol. function=helicase activity
  Homolog annotation: Hit_ID=Q8RV60; Match level="QueryCoverage=60%, HitCoverage=5%, E-value=9e-12, Identity=50%"; Hit description =Putative uncharacterized protein At2g05640
MENYKESMNFILAMYHYSILYSFLMEKTDIDLTYFIVVLHPAKKESYTMVESERLSYIRNNQKKLRIDKYSSLQTSLDTGTAKGLTKGKRVILPSTFVGSPRYMDQLYFD

SEQ ID NO: 107502 - protein, 116 aa, Glycine max
  Coding DNA Sequence Number=SeqID_15817
  Homolog annotation: Hit_ID=B0HC01; Match level="QueryCoverage=28%, HitCoverage=70%, E-value=3e-11, Identity=100%"; Hit description =Putative uncharacterized protein
GAGAYGKTPATRPFYGSWPFAGLLLTCSFLRYPLILWITVLPPLSELIPLAAAERPSAARNSYDHDYEFELGTPRSRLSNMFPYLYSILDRLKFIIPSLYSLGIGYPRSCPVPDPN

SEQ ID NO: 107503 - protein, 28 aa, Glycine max
  Coding DNA Sequence Number=SeqID_15818
MANANCPQESLHSVSNGNLRCVAVYVCV

SEQ ID NO: 107504 - protein, 26 aa, Glycine max
  Coding DNA Sequence Number=SeqID_15819
MYPEEILGTEGGRSGMTTSGMKISVS

SEQ ID NO: 107505 - protein, 72 aa, Glycine max
  Coding DNA Sequence Number=SeqID_15820
MKILSSGVVFTFEEARPGEQGCFLQKQPPSGGRNWKAQLSKKLGKLTDCAKTPPFGFRHITEFHGSRKPASF

SEQ ID NO: 107506 - protein, 173 aa, Glycine max
  Coding DNA Sequence Number=SeqID_15821
  Homolog annotation: Hit_ID=A5BSF6; Match level="QueryCoverage=64%, HitCoverage=34%, E-value=5e-12, Identity=40%"; Hit description =Putative uncharacterized protein
MEILIQSIDPGAWNAIIKGPFISTKELNGELVPKEWDEMKDDEKRIVQDDQKAKNILTSGLSSDEFFRTTRCKSEKEIWNMLEVTHEGTTDNFKQDSKLSYKNFGIEDYNNQGIQESSYNDGGSSFREEDAENFNLMVRKFGKFLKKSKDKKFSKSSKIENNNNNNNFTTFEC

SEQ ID NO: 107507 - protein, 76 aa, Glycine max
  Coding DNA Sequence Number=SeqID_15822
MRKGLHKYVILLDIWWFHGGVDNMEFFHMLVWVFTCKAMKLWKQMDQSSFKNIWDILIRVEGLKGCKSDGFPQVRH

SEQ ID NO: 107508 - protein, 229 aa, Glycine max
  Coding DNA Sequence Number=SeqID_15823
  Gene Ontology: Mol. function=protein serine/threonine kinase activity; Cellular component=cytoplasm; Biological process=protein amino acid phosphorylation
  Homolog annotation: Hit_ID=B0I557; Match level="QueryCoverage=52%, HitCoverage=27%, E-value=1e-56, Identity=88%"; Hit description =Protein kinase
  Pfam annotation: Domain name=Pkinase; Domain location=4-179; Score= -65.8; E_value=0.00011; Accession=PF00069.16; Description=Protein kinase domain
MTVKTSDTCSSRRRSQLVCKRMPGADKPVRARQRVLAGVGAGLTCGIRADCTESAPLRAIGAGLFAITPAGERGMCCKAIKLGNARVFPVTTLIPIGKRGYDGAKADIWSCGVILYVLLAGFLPFQDENLVALYKKIYRGDFKCPPWFSSEARRLITKLLDPNPNTRITISKIMDSSWFKKPVPKNLVGKKREELNLEEKIKHQEQEVSTTMNAFRYRARIRNHGHSCF

SEQ ID NO: 107509 - protein, 182 aa, Glycine max
  Coding DNA Sequence Number=SeqID_15824
MKLTDLNEKGPITDCHADAGKWFNTHGEILGNTKKGIEGEHEKALPLEVSMPHNSILNITNPSMVYAASGQHDLKVASEEMGQQTCGPTLFATKIYVRRKEVLRSNSKAQQFEKSIMDFNPASKTDPLPSLHEDSIELQYALLKEMGLTYGEDDNKVKGLLLDMENKDNMMAAEKGIKIQQL

SEQ ID NO: 107510 - protein, 110 aa, Glycine max
  Coding DNA Sequence Number=SeqID_15825
MAVFYTFVTGKPAGVYAHILNRLAVHIPLFCQLELNASGTTGFPTGTARLSALNGIVCSLIRHPRLYTLCVSGLRMCEEFSADNNFTGNSYDRLRIRGSVPPRISPGPNG

SEQ ID NO: 107511 - protein, 100 aa, Glycine max
  Coding DNA Sequence Number=SeqID_15826
ALWGSNNELKLRSAERDESRMESMVLEDEHAKVSALQIEREARERVIELLHKEAMKWMNRFALTLNESQELPRLLARAKAVADTTRAKAKVMSEIEEVQE

SEQ ID NO: 107512 - protein, 127 aa, Glycine max
  Coding DNA Sequence Number=SeqID_15827
YRLEVMINQGNESTKFLLWDRECSELIGQSADAFNKLKIEDGDVDLNALPQALDKLLGYELAFKIKVQPKFRNFAVLKCSADSSLINVVMDMLADAEVMFNASYLTLPIGEIDHDPLLGRPLTPTKR

SEQ ID NO: 107513 - protein, 362 aa, Glycine max
  Coding DNA Sequence Number=SeqID_15828
AWTRYTDNVLGRHILAERKVEIYHTELDEFQGEMERHNFHKRFTNLADSSIDLTLVKEFYANLYSPEGPLPKQVIIWVHLIRIDADNLNAFLETLMVLAEGESLPAYSRYCRMPTDIREIEAALCIPDRGFILNAEGHPGKILRKDLTTLAQVWSVLSYSNLALTSHTSDLTVDQARLIFGLVTQLDMNVGVLISGQITSMAQSNSSRLGFPALITALCRTRGVASDSLFFEHLSQIINLAYIRKNCWNPDDPIIIIRGARRPRARPTEAPSTSVAPHLAATSAAPPLAHIAAAPSTLPLVDFQSFEAMLQSIHQGQIILLQSLHLVAPLDFIPTVEQFNEWVAWPGTQPPPHRDDEDPAAQ

SEQ ID NO: 107514 - protein, 35 aa, Glycine max
  Coding DNA Sequence Number=SeqID_15829
MGTSEPYTRAMKGTMREPQANLGAGGVTNPGISVD

SEQ ID NO: 107515 - protein, 161 aa, Glycine max
  Coding DNA Sequence Number=SeqID_15830
  Gene Ontology: Cellular component=integral to membrane
  Homolog annotation: Hit_ID=A7PFR7; Match level="QueryCoverage=66%, HitCoverage=16%, E-value=3e-41, Identity=71%"; Hit description =Chromosome chr11 scaffold_14, whole genome shotgun sequence
MREPQLCNVACRLILDEKTAKEFKEMIDDEYRVNMILDNLPLVVPIRRLDQEASVVYLHGFLVGLKGQYSGIKEDKYFIHNHLAFVVKYHRDPELELSRIVGFESRPAGMQAWHWPSFYNVVTGKTLALPNLIALQHIPLSPAGVIAKRPAPIALPNSCAA

SEQ ID NO: 107516 - protein, 21 aa, Glycine max
  Coding DNA Sequence Number=SeqID_15831
MEVKESLLGIMATIALLSRYG

SEQ ID NO: 107517 - protein, 143 aa, Glycine max
  Coding DNA Sequence Number=SeqID_15832
MATQLIHDRVVMECLEGVWETLEGNERCRFRGTIRLTATSLVHPEEPARTLQQPVEWILPTPTPYRLVEPVQVIEVSSSEEDPEEDPEELPPEPVVDALDFPEDDEDPLPDVDSPEDIMSASEVDSTEESGPGGTVNSEDSSS

SEQ ID NO: 107518 - protein, 101 aa, Glycine max
  Coding DNA Sequence Number=SeqID_15833
MPNINQAFRPASETPPVQHPSNKGHPLKTRLLHNLAPPTALIRAQVPIWEGIFRLATLFDRQPNGGGIPQEDFLVSFSLMVQPQPNLRLSRGYPGHSIDNV

SEQ ID NO: 107519 - protein, 161 aa, Glycine max
  Coding DNA Sequence Number=SeqID_15834
  Subcellular localization annotation: CTP_CleavageSite=79; ConfidenceScore=5.58e-01
MPISPCKSISWSVSSRHGDRTHKTPSGPGKVQQGPGVSSSGYGPLSILQGARTPPARSRIAPARHPVDPKKSNRVLELSSSNYGSLSVLQSTCHLQQGHQPPTNRAFIKKYCVSRKAQGETPQQPGDGPAAGNRRTAITSRVHLSSSTKRLERCLRPMADQ

SEQ ID NO: 107520 - protein, 440 aa, Glycine max
  Coding DNA Sequence Number=SeqID_15835
  Gene Ontology: Mol. function=metal ion binding; Cellular component =intracellular; Biological process=regulation of transcription, DNA -dependent
  Homolog annotation: Hit_ID=A4WA65; Match level="QueryCoverage=76%, HitCoverage=82%, E-value=1e-179, Identity=94%"; Hit description=ROK family protein
  Pfam annotation: Domain name=ROK; Domain location=158-343; Score =122.4; E_value=1.3e-33; Accession=PF00480.11; Description=ROK family
MRWVTIAEEDAVSEMWLVWAKHREQSHAAERFKQQLMNASAGRHFQGKPCKCFTIANSLFRSSKIREYEVVADSQPGHIDQIKQTNAGAVYRLIDQLGPVSRIDLSRLAQLAPASITKIVREMLEAHLVQETEIQEPGSRGRPAVGLLVETEAWHYLSLRISRGEIFLALRDLSSKLVVEDRLELPLNAEQPLLESIVSHIDRFFIRHQQRLERLTAIAITMPGIIDTENGIVHRMPFYDDVKEMPLGEVLKNHTGVPVYIQHDISAWTMAEALFGASRGARDVIQVVIDHNVGAGVITDGRLLHAGSSSLVEIGHTQVDPYGKRCYCGNHGCLETIASVESVLELAQVRLGQSMSSSLHGQPLTVDSLCAAARQGDLLAKDIITGVGNNVGRILAIMVNLFNPQKSSLARRSARRRRSCSRRSRPVFTSSRSTAWGSSR

SEQ ID NO: 107521 - protein, 141 aa, Glycine max
  Coding DNA Sequence Number=SeqID_15836
MELTSVVVGDTEGPPKCFAGVYHQLLALQWHIRGKARSRLNCGGYRSGVIDILIGSVRHIGWCIIGRQAIWREGMLAIWGVRSTSTIVLVAAATALTSIIFFMLIMASIIAVIYSFMASMLVFICSCTSSTSPITLALAWV

SEQ ID NO: 107522 - protein, 132 aa, Glycine max
  Coding DNA Sequence Number=SeqID_15837
DAMSDMITLQHTEIKASFETSTHVIGHVFKVALYKRVLGIVSRYALNQIAAEFERVHYAGKNPSSCGCHKNYAWSSLCMKRWKPYLKSKLREIAYPDQNSMCPPPTKINTKGAPKKPINRNQISTKRDLSYL

SEQ ID NO: 107523 - protein, 45 aa, Glycine max
  Coding DNA Sequence Number=SeqID_15838
MCFREENPSRGAFVSDSWEILHRSSSFSIRSSSFFSLQPFSFLPF

SEQ ID NO: 107524 - protein, 75 aa, Glycine max
  Coding DNA Sequence Number=SeqID_15839
GSPIEVVVTVVLEEAVVEADLLTSSVKSASSMVIDVAPCGACRPWIFFINGFLCFLRSDCSGMEKEKDEWRCHFK

SEQ ID NO: 107525 - protein, 137 aa, Glycine max
  Coding DNA Sequence Number=SeqID_15840
MDRARLVYRLVTGMDMNIRALISGQISTIAQSNSSRLGFPTLITAICRARGVISDILTYESLSPTINLAYIKKNCWNVDDLTVNFRGARKVRARPTDIPSSSVPPAPSTSATPTPAPPTSATLAPAAQDSQRFETML

SEQ ID NO: 107526 - protein, 152 aa, Glycine max
  Coding DNA Sequence Number=SeqID_15841
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTQKSKNTRYNIKKISSVLGREFQIETAK

SEQ ID NO: 107527 - protein, 76 aa, Glycine max
  Coding DNA Sequence Number=SeqID_15842
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=88%, HitCoverage=65%, E-value=2e-33, Identity=100%"; Hit description=LacZ protein
MLSPMNHGDPLESTCRHASLALAVVLQRRDWENPGVTQLNRLAAHPPFASWRNSEEARTDRPSQQLRSLNGEWRLM

SEQ ID NO: 107528 - protein, 214 aa, Glycine max
  Coding DNA Sequence Number=SeqID_15843
  Pfam annotation: Domain name=Transposase_23; Domain location=51-114; Score=-9.3; E_value=0.012; Accession=PF03017.5; Description =TNP1ENSPM transposase
  Subcellular localization annotation: CTP_CleavageSite=22; ConfidenceScore=5.02e-01
MSQRGSLIPTHIQPDIHGLGARVSTKGSNAKSVRNPCLPNDVALVKPPMGLYVQRQDSIELVALGKTYDGGSTIHNVAYADNVVRVSVEQVIDGDAEVPFPTSEFKCVREALHTFIAWPTPLVKKIFIEHEGSSPTKDTEVVEAVNDVVIDDPLRELIKSLVDIYEKPVELVWDVTKFGIPNATASLFVTCADVNEIISGVQCLNIAILQLWTM

SEQ ID NO: 107529 - protein, 118 aa, Glycine max
  Coding DNA Sequence Number=SeqID_15844
  Subcellular localization annotation: CTP_CleavageSite=58; ConfidenceScore=5.00e-01
MDPKKSHRALGFPTLVTGLCQSYRVPVPPARSCHRDIGIAPTKTPSGPREVQQGFGVSSSGYGPLYSTEYLSPPARASGPLLIELSSRSTASPGRRRAKHHSSLGMASSGQQMHRHHL

SEQ ID NO: 107530 - protein, 136 aa, Glycine max
  Coding DNA Sequence Number=SeqID_15845
  Homolog annotation: Hit_ID=A0ST23; Match level="QueryCoverage=33%, HitCoverage=91%, E-value=1e-11, Identity=73%"; Hit description =Putative reverse transcriptase
DAGSRQARQGASAGVGGCRGWLNYAASEQIVLRVHHMRAIGAGLFAITPAGERGMCCKAIKLGNARVFPVTTLNLLKEAFQGSFSRKLLKGTELEFVIMVIAVSFGKPVVPAALMNRPTRGERRFAYWALFRFLAH

SEQ ID NO: 107531 - protein, 59 aa, Glycine max
  Coding DNA Sequence Number=SeqID_15846
MEEAIQAQECRFAKNRVEEVTNYVEQKDEKFETVLLARGGNEGSQENTWYLDTGASNHM

SEQ ID NO: 107532 - protein, 111 aa, Glycine max
  Coding DNA Sequence Number=SeqID_15847
  Homolog annotation: Hit_ID=Q51617; Match level="QueryCoverage=35%, HitCoverage=56%, E-value=5e-12, Identity=89%"; Hit description =Putative uncharacterized protein
  Subcellular localization annotation: CTP_CleavageSite=62; ConfidenceScore=5.13e-01
MVAGKLEHRGVTLVVWYGFIQLRFPTIKASYMIPHVVQKSGVSRGPFVSRVSVMTVKTSDTCSSRRRSQLVCKRMPGADKPVRARQRCWRVSGWLTMRIRADCTESAPYAV

SEQ ID NO: 107533 - protein, 76 aa, Glycine max
  Coding DNA Sequence Number=SeqID_15848
  Subcellular localization annotation: CTP_CleavageSite=41; ConfidenceScore=5.43e-01
MEGANTFLKRKYNSRIWNILHDRFPSVFPTFSTNKRWWRLRAFSSFGRRTRESRLARPPKGRLRLLATPLGTVFVS

SEQ ID NO: 107534 - protein, 214 aa, Glycine max
  Coding DNA Sequence Number=SeqID_15849
MSALKDQMAFMMEAMLDMKRLIESNAATAVVASTAAEADPVLLSMANLAHQLTPDMVGQGRDILGNTNKPHLGYNRSAYPYGLPPNFTPPAMHENMDHVAPPTFEGQPPQPTGGVCEDPQERAQGDVDSYPLFTTEGSAPYGLPQSNIVGVSQPHPMQPLLFFVGGPPPIVEGRKKLDLIEERLRAVEGFRDYPFANMTDLCLVPDVVIPPKFK

SEQ ID NO: 107535 - protein, 67 aa, Glycine max
  Coding DNA Sequence Number=SeqID_15850
DQRVPMNPKRIKVIPEWLTPPSIRKIWGIHELTFLMQSYPARALARRLQVDWARDPRKGPRVLMSLR

SEQ ID NO: 107536 - protein, 65 aa, Glycine max
  Coding DNA Sequence Number=SeqID_15851
MHGVATNVYSRKTSEKSERCGLRTLIVKGSGVVFTHGEVLSFCGRQGRFPCSYVFLNCDKEIIPM

SEQ ID NO: 107537 - protein, 78 aa, Glycine max
  Coding DNA Sequence Number=SeqID_15852
MEEFDAHVAWLGDQPFSSRGGGASVAHEPVPEEPPALAAAEEETTPEETQPSTPVAEPEQPIQDSLVAPALDLNEDQP

SEQ ID NO: 107538 - protein, 297 aa, Glycine max
  Coding DNA Sequence Number=SeqID_15853
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
WNSYVPINVSFRQKLAPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDAPLPFQPQLSLNSDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107539 - protein, 61 aa, Glycine max
  Coding DNA Sequence Number=SeqID_15854
MDENHKKTHKFLDVTNATNLVTSKLIVLQMKNGLRKVIRKEKEINLLTKDYESDENISQEG

SEQ ID NO: 107540 - protein, 218 aa, Glycine max
  Coding DNA Sequence Number=SeqID_15855
  Gene Ontology: Biological process=transposition, DNA-mediated
  Homolog annotation: Hit_ID=Q1J7G7; Match level="QueryCoverage=21%, HitCoverage=78%, E-value=2e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPRIRLFHYVIPPKKIVSVADHVNTEYEAWEVQDYTPCLAPIYSFKIGSVTRGARYQLLFPLVRVNFELGVIMVIAVSFGKPVVPAALMNRPTRGERRFAYWALAECILAYYVGTDEGVSEVLHVAEKKAAP

SEQ ID NO: 107541 - protein, 117 aa, Glycine max
  Coding DNA Sequence Number=SeqID_15856
MAGAGDNGGVYHQLDGSQRLLLDAMTTQMQHLLNRNNEELYRRIVKSSLFILKPLSPREVCDDQIRMREKREQEKENSEAPQRIRKKKSDTPEGKSDTHKRESDTHERKFNLFCRGE

SEQ ID NO: 107542 - protein, 78 aa, Glycine max
  Coding DNA Sequence Number=SeqID_15857
IARARHPVDPKKSNRFYGVRVSSSKGIRPPTNRAFIKKYCVPRQAQGGIPQQPGDGRQRATDTPPSPLEFISAHPQKG

SEQ ID NO: 107543 - protein, 182 aa, Glycine max
  Coding DNA Sequence Number=SeqID_15858
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=50%, E-value=7e-24, Identity=100%"; Hit description=LacZ protein
MKHFTDTLISANICGFIRTGDSVPDCSRSGVVERQPTLMPCFFSLAKVDSWVSASALSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107544 - protein, 38 aa, Glycine max
  Coding DNA Sequence Number=SeqID_15859
MGPVLPDSQRPFLEGCAEKGASHSQIEHCPPRFVSWGL

SEQ ID NO: 107545 - protein, 281 aa, Glycine max
  Coding DNA Sequence Number=SeqID_15860
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIDSLKSEYEDQKKLVTDLGTKLYILKRKSQTSGGSPEYDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107546 - protein, 110 aa, Glycine max
  Coding DNA Sequence Number=SeqID_15861
MGAKYLEVVKRGSHPNNGWSPDEIRTRSPLDGEKVCKMTIICPRPPLNLLFLNDKGRRICLCTFITQLAKSEFQRVQNLSLRVYPLSLLFLNDKGRRICLCAFAHSACCS

SEQ ID NO: 107547 - protein, 130 aa, Glycine max
  Coding DNA Sequence Number=SeqID_15862
  Homolog annotation: Hit_ID=A5C406; Match level="QueryCoverage=70%, HitCoverage=20%, E-value=2e-09, Identity=36%"; Hit description =Putative uncharacterized protein
MSKYGGWNALIHGRNSTAFSNWWKDLKSIFQQQHTNRLFWKDKWREDDLTLQEKYPSLYQVSYQQDSSISLMGILVNNKWEWRMQWRRNFFDHEIDMVEAFMDEIDAVQIYPTSMDSLIWKADPSGAYST

SEQ ID NO: 107548 - protein, 84 aa, Glycine max
  Coding DNA Sequence Number=SeqID_15863
MATSDHAILCDRSHIPTKRSLLELSSQNALLAQNKLLSKQLEALIDILSCVICGGAHSLAAVFPKKKHHMKSTTWGTSQDKISM

SEQ ID NO: 107549 - protein, 140 aa, Glycine max
  Coding DNA Sequence Number=SeqID_15864
MPQNVLYDAIGIYQRCDGVNFEGSSGVSWFLSAVPPVQLLNGVVLSAHNSAHKHTEPEHQRGKCKAGVPNDAAANSHSHPCRCALTAPLSSRDAVVPFAAFKAESANCCAKGDRCGPLALLRQLALKRMCCILAITMLAL

SEQ ID NO: 107550 - protein, 73 aa, Glycine max
  Coding DNA Sequence Number=SeqID_15865
MTPVNRKAGTGERTREPPGGNAWGAEPMEKRLCRGPLTSLFFKYCHSHNFSISNSCSPWGKPLVLSVPHDDRR

SEQ ID NO: 107551 - protein, 340 aa, Glycine max
  Coding DNA Sequence Number=SeqID_15866
  Gene Ontology: Biological process=transposition, DNA-mediated
  Homolog annotation: Hit_ID=Q6UUU1; Match level="QueryCoverage=17%, HitCoverage=40%, E-value=5e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIEHLSVQRENRDREIAVAAKNRERVIAIETERIEKDRLLSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 107552 - protein, 257 aa, Glycine max
  Coding DNA Sequence Number=SeqID_15867
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDQMSKISQRYSSRVQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107553 - protein, 260 aa, Glycine max
  Coding DNA Sequence Number=SeqID_15868
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLEVMVADREKETHLKPWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107554 - protein, 423 aa, Glycine max
  Coding DNA Sequence Number=SeqID_15869
  Gene Ontology: Mol. function=helicase activity; Biological process =viral genome replication
  Homolog annotation: Hit_ID=Q2R1R7; Match level="QueryCoverage=98%, HitCoverage=27%, E-value=4e-97, Identity=40%"; Hit description=AT hook motif-containing protein, putative
MIESERLSYVRNNQKKLRVDKFYSLQQSSEAGNTEGLGQGKRIILPSTFVGSPRYMDQLYFDGIAICSHVGFPNLFITFTCNPNWLEIHRLLTPLNLTPIDRPEIISRIFKLKYEQMLLDLTKNHLLGKVVAYGDGYPVYRRRNTGRTITKNGIIIDNRWIVPYNPKLLKKYQAHINIEWCNQSTSIKYLFKYINKGYDRVTTVMVHDDNGTVPHANTPNDEIKYISPCESTWRIFGFPIHGRKPSVERLQFHLPGQHSVLYQDHDDINDLLSNPGISESKFIAWMNTNQVFVEGQSLTYSEFVTKFVYNQKQRCWQLRKKGYTTGRLQWVPPTTGELFYLRMMLTVCRGPISFENIRTVDGVEYSTYREACFAMGFSQDDREFIVAIQEAKDWGSAPYLRNLFVLLLLTGTMNKPEQVWEKT

SEQ ID NO: 107555 - protein, 169 aa, Glycine max
  Coding DNA Sequence Number=SeqID_15870
MNLVIVIKRKEHALRCPYQTCARARVMGEVEEVQEQMKADMEAMKEKMATTMEVMMSMKKIMGANAVTVAATNTIAKCKNKHAFPPYDLPPYYTPPNVAYTPNGNVNNSTPILVESQQPQSDHAHVSRPMGETHEMPHHNLANFEPCLGYVAEGQAVGDIPLQNTLEGP

SEQ ID NO: 107556 - protein, 122 aa, Glycine max
  Coding DNA Sequence Number=SeqID_15871
GCMNSARQSIHGDSWTHDAGGCTNNARQSIHGAPDLKVEDALNSAEAINSWGSGLDDYDEGCMNARQSIHGAPDFMAINSWGSGYDGGGCMNSARQSIHGTPNLMMEDARTTLGNQFVGLWT

SEQ ID NO: 107557 - protein, 71 aa, Glycine max
  Coding DNA Sequence Number=SeqID_15872
MHARHSYGSNAFQGYFDDAKESRVKQSFKQRFKNQVSRFKIQESSFKFQESRIKIKIQDSRFKNQEKTQSR

SEQ ID NO: 107558 - protein, 178 aa, Glycine max
  Coding DNA Sequence Number=SeqID_15873
  Gene Ontology: Cellular component=ribosome
  Homolog annotation: Hit_ID=A2Q6B4; Match level="QueryCoverage=98%, HitCoverage=72%, E-value=1e-19, Identity=32%"; Hit description =Ribosomal protein L33; Nucleic acid-binding, OB-fold
  Pfam annotation: Domain name=DUF223; Domain location=40-135; Score= -7.8; E_value=0.016; Accession=PF02721.5; Description=Domain of unknown function DUF223
MARPPNNIKSINGSKEALKLVVRINDLWFIGTPNRSEQAEMVIIDSHGDTIHVVCKQDQLKSWKADLIENYTYVMHNFKVMKNDDQFRICDHQYKLVFTGVTVLRQSNLEDLPFKKYQFADFTNIVAGLFEPKLLVDIIGVVDEVVYRHVGSENTRVVFKLKDLRSYCTIDLLTNYVF

SEQ ID NO: 107559 - protein, 233 aa, Glycine max
  Coding DNA Sequence Number=SeqID_15874
  Homolog annotation: Hit_ID=Q2HW90; Match level="QueryCoverage=92%, HitCoverage=43%, E-value=1e-16, Identity=27%"; Hit description =Putative uncharacterized protein
MGSSQMPLLKKRFYQVKVKSLGIISLRELGQLMGQLQRQAFRKAYGKIWDLAMAEVSTEAIASLAQYYDQPLRCLTFGDFQLSPMVEEFEEIPGCPLGGRKPYLFSGFYPSLARISKIVQISAQELDHRKQVENGVVGIPRKCLEAKARILVGRGEWASFIDILALLIFGGFLFPNVDGLVDLAAIDAFLAYHDRKESLVVAILADLYDTFDRRCEKSSTRIVCCTPALYVWL

SEQ ID NO: 107560 - protein, 128 aa, Glycine max
  Coding DNA Sequence Number=SeqID_15875
  Homolog annotation: Hit_ID=A0PAV3; Match level="QueryCoverage=29%, HitCoverage=17%, E-value=5e-07, Identity=76%"; Hit description =Restriction endonuclease
MVKVGTSYVPINVSFSPKVGPGLPGINRDTRIYLFCEVIKKIFVTAVPPVQLLTGMVLSAHNSQQAYRAGTSALASVKPGVPNDADARRTSPFAAFKAESANCCARAIGCPSQNAFCGKKSCTGAQLN

SEQ ID NO: 107561 - protein, 93 aa, Glycine max
  Coding DNA Sequence Number=SeqID_15876
  Gene Ontology: Mol. function=transporter activity; Cellular component= intracellular; Biological process=transport
  Homolog annotation: Hit_ID=A7Q7Z5; Match level="QueryCoverage=98%, HitCoverage=27%, E-value=2e-31, Identity=57%"; Hit description =Chromosome chr18 scaffold_61, whole genome shotgun sequence
MWADMLHWRKEYGVDSILQEYEEVQCYYPHGYHGVGKEGQPGFEKMFKEKFPACSIAAKRHIDKTTTILDVHRVNWVSFSKVAHDLVMRMQKN

SEQ ID NO: 107562 - protein, 167 aa, Glycine max
  Coding DNA Sequence Number=SeqID_15877
  Homolog annotation: Hit_ID=Q2HTA0; Match level="QueryCoverage=76%, HitCoverage=23%, E-value=9e-09, Identity=30%"; Hit description=IMP dehydrogenase/GMP reductase, related
  Pfam annotation: Domain name=DUF1723; Domain location=69-117; Score =13.7; E_value=0.013; Accession=PF08330.1; Description=Protein of unknown function (DUF1723)
DTGADIPADTGAQAAEDEHEGFPGAPSDPSVLTQYADHVACSVCTGEERPELKLSFHGRKAHSLGRPVPAIEGLIARTGLSPLITSSFHLPVGELTITLDDISSILHLPVVGDLHAFQPLHVDDAVQMLVDLLMVSVEAARAETGQCRGPPFVTSVRPGGMPGEWLL

SEQ ID NO: 107563 - protein, 146 aa, Glycine max
  Coding DNA Sequence Number=SeqID_15878
  Subcellular localization annotation: CTP_CleavageSite=44; ConfidenceScore=5.21e-01
MVKVGTSYVPINVSFSPKVGPCFPPESTSPNQDYFRFGARNPLRSQLIATVDLEGCAGTFDFVVRLSFLFSMKLLSAPIRHKAYRPDISAASVKPGAAERNHHTRRLMRCAQAAHSPSVRNCSGNGCRCQGPSLLNATRRRGGGLQ

SEQ ID NO: 107564 - protein, 305 aa, Glycine max
  Coding DNA Sequence Number=SeqID_15879
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRLPQNGPGVADPQGRSENNRDRVANPAQIPGQADIRQAERGLNPGSNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107565 - protein, 145 aa, Glycine max
  Coding DNA Sequence Number=SeqID_15880
MAYHGFYQLFPPVQLLKFGVVSASQFGTQAYQPEASALASVKPGALKGGVCILAYYVGTDAGTHYGPRIPALSSLPLGRRCGDARTSGLSPTGQELSRGMLQGSDVAFPPGGSLVRSPVPAFRFTGVIPLLWPRLSHSTPDTQFR

SEQ ID NO: 107566 - protein, 153 aa, Glycine max
  Coding DNA Sequence Number=SeqID_15881
MYPLLFSVTTTQVDVPSTCTTKDGKGRIKRILRLCRFEFFDKVEGRHKRIQAVSPSFFWKREKRDTKRIQAKTFRKLLAKEEEEEEEEEEEEEKVQRDSKVVKEYVEKLFVRVVGVVSVLQIGTGNLWILKMRVRELFTHGEGDAILPPKGIG

SEQ ID NO: 107567 - protein, 79 aa, Glycine max
  Coding DNA Sequence Number=SeqID_15882
MGDQEETQEHMKVYMSALKEQMASMMEAMLGMRQLIPNSPSYSTPSSPKCGRMRKEHTGAQQQPPFGIQPGGLPLWIAA

SEQ ID NO: 107568 - protein, 66 aa, Glycine max
  Coding DNA Sequence Number=SeqID_15883
MGAKYLKVVKRESHPNNGWSPDEIRYRYIIWILSNSFLLVDTRRRMTIICLCVSLDAIEPGWQGAE

SEQ ID NO: 107569 - protein, 131 aa, Glycine max
  Coding DNA Sequence Number=SeqID_15884
MELIENMTTSDHAILHDKTHVPTKRSLLELSSQDALLAQNKLLAKQLESLTKTLSKLPTQLQAAQPSHLAIMQVGGCSIYGGAHESGCCIPLDDVAKEVNYMGNQNRQGFNAGVFSGYQQGANFNRNQGQG

SEQ ID NO: 107570 - protein, 71 aa, Glycine max
  Coding DNA Sequence Number=SeqID_15885
MTLSSWQNKLDKYFTCKTLVMKGGAWFYRAKQLRQRSPKQMASLGLHTTRVCRQFHHPPPLPSLASHVYCC

SEQ ID NO: 107571 - protein, 235 aa, Glycine max
  Coding DNA Sequence Number=SeqID_15886
  Homolog annotation: Hit_ID=Q6UUU1; Match level="QueryCoverage=25%, HitCoverage=40%, E-value=3e-18, Identity=78%"; Hit description =Putative uncharacterized protein
WNSYVPINVSFSPKVGPGLPGINRDTRIYLFCEVISVTAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107572 - protein, 65 aa, Glycine max
  Coding DNA Sequence Number=SeqID_15887
  Homolog annotation: Hit_ID=A5B0P7; Match level="QueryCoverage=67%, HitCoverage=14%, E-value=6e-10, Identity=61%"; Hit description =Putative uncharacterized protein
MSPYRVVFERACLFPVEIEHKAYWAVKTCNFFMDQAGEERKLQLRSSGDQKGLPKQELQGQQTST

SEQ ID NO: 107573 - protein, 126 aa, Glycine max
  Coding DNA Sequence Number=SeqID_15888
MSTSDHAILRDRTHQPTKKSLLELSSHDALLAQNKLFSKQLEILTETLGCTICGEAHETGPLKKTLKKFTIWEINSDKGILKGGFSGFQQGPYNQQGQWRSHSSNHFNKDQGRPSNKPIKQGPNIF

SEQ ID NO: 107574 - protein, 156 aa, Glycine max
  Coding DNA Sequence Number=SeqID_15889
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MKMLLIPHDVAPCEACRPWIFFINRVICFLEDRISCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107575 - protein, 158 aa, Glycine max
  Coding DNA Sequence Number=SeqID_15890
  Homolog annotation: Hit_ID=A5BU47; Match level="QueryCoverage=68%, HitCoverage=6%, E-value=8e-08, Identity=30%"; Hit description =Putative uncharacterized protein
  Subcellular localization annotation: CTP_CleavageSite=43; ConfidenceScore=5.37e-01
IMGSPPASPPPPPLPPSPPPPPPPSDALPLPPPGAKRPMVHVDPATGKANGPHRKKLRTYLGIVAHDKVDVTYENWKEVPTAQKDLIWEDIQAFDSRTKRKLLQTVGERWRQFKSDLTRKWALAADQDGVDDTVCEKYGISKEKWAQFCQTRREPSWE

SEQ ID NO: 107576 - protein, 128 aa, Glycine max
  Coding DNA Sequence Number=SeqID_15891
RVPFAIQAAQLLGRAIGAGLFAITPAGERGMCCKAIKLGNARVFPVTTFPTNSLPSAVRVSSTLKSYPEPHELLVIHASSTIESPAARFDCLALFVYPPPSNLIRSPMNCLSFMHPPPSSQEPHELIA

SEQ ID NO: 107577 - protein, 85 aa, Glycine max
  Coding DNA Sequence Number=SeqID_15892
MNSSSSSETKKLEGKLDALVNLVTQLALNQKFVLVTRVCGLCSSANHHTDLCPSMQQSGAIEQPEAYAANIYNKPPQPQQQNQPQ

SEQ ID NO: 107578 - protein, 183 aa, Glycine max
  Coding DNA Sequence Number=SeqID_15893
  Homolog annotation: Hit_ID=Q6WAY4; Match level="QueryCoverage=83%, HitCoverage=27%, E-value=3e-13, Identity=32%"; Hit description =Putative uncharacterized protein
MGTNQTGKRFYQVKIKGLDITSIKELGRLMGPLQMQAFRKAYGKILDLTIAEISIEAIASLTQYYDQPLRCFTFGDFELVPNVEEFEEILGCPLGGRKPYLFFGFLPSLSKIAIMVRDSTRELDRVKQTQNGIVGLPRKYLEGKARDMANQEEWSSVYGCISIANLWGCTLSKCGWFGRPSCN

SEQ ID NO: 107579 - protein, 48 aa, Glycine max
  Coding DNA Sequence Number=SeqID_15894
MVVILPKENLVVWFCTLHNSVLKGLDDTPQLKSKVGARWIVVKTKMKH

SEQ ID NO: 107580 - protein, 180 aa, Glycine max
  Coding DNA Sequence Number=SeqID_15895
MTLLLSNILPSDRNANLLLQKYQLVCVIPTWGSHPQRHPVDLKKSNRALGFPALVTGLCRPYRAPVPPNKFMSSWHRDCARKTPSGPEEGQQGLGVASSKYGSLSVLGSACRPQKGHQAPLPIELSSRKYCAPRQAQGETPQQHWDGRYRANRHTATTSRVHLISSIKRLERCLRHMADP

SEQ ID NO: 107581 - protein, 74 aa, Glycine max
  Coding DNA Sequence Number=SeqID_15896
SIKSSQEPRDHQSKGVRAVNGSVMQAPLELLGLGSSSSMDSFASWKMNGSGMEKEEREETPLQGEDESRRSSPP

SEQ ID NO: 107582 - protein, 120 aa, Glycine max
  Coding DNA Sequence Number=SeqID_15897
  Pfam annotation: Domain name=zf-CCHC; Domain location=68-85; Score =12.3; E_value=0.021; Accession=PF00098.14; Description=Zinc knuckle
MGVRYEVHMWGEKVEPVQGPQYWAHTQYAQPFPPHKKVQRERPKKNRRRDVDEDNVIGHRAKRKLSDFTCGRCGQTNHNIRSCKNIGVPIRPKKYVAPPTLNQDDNLLAQDEQALNEAKV

SEQ ID NO: 107583 - protein, 115 aa, Glycine max
  Coding DNA Sequence Number=SeqID_15898
  Homolog annotation: Hit_ID=A2Q1D6; Match level="QueryCoverage=97%, HitCoverage=19%, E-value=1e-11, Identity=38%"; Hit description =Ovarian tumour, otubain, related
MKSTHGLPCACELSRHTAGSIPVESVHIFWRRLFFSDQGLCEAEVSIKEEIETISKRFDELDVSGKVNLKSKLREIEYPDHNSMCPPLSKVNTKGAPKKPMKRSQRSTKCDPCYW

SEQ ID NO: 107584 - protein, 75 aa, Glycine max
  Coding DNA Sequence Number=SeqID_15899
MKAKCNQRWLGGANTGCSPRRANLPFFFLRYHEYGPLRVGVHLLEPTQAAFFACPASGRDDDLSVMTLAFIYIRP

SEQ ID NO: 107585 - protein, 148 aa, Glycine max
  Coding DNA Sequence Number=SeqID_15900
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=Q6A9W9; Match level="QueryCoverage=34%, HitCoverage=6%, E-value=5e-14, Identity=74%"; Hit description=Cation- transporting P-type ATPase A
MVKVGTSYVPINVSFSPKVGPGLPGINRDTRIYLFCEVIFRHSCPSCSATDGVGELELHRGGGRSRTSGSPGLQEFDANGQDVDRAHRYAAALDQHSTHPVAKAVVAAVKGTIPACPSPRTLAGRGASIKLIDTVDLEGGPGTSFCSL

SEQ ID NO: 107586 - protein, 116 aa, Glycine max
  Coding DNA Sequence Number=SeqID_15901
LAADHRHGDGHHQNTAGDAERIDRDAEHPQDPFAQEKRRPQNDGDRQVGGQVGFIAPRFRLVAGHADKHRQDAHRVDQRKQTDKELDKAGKIQQRLAHRCSALIAIKKVCCLCALM

SEQ ID NO: 107587 - protein, 56 aa, Glycine max
  Coding DNA Sequence Number=SeqID_15902
MVKARQKGVWKGKRGRWLPPSSPRRAGLLPPEGTAFCWNTLEGPSGPGCYLHTPVY

SEQ ID NO: 107588 - protein, 95 aa, Glycine max
  Coding DNA Sequence Number=SeqID_15903
MDQRFNIQFERLDILRDSIRHPKLQHSSSSVSIYDGTQSDIRVKSHCRLNLLSASTFNFERPDILRDSIRHPSKKLLSFELPQRFNIQFRASGIL

SEQ ID NO: 107589 - protein, 114 aa, Glycine max
  Coding DNA Sequence Number=SeqID_15904
  Pfam annotation: Domain name=G-patch; Domain location=1-42; Score =29.7; E_value=1.1e-05; Accession=PF01585.14; Description=G-patch domain
MVARVMLKHGFEPGMGLGKDGLGNADVVDIRGNPSKNGLGYEPGMPRRRNVPSRLWADRAWPGRISQCWNDVRGRDGRSRRGVPSRPAKFRATMPSRLPSGELARDKPVRGLYR

SEQ ID NO: 107590 - protein, 253 aa, Glycine max
  Coding DNA Sequence Number=SeqID_15905
  Gene Ontology: Mol. function=beta-lactamase activity; Cellular component=nucleus; Biological process=beta-lactam antibiotic catabolic process
  Homolog annotation: Hit_ID=P62593; Match level="QueryCoverage=44%, HitCoverage=39%, E-value=4e-56, Identity=98%"; Hit description=Beta -lactamase TEM precursor
LNEAIPNDERDTTMPVAMATTLRKLLTGELVTLASRQQLIDWMEADKVAGPLLRSALPAGWFIADKSGAGERGSRGIIAALGPDGKPSRIVVIYTTGSQATMDERNRQIAEIGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRA

SEQ ID NO: 107591 - protein, 57 aa, Glycine max
  Coding DNA Sequence Number=SeqID_15906
EKKESHEDSTSGSFNLFSVSLTFGNSIGAVGGITEGISGNRYRSCYRRLKTRESAQR

SEQ ID NO: 107592 - protein, 58 aa, Glycine max
  Coding DNA Sequence Number=SeqID_15907
MELTDCAKTPPFDFRCVSGLTYCATKGAKYLEMANQRLHVIKLSLQYCFLLRIKHNSL

SEQ ID NO: 107593 - protein, 123 aa, Glycine max
  Coding DNA Sequence Number=SeqID_15908
  Gene Ontology: Biological process=transposition, DNA-mediated
  Homolog annotation: Hit_ID=Q1J7G7; Match level="QueryCoverage=24%, HitCoverage=42%, E-value=2e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSIGSLLDRVASQSSNVGKQA

SEQ ID NO: 107594 - protein, 170 aa, Glycine max
  Coding DNA Sequence Number=SeqID_15909
  Homolog annotation: Hit_ID=Q6UUU1; Match level="QueryCoverage=35%, HitCoverage=40%, E-value=1e-18, Identity=78%"; Hit description =Putative uncharacterized protein
MLSQGRFEWDEGCKMVVATDLAWDEYIKVYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107595 - protein, 45 aa, Glycine max
  Coding DNA Sequence Number=SeqID_15910
MGLSGLKEHSNPVTPKAYTPKSPSGPLPPDSGPTPKIILAHRHCS

SEQ ID NO: 107596 - protein, 239 aa, Glycine max
  Coding DNA Sequence Number=SeqID_15911
  Homolog annotation: Hit_ID=Q84VH5; Match level="QueryCoverage=100%, HitCoverage=35%, E-value=1e-71, Identity=63%"; Hit description =Envelope-like protein
  Subcellular localization annotation: CTP_CleavageSite=36; ConfidenceScore=5.07e-01
MATSPKDTAAPGSPSVPSSPHQGQPEFNIQPIQMIPGSAPVPEKLVPKRQQGVKISENPSLATSPREVDPEMDKKIRSIVSNILKNASVPDVDKDVPTSSTPNVSVPDVDKDVPTSSAPNAEALPSPSEEESTEEEDQASEETPAPRAPEPAPGDLIDLEEVESDEEPIANKLAPGIAERLQSRKGKTPIKRSGRIKTMAQKKSTPITPTTSRRSKVAIPSKKRKEISSSDSDDDVELD

SEQ ID NO: 107597 - protein, 56 aa, Glycine max
  Coding DNA Sequence Number=SeqID_15912
MFPEEASSGRLPEDNGILPEEASSGSTEGGRSGMTTSGRRSSGSSFRKNFFRNWAS

SEQ ID NO: 107598 - protein, 310 aa, Glycine max
  Coding DNA Sequence Number=SeqID_15913
  Homolog annotation: Hit_ID=UPI00016621D1; Match level="QueryCoverage =40%, HitCoverage=35%, E-value=1e-07, Identity=31%"; Hit description =UPI00016621D1 related cluster
MSFRGLHVLALRGLHPLAFRGLHALAFRGLLVLTFRGLPVLTFRGLHAFSFRGLHVLAFKGLHVLAFKGLHVFAFKRLHALAFKGGLDALAFRGLNTLAFRGLHVLAFTGLHVLTFRGLHICAFRGLKHHQREAIVQPPCILGQDFTHATTKRRVQIMRTNMTTLTQIWMTLLLSNILPSHHNADLPLRKYQLGSRPQDTQWTRRSPTGPWGFQLWLQAFVSPTGDRVRETPSGPGEVQQGLGVSSSDYGPLLVLRSARRPQQGAVQDTTTAWGWPTAGNRRTAATSRVQRMEHFLRPVADQQATKSKAK

SEQ ID NO: 107599 - protein, 194 aa, Glycine max
  Coding DNA Sequence Number=SeqID_15914
MTMKGQDIYSSQDDAITSPSSSESEETKMEESSEEIYPQEEGQPLMVKEECKEVSVPSKRLAKKEIHFAIKTNIKETSPLRQPPHLLLCKKTLISIATPLRLEIIPQVNELLDRGLVRITRHQIPMIGSMMNVLSGATFFCKITHASNIFMIHIHRDSLGVEEKIPVFQEPLDLRSNPFQGGRDDAVLPPKGIG

SEQ ID NO: 107600 - protein, 151 aa, Glycine max
  Coding DNA Sequence Number=SeqID_15915
  Homolog annotation: Hit_ID=Q6L477; Match level="QueryCoverage=65%, HitCoverage=15%, E-value=1e-09, Identity=29%"; Hit description =Putative uncharacterized protein OSJNBa0009L15.8
  Subcellular localization annotation: CTP_CleavageSite=36; ConfidenceScore=5.63e-01
MSLLIISTPGEDHGFSFYSFSTSSSFSSSAMKRTRKASRLRSLSTRPPGAERPVVDITYENWEKVPTAQKDLIWEDIQAEFEIPQASDSRTKKKLLQTVGERWSQFKSDLTRKWALAADKDSVDDTVYEKYSISKQKWAQFCQTRRDPSWE

SEQ ID NO: 107601 - protein, 41 aa, Glycine max
  Coding DNA Sequence Number=SeqID_15916
MNDSGILMLCMANVIMRLRCPKKPHFLVSHALEENARIMHE

SEQ ID NO: 107602 - protein, 47 aa, Glycine max
  Coding DNA Sequence Number=SeqID_15917
  Subcellular localization annotation: CTP_CleavageSite=37; ConfidenceScore=5.10e-01
MTCGDTLWLSAPFVNQRQVLLSSSRDIQVRQRARFFSARQGRSSSIA

SEQ ID NO: 107603 - protein, 274 aa, Glycine max
  Coding DNA Sequence Number=SeqID_15918
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKSWPRASRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMDFFLAHRGANDTIIIQVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107604 - protein, 171 aa, Glycine max
  Coding DNA Sequence Number=SeqID_15919
  Subcellular localization annotation: CTP_CleavageSite=53; ConfidenceScore=5.05e-01
MDDVAIQQHSAQQAQCQSPPTDVSVGIAPTRHPVDPKKSNRALGFPALVTGLCQSYRMPVPPARSCHRDIGITPTKTPSGPGEVQQGPGGSRPQDTQWTRRSPTGSWSFQALITGLYQFYGVLVAPSKIIRPPTNRVFIKKYCVPRQLQGETPQQPGDGPAVDNRRTAAHL

SEQ ID NO: 107605 - protein, 304 aa, Glycine max
  Coding DNA Sequence Number=SeqID_15920
  Homolog annotation: Hit_ID=A1FXH4; Match level="QueryCoverage=72%, HitCoverage=46%, E-value=3e-19, Identity=34%"; Hit description =Putative uncharacterized protein precursor
GQRLAIAAGGSEPDAVCLAVDAASGGQRAGLCGLRRRVCGDGAAVAAGGGRGEAVCAGLGGRRGGAGNRAGVASRRRRSGASVDVQPGEGLADRHHFQRVDVDARRQRRDPEHRLGDVFRRQRIGAFVGFVDLAVIALEAHVGEFGAAHQARLDIGHADARAVQIGAQPQAELFDERLGGAVHVAAGVRPVGGGGADVDHMADVALDHGRQQRARHVHQPLGVGVDHGFPVIGVGLVRRLQPQRQPGVVHQHVNLAQLGRQCFNRLLNGGALFETLKAAPGGDHLMAFTDKTACDCLAETGGGA

SEQ ID NO: 107606 - protein, 19 aa, Glycine max
  Coding DNA Sequence Number=SeqID_15921
VHSKFGEAFAASNPMVLLG

SEQ ID NO: 107607 - protein, 167 aa, Glycine max
  Coding DNA Sequence Number=SeqID_15922
  Homolog annotation: Hit_ID=Q9KHC4; Match level="QueryCoverage=26%, HitCoverage=9%, E-value=1e-07, Identity=66%"; Hit description=SocE
DAGSRQARQGASAGVGGCRGWLNYAASEQIVLRVHHMRAIGAGLFAITPAGERGMCCKAIKLGVLIKKRQSFTFSVIAKKLNKFGIFFIMLYKGVAIPSSSIMKIGKISVFFFKFLGRETCRASCINESANARGEAVCVLGALPLPRSLTRCARSFGCGERYQLTQR

SEQ ID NO: 107608 - protein, 224 aa, Glycine max
  Coding DNA Sequence Number=SeqID_15923
  Homolog annotation: Hit_ID=A4PP05; Match level="QueryCoverage=41%, HitCoverage=24%, E-value=1e-11, Identity=38%"; Hit description=IMP dehydrogenase/GMP reductase, putative
GFTWGAPALVHMYNHLNDASQASTRQLGGYITLLQGWIYEHFPIVHTSVIHYAYDEGSPRACRWLTGKAHITGIKGAPYRRRLDALSVTDMCWMPYAGSSTVWLPLNGPSAAGELCVVPEQVAADYMEWFFRILHPFVTRTEETAAPRHPPPLHHKEFVKPPIPEVSVATDLPTHSVVHCVGCQGMAQDLGAIVEDLERVINLRMVTEGTDLHDIMTRCLRRAR

SEQ ID NO: 107609 - protein, 176 aa, Glycine max
  Coding DNA Sequence Number=SeqID_15924
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=29%, HitCoverage=50%, E-value=6e-24, Identity=100%"; Hit description=LacZ protein
MRKEKIPHQAPFAIQAAQLLGRAIGAGLFAITPAGERGMCCKAIKLGNARVFPVTTFPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107610 - protein, 159 aa, Glycine max
  Coding DNA Sequence Number=SeqID_15925
  Homolog annotation: Hit_ID=A0ST23; Match level="QueryCoverage=28%, HitCoverage=91%, E-value=1e-11, Identity=73%"; Hit description =Putative reverse transcriptase
DAGSRQARQGASAGVGGCRGWLNYAASEQIVLRVHHMRAIGAGLFAITPAGERGMCCKAIKLGNARGESLKNTITWKVGCGDKFKFWEDSWMEGEIMGGNGILDGGGHYLTMKGTELEFVIMVIAVSFGKPVVPAALMNRPTRGERRFAYWALFRFLAH

SEQ ID NO: 107611 - protein, 53 aa, Glycine max
  Coding DNA Sequence Number=SeqID_15926
MKNLVERLGVHGGTSLTMGRSVRVTLFCENAPTIWDQHRLKEALKPGVFTPKA

SEQ ID NO: 107612 - protein, 103 aa, Glycine max
  Coding DNA Sequence Number=SeqID_15927
  Gene Ontology: Mol. function=structural molecule activity; Cellular component=flagellin-based flagellum; Biological process=ciliary or flagellar motility
  Homolog annotation: Hit_ID=A4WBW7; Match level="QueryCoverage=100%, HitCoverage=99%, E-value=3e-43, Identity=88%"; Hit description =Flagellar hook-basal body complex protein fliE
  Pfam annotation: Domain name=FliE; Domain location=4-103; Score =141.1; E_value=3e-39; Accession=PF02049.9; Description=Flagellar hook-basal body complex protein FliE
MAIQGIEGVISQLQATAMTARNQNVAEQQPTISFAGQLHAALDRISDTQTAARTQAEKFTLGEPGVALNDVMADLQKATVSLQMGIQVRNKLVSAYQEVMGMQ

SEQ ID NO: 107613 - protein, 179 aa, Glycine max
  Coding DNA Sequence Number=SeqID_15928
MPPTRHPLDPDKSNRSLRFPALITSLCQSFGVPVTPSKVIRPPITRAFIEKYCTPRQAQGDAPQAADAPPPPHQANPAGSLDMERYLQHLVRQQAANHRGQVQIHECLYQLSLSQQGQSFIPFGCPTPDQFRAEVAWPGDWPEAQAREAPAKAIGNAEEARMDEEMTDLFDFLGGSGAT

SEQ ID NO: 107614 - protein, 61 aa, Glycine max
  Coding DNA Sequence Number=SeqID_15929
  Subcellular localization annotation: CTP_CleavageSite=24; ConfidenceScore=5.25e-01
ARLTGAFSKGGKMRGVATNVLAPLTSTKSGAFAPTYPHLERKPDLRSSFLRVNQAILFTMK

SEQ ID NO: 107615 - protein, 278 aa, Glycine max
  Coding DNA Sequence Number=SeqID_15930
  Gene Ontology: Biological process=transposition, DNA-mediated
  Homolog annotation: Hit_ID=Q1J7G7; Match level="QueryCoverage=14%, HitCoverage=55%, E-value=9e-15, Identity=97%"; Hit description =Transposase
MVKVGTSYVPINVSFSPKVGPGLPGINRDTQDLFILRSDLPSQVFIRAQSASGDAAQLTDLVYDGVFEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIGLSYAVVSIMGPQSSGGARYQLLFPLVRVNFELGVIMVIAVSFGKPVVPAALMNRPTRGERRFAYWALAECILAYYVGTDEGVSEVLHVAGEKRLH

SEQ ID NO: 107616 - protein, 146 aa, Glycine max
  Coding DNA Sequence Number=SeqID_15931
MDWLPSLRITKGVEVETPEEDEEDELRVFLRSKRSLSQRLSETETNMLAIINKYQEELNLAMAHEHKVADEYARVYAEKEARGRVIDSLHQEETMWMVCSYFERESRASPIAGKGQSYGRHLLRPQGDPRAPPLLSAHDRLDGPYN

SEQ ID NO: 107617 - protein, 136 aa, Glycine max
  Coding DNA Sequence Number=SeqID_15932
  Subcellular localization annotation: CTP_CleavageSite=58; ConfidenceScore=5.55e-01
MVKVGTSYVPINVSFSPKVGPGLPGAPVASVFYQLSLPVQLLTGVVRNGKKHRRTSALASVAVTLRVTTTPAALNAPLQGASHSPFRLRNCWEGRSVRASSLLRQLAKGGCAARRLSWVTPGFSQSRRCKTTASEL

SEQ ID NO: 107618 - protein, 47 aa, Glycine max
  Coding DNA Sequence Number=SeqID_15933
MFLDGEKKSHEDNTSGGFNPFSVSLTFGNSIRAVGGKTGGISGDRDP

SEQ ID NO: 107619 - protein, 144 aa, Glycine max
  Coding DNA Sequence Number=SeqID_15934
  Gene Ontology: Mol. function=copper ion binding; Cellular component =mitochondrial inner membrane; Biological process=respiratory chain complex IV assembly
  Homolog annotation: Hit_ID=Q8VYP0; Match level="QueryCoverage=76%, HitCoverage=32%, E-value=3e-48, Identity=80%"; Hit description =Putative SCO1 protein
  Pfam annotation: Domain name=SCO1-SenC; Domain location=1-127; Score =57.9; E_value=3.5e-14; Accession=PF02630.5; Description=SCO1SenC
MAVKKEHCNFSIFNFCSCDNVLMVIISMLFWFPAEEKAGIETVPVFISVDPERDTVEQVGEYVKEFHPKLIGLTGSPDEIKNVARAYRVYYMKTAEEDSDYLVDHSIVIYLMSPEMKFVKFFGKNNDVDSLADGVIKEVKQYKK

SEQ ID NO: 107620 - protein, 157 aa, Glycine max
  Coding DNA Sequence Number=SeqID_15935
MEGIGKHDAGCRSSTRGFILDLGKVYAVKWKDVLDSIWHLVDKDENYHNIVYNQDLNQPVIVAGWITLRNFYQLTGNHLVSLHHYGSVTFKVYLTEQKVSCSSLDVPSVMHYFLKDKGWTHLHLEDVAECRLVFNHWRKTLKIEADGNISTDLVVHH

SEQ ID NO: 107621 - protein, 621 aa, Glycine max
  Coding DNA Sequence Number=SeqID_15936
  Gene Ontology: Cellular component=integral to membrane; Biological process=vesicle-mediated transport
  Homolog annotation: Hit_ID=A7QHQ0; Match level="QueryCoverage=96%, HitCoverage=55%, E-value=0.0, Identity=60%"; Hit description =Chromosome chr8 scaffold_99, whole genome shotgun sequence
  Pfam annotation: Domain name=WD40; Domain location=231-269; Score =19.1; E_value=0.017; Accession=PF00400.23; Description=WD domain, G -beta repeat
  Pfam annotation: Domain name=WD40; Domain location=30-68; Score=3.4; E_value=12; Accession=PF00400.23; Description=WD domain, G-beta repeat
  Pfam annotation: Domain name=WD40; Domain location=517-555; Score =7.2; E_value=4.1; Accession=PF00400.23; Description=WD domain, G -beta repeat
  Pfam module annotation: Pfam domain module=WD40::WD40::WD40; Domain location=231-269::30-68::517-555
MFAKRLLHKAVLHHSNHKLQHGGLQGNELDPRIVIHYGIPSTASVLAFDPIQRLLAIGTLDGRLKVIGGDNIEGLLVSPKQLPYKYLEFLQNQGHLVGVLNDNDIQVWNLESRSLVCSLQWEFDITAFSVISGSHFIYVGDQHGLFSVIKFEAEEGQLLKSSYNLSAKFLREAAGFSEPSEQPIIGVLLQPSSFGNRQDITRIVFLGGGKDLQLKDEDGNSSSESGANPPADIVEQNLGDKEITALCWASSTGSILAVGYLDGDILLWNLSSAAPSKGQQTSKNVVKLQLSTEERRLPVIVLQWSNSHKSQSDSAGQLFVYGGDEIGSEEVLTGFQVLTLEWSSGMESVKCTNRADLTLNGSFADLILLPSPGTMGLSSKDELFVLTNPGQLHLYDNDSLSTLTSQPKRTPSVSAVEFPVLVPIADPCLTVAILIRLPSKSNSSKILTEVASAMRTGSRPGSAPSNWPLTGGVPSLSSTAKGAVVERVYFVGYSNGSVLVCDATHAVLSYICYIEGEVNGIKVAGSDAQVTKLDFCSVSLLLAVGNECGLVRIYDLKGHSGGRNFHFVTETKSEVLDAPQGKGPYCSSVFSVLDSPVQALSFANSGTKLAIGFLSGRVGII

SEQ ID NO: 107622 - protein, 432 aa, Glycine max
  Coding DNA Sequence Number=SeqID_15937
  Gene Ontology: Mol. function=methionyl aminopeptidase activity; Cellular component=ribonucleoprotein complex; Biological process =proteolysis
  Homolog annotation: Hit_ID=A0EVX1; Match level="QueryCoverage=100%, HitCoverage=100%, E-value=0.0, Identity=78%"; Hit description=EBP1
  Pfam annotation: Domain name=Peptidase_M24; Domain location=20-313; Score=123.6; E_value=5.9e-34; Accession=PF00557.15; Description =metallopeptidase family M24
MSDDEREEKELDLSSAEVVTKYKTAAEIVNKALKLVISECKPKAKIVDICEKGDSYIREQTGNVYKNVKRKIERGVAFPTCLSINNVVCHFSPLASDEAVLEEGDILKIDMACHIDGFIAVVAHTHVLQEGPVTGRAADVIAAANTAAEVALRLVRPGKKHMRWQLCRGDQYHIGFLFSLLPILELAENNFMVVLIYTNKDVSDAIQKVAAAYDCKIVEGVLSHQMKQFVIDGNKVVLSLSNPDTRVDEAEFEENEVYAIDIVTSTGDGKPKLLDEKQTTIYKRAVDKSYHLKMKASRFIFSEISQKFPIMPFSARALEEKRARLGLVECVNHELLQPYPVLHEKPGDFVAHIKFTVLLMPNGSDRITTHPLQELQPTKTIDDPDIKAWLALGTKTKKKGGGKKKKGKKGEKADESAEAEPMDSTNEATPQE

SEQ ID NO: 107623 - protein, 145 aa, Glycine max
  Coding DNA Sequence Number=SeqID_15938
  Gene Ontology: Mol. function=protein transporter activity; Cellular component=nuclear pore; Biological process=protein import into nucleus, docking
  Homolog annotation: Hit_ID=A7QHN3; Match level="QueryCoverage=88%, HitCoverage=12%, E-value=5e-55, Identity=82%"; Hit description =Chromosome chr8 scaffold_99, whole genome shotgun sequence
  Pfam annotation: Domain name=IBN_N; Domain location=29-104; Score =66.0; E_value=1.2e-16; Accession=PF03810.10; Description=Importin -beta N-terminal domain
MALSASDVAAMYSLLSNSMSADHRLRGPAEDALAQSESRPGFCSCLLEVITAKDLASQTDVRMMATVYFKNSVNRYWRHRRDSSGISNEEKMHLRQKLLMYSREENDQIALMLAVLISKIARIDYPKEWYFLAFISLVFKNIYSV

SEQ ID NO: 107624 - protein, 165 aa, Glycine max
  Coding DNA Sequence Number=SeqID_15939
MKERIERFFSTESLRWILRIPLRLKCSSRCGGSVAGNDGSWWPPVVVGGEGGVEMPNSVNLMCFNFNFSASSARLARCLSLPVLSAPSLLSGYSLTRAKRENGAKRAFKDRKPFLRLQLEKSSKSSRIRLIQSVESRTEAKNRARKPKTSTFKRILGLGVISRFL

SEQ ID NO: 107625 - protein, 113 aa, Glycine max
  Coding DNA Sequence Number=SeqID_15940
MAPSFTSTGCETSIVYSERCSPALNTYASSAPKSLVKVAKITMSAISPVTLAEQSHIQSQAYMHGDIRACMAGATYPQDLPKHQPRVTKGTAEYGFGVLMVAVMWEALSVWWF

SEQ ID NO: 107626 - protein, 70 aa, Glycine max
  Coding DNA Sequence Number=SeqID_15941
MASGTAYPAGGAGWPSMGRLPCGRDSHLRGRCVGSQVYPSNLPNNWYQSRWFKLVTGSDEYASTAGGHKG

SEQ ID NO: 107627 - protein, 164 aa, Glycine max
  Coding DNA Sequence Number=SeqID_15942
MAAPEASVSKQKGISKSSGWGRQLGIAANEAPIKPCQPKEAAEVEGALCEGVEDCFQVLNVVCPRIIVDQYIVEEDCNEFAQEWSEQFVHRGLEGGRRVAEPKGHHAVLIMAGVGAKGYFGDVFFGHPDLMESLAIERAIIHAAAPATVLLLHKEHRRGIRVVT

SEQ ID NO: 107628 - protein, 60 aa, Glycine max
  Coding DNA Sequence Number=SeqID_15943
  Gene Ontology: Mol. function=protein binding; Biological process =protein modification process
  Homolog annotation: Hit_ID=A7QKX5; Match level="QueryCoverage=85%, HitCoverage=19%, E-value=1e-10, Identity=70%"; Hit description =Chromosome chr8 scaffold_115, whole genome shotgun sequence
VSVLEVSVDGGTRVSDKEFLMSTELLMRQLLKLDGIEAEGGEVKLQRKAEVVFMVLELLT

SEQ ID NO: 107629 - protein, 170 aa, Glycine max
  Coding DNA Sequence Number=SeqID_15944
  Gene Ontology: Mol. function=phosphoric monoester hydrolase activity; Cellular component=integral to membrane; Biological process =biological_process
  Homolog annotation: Hit_ID=A7QHP6; Match level="QueryCoverage=99%, HitCoverage=36%, E-value=3e-37, Identity=42%"; Hit description =Chromosome chr8 scaffold_99, whole genome shotgun sequence
MWRRVANLEGGTANFIETEQFLENEEFKFSFLQHGEEGQLSAAYAAEMQNQQHVSLSSFIVLDMNMIIVCTTDYGRYVPFDFHHHYGSSNFDNMKILYDQISEDFEKQRYFLIDRQGNILEEQRGLVRLNYIDSLDRTNVTQRYLAQKSLNIQLQRIEVLTSSECISMFA

SEQ ID NO: 107630 - protein, 81 aa, Glycine max
  Coding DNA Sequence Number=SeqID_15945
  Gene Ontology: Mol. function=DNA-directed RNA polymerase activity; Cellular component=DNA-directed RNA polymerase II, core complex; Biological process=transcription from RNA polymerase II promoter
  Homolog annotation: Hit_ID=A2YRD6; Match level="QueryCoverage=50%, HitCoverage=2%, E-value=4e-13, Identity=82%"; Hit description=DNA -directed RNA polymerase
MHVPESFETRAESNKPVIRINCPRCTFRMQKNHRDTFITKEEVDPDSAQKFLGHTKWLVNYWLLQNAFSIGIGDAIADAFT

SEQ ID NO: 107631 - protein, 99 aa, Glycine max
  Coding DNA Sequence Number=SeqID_15946
MASMCPYVDKVKTKCSQKGRASIVDVRSDGHCGYWEVAALLGIGKGSWPLVHNNLHKELGLWHDECANIFGGYGCFYQIKQSLLIDHVSMVGVLLRRDD

SEQ ID NO: 107632 - protein, 152 aa, Glycine max
  Coding DNA Sequence Number=SeqID_15947
  Homolog annotation: Hit_ID=A7QKV0; Match level="QueryCoverage=69%, HitCoverage=91%, E-value=1e-15, Identity=41%"; Hit description =Chromosome chr8 scaffold_115, whole genome shotgun sequence
METWIFYKENWRKNLRKNAAFQHGITYHLSLVNTAIGDEFNDLEQQWISVQEQKKTIQTIEKNKQRTQMVLSMYASVTNIVPNLDEQSKISGCILLMNLLFSVPSSVSSDIVEKDKNAVEKFEYDTSNMTALDICNVLSGKLAILQFSYILV

SEQ ID NO: 107633 - protein, 451 aa, Glycine max
  Coding DNA Sequence Number=SeqID_15948
  Gene Ontology: Mol. function=translation repressor activity; Cellular component=nucleus; Biological process=negative regulation of transcription
  Homolog annotation: Hit_ID=A7P330; Match level="QueryCoverage=63%, HitCoverage=31%, E-value=6e-89, Identity=56%"; Hit description =Chromosome chr1 scaffold_5, whole genome shotgun sequence
  Pfam annotation: Domain name=GCFC; Domain location=96-451; Score =51.2; E_value=2.8e-15; Accession=PF07842.3; Description=GC-rich sequence DNA-binding factor-l
MEFAEDGVDEDARVLGGVAGGDVNDVGLDDDGAGGGAGVKSGDRAVVEEAVVAADHAEADNVALVVEDVEALGADGGGEAGDDVDLAEGPDVAVAEDDVAALDEVLVGLRVVEAPHDGPDGGDRGGDLLDHGGAALLRGHHVGVVPGHRVGNNSGRIVGIKLFYIEELEEQMKKLHEDRASAIFERRTTNNDDEMIEVEAAIKAAMSVLDKKGNNMEAAKSAAQEAFAAVRKQKDLPVKLDEFGRDLNIEKQMQMKVRAEARQRKRSQAFNSNKLAYMELDDPKIEGESNTDESDSESQAYQSQRDLVQRAADEIFSEASEEYGQLSFVKRRMEEWKREYSSSYKDAYMSLNLPLVFSPYVRLELLRWDPLHKGLDFQEMKWYKLLFTYGLPEDGKDFVQDDGDADLELVPNLVAKVALPILHYEISHCWDMLGQQETVNAIAATKLIVQQ

SEQ ID NO: 107634 - protein, 52 aa, Glycine max
  Coding DNA Sequence Number=SeqID_15949
  Homolog annotation: Hit_ID=Q949R9; Match level="QueryCoverage=94%, HitCoverage=43%, E-value=1e-17, Identity=81%"; Hit description =Putative uncharacterized protein At5g20090
  Pfam annotation: Domain name=UPF0041; Domain location=1-51; Score= -33.7; E_value=0.03; Accession=PF03650.4; Description=Uncharacterised protein family (UPF0041)
MASNFQAFLNNPVGPKTTHFWGPIANWGFVAAGLMDMMKKPPKMISGNMTAG

SEQ ID NO: 107635 - protein, 433 aa, Glycine max
  Coding DNA Sequence Number=SeqID_15950
  Gene Ontology: Biological process=intracellular signaling cascade
  Homolog annotation: Hit_ID=A7QFE6; Match level="QueryCoverage=95%, HitCoverage=95%, E-value=1e-177, Identity=70%"; Hit description =Chromosome chr8 scaffold_88, whole genome shotgun sequence
  Pfam annotation: Domain name=DUF231; Domain location=257-430; Score =282.1; E_value=1.1e-81; Accession=PF03005.6; Description=Arabidopsis proteins of unknown function
MKLQKGGRDGAAGRGTMEEAKIKMAKTYQIVLAGSSWGVRNTFHSLVAILTTLVVITTIYLRQDGGHVSPKINASSSNSSSSSKCDLFSGKWVFDNESYPLYKEKECTFMSDQLACEKFGRKDLSYQNWRWQPHHCNLPRFNATALLERLRNRRLVFVGDSLNRGQWASMVCLVDSILPKTLKSMHSTANGSLNIFKAKDYNATIEHYWSPLLVESNSDDPVNHRVPERTVRVKAIEKHARYWTDADFLVFNTYLWWRRPVMNVLWGSFGDPDGVYKGVEMLRVYEMALRTWSDWLEVHVNRNKTHLFFVSMSPTHERAEEWRAAKGNNCYSETDMIAEEGYWGKGSDPKMMHVVENVIDDLKARGLNVQMLNITQLSEYRKEGHPSIYRKQWDALTQEQIANPNSYADCIHWCLPGVPDVWNELLYAYIFHQ

SEQ ID NO: 107636 - protein, 616 aa, Glycine max
  Coding DNA Sequence Number=SeqID_15951
  Gene Ontology: Mol. function=transcription factor activity; Cellular component=nucleus; Biological process=regulation of transcription, DNA-dependent
  Homolog annotation: Hit_ID=Q8GZF2; Match level="QueryCoverage=20%, HitCoverage=39%, E-value=1e-28, Identity=54%"; Hit description =Dehydration responsive element binding protein
  Pfam annotation: Domain name=AP2; Domain location=74-132; Score=74.0; E_value=4.8e-19; Accession=PF00847.11; Description=AP2 domain
MKTNNNVSGERKSRKRRNGGSDYVEDTLEKWKEYNRQQQLGSRENGVEVIHKAPAKGSRKGCMRGKGGPQNSDCKFRGVRQRIWGKWVAEIREPINGKLVGEKANRLWLGTFSTALEAALAYDEAAKALYGPCARLNFSESIDSNGSSSSSGSDKKSPSGFSENGCDVAKAEELEVNRHRCHEEKPRFSKVGVFEETEEKPILSGGCVADDSIEELKEITTGFEQCQTSEECMATTLKNVKSEVPGESEEMERELEEVVKNSGIGGEVNHLRKEPMDIAMNARGNYCSSPGSSDAATEHEILLKSEETRGESVETLNSCELSCSNHCLGFMHNNMLPDTNLRPNPEASIAKKHTEEVISEILGLCQGKCLKISHGQSPNEQFRRSEHFDEMKTRLKGLECKLRAHSIHYKNQAPIVGDSNHPSMQGIHLFGGGTVGPIESMSQVEALNNINTNRNSLPGFSSGHGRKLCDLSQQLHKLGGYLPEHWNSVQFPDLEVGHDYSFLNPDYDFGLYEEQKPNSAQANTFKQKDFSLELVLMTWPLRPTSAQANTFKQKDFSLELVLMTWPLRPTSAQANTFKQKDFSLELVLITWPLRPTSAQAECLTLKVNPSQLGSGI

SEQ ID NO: 107637 - protein, 72 aa, Glycine max
  Coding DNA Sequence Number=SeqID_15952
MAEEFVKGSVHQNGVAVITLDRPKAWYLIFFQPSFSLRAFSIMAEEFVEGSVHQNNVAVMTLDRPKGCIRCS

SEQ ID NO: 107638 - protein, 35 aa, Glycine max
  Coding DNA Sequence Number=SeqID_15953
MAGGANFVQRVLSYVVNEVVINGLANRQNLVISTA

SEQ ID NO: 107639 - protein, 430 aa, Glycine max
  Coding DNA Sequence Number=SeqID_15954
  Homolog annotation: Hit_ID=A5APQ3; Match level="QueryCoverage=32%, HitCoverage=8%, E-value=3e-15, Identity=39%"; Hit description =Putative uncharacterized protein
  Pfam annotation: Domain name=DUF1723; Domain location=110-159; Score =67.3; E_value=5e-17; Accession=PF08330.1; Description=Protein of unknown function (DUF1723)
MVRTRGLGRGLGTGRGRDMSQDAHKPEVPRRRRPTASDVPHVSDATPEMTSIVDAVDAEGVASDGSLGSLAADEGFPGGPRDPSVLTAPEIEGMIAATELSPLIRCSIITTDPGLISAFVERWHRETNTFHLPVGELTITLDDISSLLHLPITKALHAFEPLVTFDTVRLLTELLEVTLKEATAETRQAGGPHAFRDLAQAGGFSWGVAALVHLYEHLNEASQTPTRQMVGYITLLQCWIYKHFLAVHQYVVDDAYAKASPRASRWLTGKAHMTGIKGAPYRARELRWGQIVVYVRLERTVPSPPVRDSLTGPDIDDRWLHFSDHLVPTGEICVVPGQDGAEPRHPPTPHDEEFVEPPIPEVPVASDLPTHSVVNCQGCQAFVEDLERVINLRMVTEGTDLYDIMTHCLRIARGDAANGSLRSRQRRRID

SEQ ID NO: 107640 - protein, 32 aa, Glycine max
  Coding DNA Sequence Number=SeqID_15955
MGKGEWHFRPFTRIAGCPNKKCWCPKQYPTVK

SEQ ID NO: 107641 - protein, 87 aa, Glycine max
  Coding DNA Sequence Number=SeqID_15956
  Homolog annotation: Hit_ID=A7QFF7; Match level="QueryCoverage=80%, HitCoverage=65%, E-value=3e-14, Identity=52%"; Hit description =Chromosome chr8 scaffold_88, whole genome shotgun sequence
MPVLTLSTNVSLNDLDASSILSQVISTVASIMRTPEPPAAYGELVSMGALNPELNKKLSAGIACVLETKLLGYNCALNGSIMVVESK

SEQ ID NO: 107642 - protein, 200 aa, Glycine max
  Coding DNA Sequence Number=SeqID_15957
MSKNWVLKKHNKTFLDWFKDIIFADENASKTLRKLADVPKRNATPMIVRTDDVLSREDYEYLEKKLMDEKRKKKQEEAAQSGSTEVMIDPPSPIRRHVKWKMARTKKIGHMTSEVTKEIAERIDSLEEHASQGSFVPHGHQDVLTAAIGQPEHAGHVCAVGVGVTIKQYFGPAQRTARSTSSIAPEELVQLTQQIKDQLE

SEQ ID NO: 107643 - protein, 129 aa, Glycine max
  Coding DNA Sequence Number=SeqID_15958
  Gene Ontology: Mol. function=nucleoside-triphosphatase activity; Cellular component=intracellular; Biological process=regulation of transcription, DNA-dependent
  Homolog annotation: Hit_ID=A2XDW7; Match level="QueryCoverage=51%, HitCoverage=3%, E-value=2e-16, Identity=67%"; Hit description =Putative uncharacterized protein
MPLAGLNCPVKTRATEREPHAAEATRELKPENTLGMRGKPVSFSIVYLQLFEWWWWRFRNFWPELVPNLQSAIPMIVTTPEKWDAITRKSSDMSLSMVVKLLIIDEVHLLNDDKALVARTLRQTLAYDS

SEQ ID NO: 107644 - protein, 67 aa, Glycine max
  Coding DNA Sequence Number=SeqID_15959
MAGEWRRRVERRRHFKEKMSQEEAHHHRKPWIRAWSPLIQDQVQDSPLSVLRLRHVKHEGHAQSVTI

SEQ ID NO: 107645 - protein, 186 aa, Glycine max
  Coding DNA Sequence Number=SeqID_15960
  Homolog annotation: Hit_ID=A7QFF9; Match level="QueryCoverage=33%, HitCoverage=56%, E-value=6e-23, Identity=85%"; Hit description =Chromosome chr8 scaffold_88, whole genome shotgun sequence
MVILKSSVPISFEGNKEPAAYAEIVSMGGINTEVKRKLIATIGTILQSNLSIPRTRFFLKVFDVRGRLLVCNRNPISASSGLRPRCHPLWMVVLLEDFLGCGGDKGYCYIDSTQAIFVSFKSSPNTTINNNNHFTWRRSPTLESFLAPVDLSDFALVHTLISVANEIVSCFLKCVDELASAPMRPK

SEQ ID NO: 107646 - protein, 45 aa, Glycine max
  Coding DNA Sequence Number=SeqID_15961
MRCTAKKPYSRSIVGAWKEIKKRIKKTKDEKKTKKPNTDMRIFVC

SEQ ID NO: 107647 - protein, 375 aa, Glycine max
  Coding DNA Sequence Number=SeqID_15962
  Gene Ontology: Mol. function=DNA binding
  Homolog annotation: Hit_ID=A7QFG1; Match level="QueryCoverage=84%, HitCoverage=46%, E-value=2e-72, Identity=46%"; Hit description =Chromosome chr8 scaffold_88, whole genome shotgun sequence
  Subcellular localization annotation: CTP_CleavageSite=46; ConfidenceScore=5.60e-01
MVPLVGARKKTQTSQFSVTQTFSPNSSCGRNLRKNQLGGIIFGCKNATMKECLSKQLFGLPAHHFCYVKNIDPGLPLFLFNYTDRKLHGIFEAASSGRMFIDPYGWTTDGSERTQYPAQVQICVRLKCHPLPEDKFKEVIADNYYTHNRFYFELDHAQTSKLISLLSAGAIASDNSAPQNTQKWITVSRPLASNETLREGETSKMLELETEHSTHSSTRSYWIENDFSFDGYIRPLDTNEVEKEVNEDEQNSIFMKLKELTLDSESQDLSLANNANDTPGMNNTEEGYMEALDGLDEKEQTSNPPFDYQYNIAQCILVGARGQRIDKFPENTNGEELLPGAEAVPSIGIKAFHHVLQLQTSGASGDTVIAVFASD

SEQ ID NO: 107648 - protein, 141 aa, Glycine max
  Coding DNA Sequence Number=SeqID_15963
  Homolog annotation: Hit_ID=A5BP71; Match level="QueryCoverage=53%, HitCoverage=19%, E-value=6e-10, Identity=44%"; Hit description =Putative uncharacterized protein
  Pfam annotation: Domain name=zf-CCHC; Domain location=114-131; Score =14.1; E_value=0.011; Accession=PF00098.14; Description=Zinc knuckle
MKDKYIVQSLLKNLEKIKNKLVRTSFACMTSTPQACGYVSLNYYQYIDVVYTNEHILKAYSAHWWPLGNEAAIPPSNDAWTLIPDPTTIRAKGQPKSTRIRNQMDWVEPSEHRQKCSRCGAEGHNKRCCPMQSERGSCSNH

SEQ ID NO: 107649 - protein, 285 aa, Glycine max
  Coding DNA Sequence Number=SeqID_15964
MAQKKLLSKRARKDAAGEGSKRRVQLREGEYTEFQEEVARRQWTQLTGPVVKYDPEIVMEFYANAWPMEEGVRDKRSWVRGEWVPYDDDAINQFLGHPLVLEERQHCEFSERRSHASGFDEEAIGQLDHASKTPSGPEKSNRALGFPALITGLCQFYGVSVTPTKLIWPLINRSFIEKYCMPRQAQQPGQDQQQQLAIDAPPPPLQQPPSLESISAHIFYQYTLHQQHQNPSPYPRPTLEQFRATVAWPEGRPNFQAGVGPTEAPRDEDGAQEVDDMADVMDFFL

SEQ ID NO: 107650 - protein, 60 aa, Glycine max
  Coding DNA Sequence Number=SeqID_15965
MVGSCGNGVGEKNVLVGPAFQRFAVRTSKRIEDISNKAVQKRQELAEQIKDISKNMEVVC

SEQ ID NO: 107651 - protein, 93 aa, Glycine max
  Coding DNA Sequence Number=SeqID_15966
MRGFSGFAARPGELLLQPEVTMLAQASSACPGKLKEKGSKGRESNCATREWNVASMQRCNEQHGPGTMGTQCREELSDSERAKVRITEEEREL

SEQ ID NO: 107652 - protein, 440 aa, Glycine max
  Coding DNA Sequence Number=SeqID_15967
  Gene Ontology: Mol. function=catalytic activity; Cellular component =protein serine/threonine phosphatase complex; Biological process =protein amino acid dephosphorylation
  Homolog annotation: Hit_ID=A5BF43; Match level="QueryCoverage=98%, HitCoverage=96%, E-value=1e-113, Identity=50%"; Hit description =Putative uncharacterized protein
  Pfam annotation: Domain name=PP2C; Domain location=48-357; Score =101.4; E_value=2.8e-27; Accession=PF00481.12; Description=Protein phosphatase 2C
MGGCCSHDVSVRGKVESEMGDREYEYEHENDVSFEQGGALVRLRGSSRFVSMYAQQGQKGVNQDAMTVWEDYTGEKDVIFCGVFDGHGPLGHKVSQFIRDNLPSKLSAAIEISQQKTIKYYDANDAETGSFDDAYDDNNHNMSLASWEGCLLKSFDEMDEYLAQEINTDSYCSGCTAVTLIKQGGQLIVGNLGDSRAVLCTRDRDQLIPVQLTVDLKPDIPSRSWFWLQFPSITSPSSETSRIVNCEGRVFAAEEEPDVYRIWMPDDDCPGLAMSRAFGDFCLKDYGLISVPDVFYRKITPQDEFVVLATDGVWDVLTNSEVINIVASAPRRSIAAKLLVKRAVRAWRYKYPGSKVDDCAAICLFLGEQSVLLNSQSYMSRKSRQRSKHLNRTKSTRNEDNETVYGKIGVELERANSLSKLPRLARGMSKRQSSKYYTPS

SEQ ID NO: 107653 - protein, 255 aa, Glycine max
  Coding DNA Sequence Number=SeqID_15968
  Homolog annotation: Hit_ID=A6XNC7; Match level="QueryCoverage=24%, HitCoverage=12%, E-value=3e-08, Identity=50%"; Hit description =(Iso)flavonoid glycosyltransferase
MEEQQMKETKYTFVDWTLSVAKGGRSQEGEGEGRARGREKEAMTVKEGKEEEESRNVEEGGHGRGRRKKETVGGRKEKEEGGGEEKNKVRHYAKHGACVTIITTPTNALTFQKAIDSDFSCRYHIKTQVDLHPDCLVTDVLYPWTVESAEKLGIARLYFYSSSYFASCATHFIRKHKPRESDYEQLYHSTKAVKCWSVGPVSASANKSDEEKANRGHKEELALESEWLNWLNSKQIESVLYEFWKLHQALSFSDC

SEQ ID NO: 107654 - protein, 137 aa, Glycine max
  Coding DNA Sequence Number=SeqID_15969
MESSSGRESTGRVPLSGVVRCTVMAMVFPEMSTSMKLSLGWDNTHVGDIYASKGISRAFGDFRVLSKIGVLPRYSALFKSQAFVVSVTDADVIGLGMKGRIWLTKVSRVRSSVWKVGGKRPGYNASDSESDELEEDS

SEQ ID NO: 107655 - protein, 115 aa, Glycine max
  Coding DNA Sequence Number=SeqID_15970
  Homolog annotation: Hit_ID=A5BP71; Match level="QueryCoverage=65%, HitCoverage=19%, E-value=8e-10, Identity=42%"; Hit description =Putative uncharacterized protein
MVIIVNAEACGYVSMNYYQYINVVYTNEHILKAYSAQWWPLGNEAAIPPSDDAWTLIPDPTTIRAKGRPKSTRIRNEMDWLEPSEHRQKCSRCGAKWHNRRRCPMQSDHGSCSFN

SEQ ID NO: 107656 - protein, 613 aa, Glycine max
  Coding DNA Sequence Number=SeqID_15971
  Gene Ontology: Mol. function=D-alanine-D-alanine ligase activity; Cellular component=cell wall; Biological process=peptidoglycan biosynthetic process
  Homolog annotation: Hit_ID=A7QFI6; Match level="QueryCoverage=90%, HitCoverage=64%, E-value=0.0, Identity=62%"; Hit description =Chromosome chr8 scaffold_88, whole genome shotgun sequence
  Pfam annotation: Domain name=Dala_Dala_lig_C; Domain location=394 -540; Score=-109.8; E_value=0.018; Accession=PF07478.4; Description=D- ala D-ala ligase C-terminus
  Pfam annotation: Domain name=Dala_Dala_lig_N; Domain location=224 -306; Score=-0.5; E_value=3.4e-07; Accession=PF01820.12; Description =D-ala D-ala ligase N-terminus
  Pfam module annotation: Pfam domain module=Dala_Dala_lig_C::Dala_Dala_ lig_N; Domain location=394-540::224-306
VELQFRGANDVKENDAIFNYRRKYLPTQQVAYHTPPRFPLDVIENIRKGASLIFQQLCLQDFARIDGWFLPNSSSKLSPSPESEFGRTESGTIIFTDINLVGFSHTNILRSIIHHACLRFPNLASVSGISGNTSERQVSLMSGTNVWLNLLAFHDLEVTPCLLSPTSECASSVDIGKKADDVMNRTVLSLPYSLVLRHTTEEVLDACMEAIEPERAAITSDLRKKVMNDLMEGLKDHNWFTGFDIADDLPAKFSLRQWIKLAKEVQATIFIAVHGGIGEDGTLQSLLDAEGVPYTGPGAMASKICMDKVATSVAIKHEATVPNIMCQTSKRWMLNWGRKTMKIRGIMFYNLLILFSFSCSEDLAIYVRALEDCLLRIPPNSLSKAHGMIEMPNPPPEYLIFEPFIETDEIIVTSKFEDATGHGLTWKGHSRWVEITVGVIGKRGSMHSLSPSVTVKESGDILSLEEKFQGGTGINLTPPPLSIMSENALKRCKQHIELIANTLQLEGFSRIDAFVNVDSGEVNTVPGMTPSTVLIHQALVEQPPLYPHQFFRKLLDLASESLYLLKLTLKKDSKCVFNKAGEPLKGSEVVWQEAHVRGSSTIDEIRLNSHFSP

SEQ ID NO: 107657 - protein, 228 aa, Glycine max
  Coding DNA Sequence Number=SeqID_15972
  Gene Ontology: Mol. function=D-alanine-D-alanine ligase activity; Cellular component=cell wall; Biological process=peptidoglycan biosynthetic process
  Homolog annotation: Hit_ID=A7QFI6; Match level="QueryCoverage=87%, HitCoverage=21%, E-value=1e-77, Identity=72%"; Hit description =Chromosome chr8 scaffold_88, whole genome shotgun sequence
  Pfam annotation: Domain name=Dala_Dala_lig_N; Domain location=1-75; Score=-27.7; E_value=0.00023; Accession=PF01820.12; Description=D -ala D-ala ligase N-terminus
MVYSNTPADFDFKLESLAQSFQTLSDLAKHLATAVDIVFPVIHGQFGEDGGIQELLEKYNVPFVGTGSKECCQAFDKHKASLELRKHGFITVPSFLVQGYETKKSELSEWFEKHQLDPDLGKVVVKPTRGGSSIGVRVAYGVNDSLVKANEIMSEGIDNKVLIEIYLEGGSEFTAIVLDVGSASDSFPVVLLPTERRLSIYIETEESISCCLIQWNVHDEKLRMKKGT

SEQ ID NO: 107658 - protein, 195 aa, Glycine max
  Coding DNA Sequence Number=SeqID_15973
MFPTDFQTHPKPFSRHCIYLNALFFYNFHIPITQNTPYSVLRPPLGDEAAVGGASGDGGLEGVVAELAEENGVGKVGHAGGGITGIVAAAAAGDGSFGVTAVRKIGVVVATAVVNSGDGGGGGGIVEVAVDGGNDKNGDGDDDDDGYGVGIDDGRDGDDDEGGRIEQWRQALSLPEGKTETSDTKLRFCEAKREK

SEQ ID NO: 107659 - protein, 447 aa, Glycine max
  Coding DNA Sequence Number=SeqID_15974
  Gene Ontology: Mol. function=phosphoprotein phosphatase activity
  Homolog annotation: Hit_ID=A7UQU7; Match level="QueryCoverage=69%, HitCoverage=64%, E-value=4e-37, Identity=31%"; Hit description=IMP dehydrogenase/GMP reductase, putative
  Pfam annotation: Domain name=DUF1723; Domain location=140-189; Score =54.9; E_value=2.8e-13; Accession=PF08330.1; Description=Protein of unknown function (DUF1723)
MVRTRGLGHALGHVTGRVAMIAAHDEPVVPAPDIEADVFPDDPMAPADVENIVADIPADTGAEAAEDDHEGFPGGPSDPSVLTQYMDHVACSVWTGEERPELKLSSHGRKVHSLGRHVPAIEGPIAGTGLSPLIACSVDTGDRGLLSSFVERWHWETSSFHLPVGELTITLEDVSSLLHLPMVGDLHAFQPLHVDDARRCQAGHCTAAARAYLLHLLDCTLFTNKSATNVHVVYLEALRDLSMTGRYAWGVAALPIAWRLHHTAAVADSTVDQEYDEDSPRACRWIATKKTVKSIRTSAYRERLDQLWITDVYWIPYREHQSVRDFHVISCYSGLLRWGPVAVYYRPERVVRQFRYTQIIPAPPVCAVPGQCASGYMDWFFRISHPFMTPGHASDPLPDGHAPQPRVTDIPHVPEPGASSTSVEEPRHAVVGASSESRGGHTKFIDT

SEQ ID NO: 107660 - protein, 125 aa, Glycine max
  Coding DNA Sequence Number=SeqID_15975
MSGKGLEHVRKSLSQYQLLRACLEIKWDTNWERGFSVYVIFKELKNFDILTFRNIGKVSTPLKRPRLRLRGGGGSSRSTSASSTLGKHNVRVVAGRSSQRDEVVQATAGMLGFWRVGEGVYCESI

SEQ ID NO: 107661 - protein, 215 aa, Glycine max
  Coding DNA Sequence Number=SeqID_15976
  Subcellular localization annotation: CTP_CleavageSite=40; ConfidenceScore=5.36e-01
MSVFNDTVLPPRVVTDVERGCTESSMSPSTTTTSKLSYARMAVRGASFSFVFIAARGSRIGPEDEIFNVCVDIDESLDFEVKVNVKRGVVKILIWRCILVEPRKQQFGFRSWPRQHPRESYITRMPKLRVLCHLNHVFCTTTSADIIRAWNLRVDVVEDGANDEYGEMELVHGRDVGGAMETTRSLWMLKLEMAEVGVVVDLEGFYVRVSKSSVK

SEQ ID NO: 107662 - protein, 49 aa, Glycine max
  Coding DNA Sequence Number=SeqID_15977
MGLQDYLQDPYRPGSIPNGLWQSLPLTGSIRGKEEVAILGVGRDEIECL

SEQ ID NO: 107663 - protein, 260 aa, Glycine max
  Coding DNA Sequence Number=SeqID_15978
MEENKDKRSLKTENRVEGWCGGLCSLWKVGMEWWVRPWDQTDEERDVEEEGSNEGWPCGKVKWLDGEVEEMDGGDWLNVGWLVKGLRVLEREKCHEQGGIFQVKVRDKGTLEERYHHTGKVERYEPLSRCETLLKAVICKQQLQSYRGLGRGQRSVDSGHCGGSSNVIRQSVGRMAVQSFKQRHSDGRVKGGVEPIFCLVEIIEPKARMLTDKASKAMLNCNFVPCILNNSFQKALRKRGSLSEVIVIGRPCRWHLLVEK

SEQ ID NO: 107664 - protein, 114 aa, Glycine max
  Coding DNA Sequence Number=SeqID_15979
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=74%, HitCoverage=72%, E-value=3e-24, Identity=69%"; Hit description=LacZ protein
MLLDRDKPHACVPGKLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVV

SEQ ID NO: 107665 - protein, 142 aa, Glycine max
  Coding DNA Sequence Number=SeqID_15980
  Gene Ontology: Mol. function=lipid binding; Cellular component =cellular_component; Biological process=lipid transport
  Homolog annotation: Hit_ID=Q1KL62; Match level="QueryCoverage=77%, HitCoverage=93%, E-value=3e-29, Identity=55%"; Hit description=Non -specific lipid-transfer protein
  Pfam annotation: Domain name=Tryp_alpha_amyl; Domain location=29-112; Score=93.9; E_value=5e-25; Accession=PF00234.13; Description=Protease inhibitorseed storageLTP f
MASMKVTWVVVIMCMAVVGAPMMAQAMTCNDVTVNMAQCLSYLMQGGTPSTLCCSGVKNILGSAVTTVDKQTVCNCLKADAARYNINDQYAQALPGFCKVNVPYKISRSTNCARSGGIHTKELNHQVLNKPWTDLLISAAGY

SEQ ID NO: 107666 - protein, 175 aa, Glycine max
  Coding DNA Sequence Number=SeqID_15981
MGGVYKFEETTDGYSKMQTYKGMLLDPAKNLKNLLRVGGLTTEDKMLVYLITYILTPRSSIKMNWVLLIEDIILMSCQLVDYKFPYVMLASRFIDYFNVDVSNEIVDFTKASSEITERNLKKHGKRFANHEWIIIGEQANSTKVHSSLENITTRLENIETRLMFRSLLNPDEDEA

SEQ ID NO: 107667 - protein, 239 aa, Glycine max
  Coding DNA Sequence Number=SeqID_15982
  Homolog annotation: Hit_ID=A6FJQ2; Match level="QueryCoverage=15%, HitCoverage=84%, E-value=7e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLIPTNPTAALPSKPLTVSAVNSNVNQEIHENNAILPQVTEKQISTTPPPNNQVMMPESVHSRKKWNTDEDNSKPAKGFRKLLFFGYRARIRNHGHSCFLRETCRASCINESANARGEAVCVLGALPLPRSLTRCARSFGCGERYQLTQR

SEQ ID NO: 107668 - protein, 208 aa, Glycine max
  Coding DNA Sequence Number=SeqID_15983
  Gene Ontology: Mol. function=transporter activity; Cellular component= integral to membrane; Biological process=transport
  Homolog annotation: Hit_ID=A4WA68; Match level="QueryCoverage=100%, HitCoverage=96%, E-value=6e-87, Identity=78%"; Hit description =Binding-protein-dependent transport systems inner membrane component
  Pfam annotation: Domain name=BPD_transp_1; Domain location=11-204; Score=92.2; E_value=1.7e-24; Accession=PF00528.13; Description =Binding-protein-dependent transport s
MDNWNTLLALTWQHTWLVLVAVGFAILVGVPLGILIVRFKWLATPVLGIATIVLTIPTIALFGLMIPLFSLIGQGIGALPAITAVFLYSLLPIVRNTHTALENLPPGLREAGRGIGMTFWQRLRWVEIPMALPVIFGGIRTAVVMNVGVMAIAAVIGAGGLGLQLLDGISGSDVRMLIAGALMICLLAIILDWLLHRLQSALTPKGIR

SEQ ID NO: 107669 - protein, 105 aa, Glycine max
  Coding DNA Sequence Number=SeqID_15984
MKGGEHKYGFNNNKREKPQKVRLVDDETGDKHELFEVLRMPSRCVFLKVFMLFLHHSTSSCHSFPESFKIMASPPASPPPPPPSAPSDASASPSAVKRTRKASRL

SEQ ID NO: 107670 - protein, 94 aa, Glycine max
  Coding DNA Sequence Number=SeqID_15985
MFLIFNTSALKGLDDTPQPKSKAAARWIVVKCNRQKGITECGYYVMHWMSTIILGSFRNNWETYFNEVRPLEAERFKALRIQWAQYYLKVRNQT

SEQ ID NO: 107671 - protein, 146 aa, Glycine max
  Coding DNA Sequence Number=SeqID_15986
MSKSCGFGMTGPLDESISCFLIRVDPWVLVPITVLEDYTSSTNQRAARPHLQRTTCPRLERATRPHLGGLHVLALRGLHVLTIRGLHALTSRGLHVLALRGLHALTLGTSYPHRQRTTHPRLERTTRPHHQRAACPHLQRTISPRL

SEQ ID NO: 107672 - protein, 129 aa, Glycine max
  Coding DNA Sequence Number=SeqID_15987
  Homolog annotation: Hit_ID=B0HC01; Match level="QueryCoverage=25%, HitCoverage=70%, E-value=3e-11, Identity=100%"; Hit description =Putative uncharacterized protein
GGGAYGKTPATRPFYGSWPFAGLLLTCSFLRYPLILWITVLPPLSELIPLAAAERPSAARNSYDHDYEFELGTLYGIIMKMDMNLGYLVSYQISIIAQHDSSRLGFPALITALCKAREVTSDFQPSDSR

SEQ ID NO: 107673 - protein, 55 aa, Glycine max
  Coding DNA Sequence Number=SeqID_15988
MDVKVAEVTTFSGGSTRKDWEKTTQQVSFGCVSGTAEPLDFCFVNDDAPQNNHFG

SEQ ID NO: 107674 - protein, 147 aa, Glycine max
  Coding DNA Sequence Number=SeqID_15989
MWAWERCPTLAPKRTPSQVENILLGHRWLRRGNQHIDNDDVRAFRRKLDIMKRHEFVWEPYTSTVISLLPPVYLVGSLAWLKLQRHYNTWCLLKGGIHGQLMISCLMWKKLQFYPKSKRESLSQCHMVPHQSVNFPHNSFTYFSQVL

SEQ ID NO: 107675 - protein, 223 aa, Glycine max
  Coding DNA Sequence Number=SeqID_15990
MAVVKEFYANLYSPEEPAPKQARVRGHLIKIDADNLNEFLQTLVVLEELRINHQEIEARLCIPCKRFVLNVEGQPWKLLRKDLTTLAQTWSVFSYSNLAPTSHTSDLNMDKATLVYGLVCNMDMNIGALISDLTVNFRGARKARARLADVPSSSAPPAPSTSTTPTPAPPGLSAQDSQCFEAMLQSLHQGQILLMQSLQVVSPPGSTLLLEQFMEKYPGPGIL

SEQ ID NO: 107676 - protein, 164 aa, Glycine max
  Coding DNA Sequence Number=SeqID_15991
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPPLARCCCKVGNNITKAVCVLGALPLPRSLTRCARSFGCGERYQLTQRRSFAPSWAVCTNPPFSPTAAPYP

SEQ ID NO: 107677 - protein, 239 aa, Glycine max
  Coding DNA Sequence Number=SeqID_15992
  Homolog annotation: Hit_ID=Q5CDC4; Match level="QueryCoverage=11%, HitCoverage=21%, E-value=3e-07, Identity=100%"; Hit description =LacOPZ-alpha peptide from pUC9
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSLNNPVISLFEIYLDGHESLLSSSVMDNMHCFLGQNRVIKCSPPWDECSLKRSYHDVQERTKMMGTELEFVIMVIAVSCVKLLSAHNSTQHTSRKHKV

SEQ ID NO: 107678 - protein, 82 aa, Glycine max
  Coding DNA Sequence Number=SeqID_15993
  Homolog annotation: Hit_ID=Q51617; Match level="QueryCoverage=41%, HitCoverage=49%, E-value=6e-11, Identity=94%"; Hit description =Putative uncharacterized protein
MTVKTSDTCSSRRRSQLVCKRMPGADKPVRARQRAPFAIQAAQLLGRAIGAGLFAITPAGERGMCCKAIKLGNARVFPVTTL

SEQ ID NO: 107679 - protein, 201 aa, Glycine max
  Coding DNA Sequence Number=SeqID_15994
  Homolog annotation: Hit_ID=Q6WAY6; Match level="QueryCoverage=40%, HitCoverage=14%, E-value=1e-12, Identity=45%"; Hit description =Putative uncharacterized protein
MVGASVNWFSRWKEGGAEVLCSCEGFPNVPLMGTRGCINYNLVLAIRQLGYPMRGVPSEESIAPFITRGFSDPNARMLQRVRKAWNAVQWKDKEIRGSNYKATSCVCTSTALNMDDYKSLQIEFEIFKKDHYAECMKLQTELSYLKVLFRKLNKGKSDLNHMLNVQKHTTDKTGLGYNKQTTFSKKTKFVSSKGVNPDKVS

SEQ ID NO: 107680 - protein, 201 aa, Glycine max
  Coding DNA Sequence Number=SeqID_15995
  Homolog annotation: Hit_ID=UPI0000ECC274; Match level="QueryCoverage =25%, HitCoverage=78%, E-value=1e-12, Identity=62%"; Hit description =UPI0000ECC274 related cluster
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIVLSPTRISRARYVGGATEFLKWWPNYGYTRRTVF

SEQ ID NO: 107681 - protein, 106 aa, Glycine max
  Coding DNA Sequence Number=SeqID_15996
QQLSPVLLRTLESNQFPLLNDPNKACIYVIKDLTITHKLISSSQNGFRFELSSLQIFTQQNLSKLSGTWTFLSLELPKHAKASSQGQTLVHAEASQGKMPKLPQKI

SEQ ID NO: 107682 - protein, 147 aa, Glycine max
  Coding DNA Sequence Number=SeqID_15997
MLPEFSSKVIPKSLATSQKTLSWASLFCLFDLHGIFISKHDDLWVKILISKYGGWRALEEGTSVTNESIWWQDLSRSLFRIWDVTLQMFGNGSLNGEDTFLTMRCKRQPISWMISRGVILIVGHQTAGFGNQNLMASFLQGAHTVCY

SEQ ID NO: 107683 - protein, 85 aa, Glycine max
  Coding DNA Sequence Number=SeqID_15998
MASTSGDATPPSPKTARLMEEMIKLDEGYEEDGGGRRNERYRERRNHRRYGGRQREEMNEGVKAKIPTFKGTYDLEVYLEWEMKV

SEQ ID NO: 107684 - protein, 113 aa, Glycine max
  Coding DNA Sequence Number=SeqID_15999
  Homolog annotation: Hit_ID=Q1RU80; Match level="QueryCoverage=62%, HitCoverage=63%, E-value=3e-09, Identity=40%"; Hit description =Putative uncharacterized protein
MGGRIKFFDRVFNRHWRSGTYILVCREVAPGDKYFPSSSGGDALRDLTQTRRYAWGAAGLIHMYDHLNDASINTSRQVTGYITLLQCWIYEHFPSIAECNADLEYDEVSPRSA

SEQ ID NO: 107685 - protein, 416 aa, Glycine max
  Coding DNA Sequence Number=SeqID_16000
  Homolog annotation: Hit_ID=Q6WAY6; Match level="QueryCoverage=96%, HitCoverage=68%, E-value=5e-32, Identity=27%"; Hit description =Putative uncharacterized protein
MVLTVEEFEEILGCPLGGRKPYLFSGFLPSLSKIAAVVGDSTKELDRMKQTRNGVVGLPQKYLEGKARDMASQEKWVSFEDILALLIFGVVLFPNVDGLVDLAAIDAFVAYHHSKESPVVAILANLFDTFDRRCEKNSARIVCCLPALCVWLVSHLFQQDIRHPCSLQSYRSCIKKRRVDWDQHLAGIGGSTINWFPRWKEGKEGVLFSCGDYPNVPLIGTRGCINYNPALAIRQLGYPMRGAPTEESLSPFLVRDFGAQSLKVVQRVHKAWRSPLRKDKELRGIRNGIIGGYHEWLRVHTRGLDWLSKLKVVNEENFKAPEEDEEIQALKLELGKARLAKEKFKSAATNIRKECTKLREENGATARALEQETKRARKEEHGRDKFRGALWGSNNELKLRREERDQSRVHGIILKE

SEQ ID NO: 107686 - protein, 165 aa, Glycine max
  Coding DNA Sequence Number=SeqID_16001
  Gene Ontology: Mol. function=binding
  Homolog annotation: Hit_ID=A7Q5A5; Match level="QueryCoverage=46%, HitCoverage=8%, E-value=3e-18, Identity=59%"; Hit description =Chromosome undetermined scaffold_52, whole genome shotgun sequence
MEKRPATRPLYGSWPFAGLLLTCSFLRYPLILWITVLPPLSELIPLAAAERPSAASHWHDRFPDWKAGSERNAINETAMTMITNSSSVPDVGTLDILYGGFENDDWASPLPSNEDECVHAILGEGFAKILLLSDNYPSIPASLHPVILSKLIYLYFTDVSEHLHR

SEQ ID NO: 107687 - protein, 146 aa, Glycine max
  Coding DNA Sequence Number=SeqID_16002
MTLLLSNILPSDRNADLPLQKYQLVCAVPTLGSCPHDTQWTRRSPTGPWGFQLWLRPLSVLQGARSPQQGVAPTRHPVDPEEPNRALGFPALVTGLCQSYRAPVPPASSCHRDIGITPARHSVDPEKSNRVLELPALIMGLCQFYE

SEQ ID NO: 107688 - protein, 236 aa, Glycine max
  Coding DNA Sequence Number=SeqID_16003
  Homolog annotation: Hit_ID=A8GBK4; Match level="QueryCoverage=49%, HitCoverage=52%, E-value=2e-55, Identity=93%"; Hit description=Curli production assembly/transport component CsgG precursor
  Pfam annotation: Domain name=CsgG; Domain location=125-236; Score= -42.4; E_value=0.0069; Accession=PF03783.5; Description=Curli production assemblytransport component CsgG
DAVVPPVIRMIHRFYHAGGPQAAQRPAGAGLVDAKPGRHLGDAQRLLADFDHQMDLQRRKARAVALLVQHAEFSDQTTRQCSEIPDDRGVSITATTFVMSTSGAGCSRAVLCSWRDRMPMKKSLAVCSVALSVTLLAGCATESSRSLEVPKVASYNTTYQGPRSPIAVGKFDNRSSYMNGIFSDGVDRLGNQSKTILITHLQQTGRFNVLDRANMEELKTEAGIKGKAQTLKGANY

SEQ ID NO: 107689 - protein, 209 aa, Glycine max
  Coding DNA Sequence Number=SeqID_16004
  Homolog annotation: Hit_ID=Q6WAY4; Match level="QueryCoverage=70%, HitCoverage=26%, E-value=2e-18, Identity=35%"; Hit description =Putative uncharacterized protein
MVEVSTEVIASLAQYYDQPLRCFTFGDFQLSPMVEEFEEILGCPLEGRRPYLFSGFYPSLARISKIVQISAQELDHRKQVKNGVVGIPRKYLEAKARILAGKGEWAPFIDILALLIFGGVLFPNVDGLVDLAAIDAFLAYHDHKESPIVAMLADLYDTFDRRKYTITKCTPRHPYHTRSKSRTMGDQEETHEQMKADMSALKEQMASMM

SEQ ID NO: 107690 - protein, 66 aa, Glycine max
  Coding DNA Sequence Number=SeqID_16005
  Homolog annotation: Hit_ID=UPI0000ECBAF8; Match level="QueryCoverage =62%, HitCoverage=48%, E-value=1e-16, Identity=100%"; Hit description= UPI0000ECBAF8 related cluster
MDDKIGDGITRQKGMQAWHWPSFYNVVTGKTLALPNLIALQHIPLSPAGVIAKRPAPIALPNSCAA

SEQ ID NO: 107691 - protein, 131 aa, Glycine max
  Coding DNA Sequence Number=SeqID_16006
MTVITSDTCSSRIRSQLVFDGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPDAVSTIR

SEQ ID NO: 107692 - protein, 104 aa, Glycine max
  Coding DNA Sequence Number=SeqID_16007
MAKYDPEIVMEFYANVWPTEEGVVDKHSWVRGQCIPYYEDAIYQFLGHLLVLEERQRRWVRIMSTSMTTLTQIWMTLLLNNILPSNHNSDLPLPKCQLVYTILT

SEQ ID NO: 107693 - protein, 78 aa, Glycine max
  Coding DNA Sequence Number=SeqID_16008
MDRSWMQASRISDEYENGVKQFLQFTELNAPSLRENPSISQTNPVDVDMGNRIEDMIRDLGQGAQLSQGCQWYYLWST

SEQ ID NO: 107694 - protein, 115 aa, Glycine max
  Coding DNA Sequence Number=SeqID_16009
  Homolog annotation: Hit_ID=Q51617; Match level="QueryCoverage=30%, HitCoverage=50%, E-value=4e-11, Identity=91%"; Hit description =Putative uncharacterized protein
  Subcellular localization annotation: CTP_CleavageSite=32; ConfidenceScore=5.12e-01
MTVKTSDTCSSRRRSQLVCKRMPGADKPVRARQRMRKEKYRIRRHSPFRLRNCWEGRSVRASSLLRQLAKGGCAARRLSWVTPGFSQSRRCKTTASAKLACLQVDSRGSPPTLLT

SEQ ID NO: 107695 - protein, 61 aa, Glycine max
  Coding DNA Sequence Number=SeqID_16010
MDSGRFQVSVPGVYHQLLALPWHIRGKAQSRLDCGGEFHVSPPQFKRHVHDQFGVVGSQWV

SEQ ID NO: 107696 - protein, 75 aa, Glycine max
  Coding DNA Sequence Number=SeqID_16011
  Subcellular localization annotation: CTP_CleavageSite=35; ConfidenceScore=5.27e-01
MGVAVMPRCASPSSHNVWNGMVRSSWESRVCLDSRASSGGGGRGCLGARLVMASVLKRPNVRRAEYVSTIALAFA

SEQ ID NO: 107697 - protein, 44 aa, Glycine max
  Coding DNA Sequence Number=SeqID_16012
MAHHTPIIQAPDWTTLFELIGMEKEEREKKPLQGEDESRRSSPP

SEQ ID NO: 107698 - protein, 114 aa, Glycine max
  Coding DNA Sequence Number=SeqID_16013
LGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRIPPLSELGIL

SEQ ID NO: 107699 - protein, 119 aa, Glycine max
  Coding DNA Sequence Number=SeqID_16014
MNPLMKKILGLQAPMELTSQCHTKNTKAEKNSYQKWRCVHFWKKKAFIRKKEARGIFAIYKFCWVHLAPLFIFSYTLKTHWAGLEYALLGVIGDIGENRIFTGQRDVYGNLKVSDRVQD

SEQ ID NO: 107700 - protein, 288 aa, Glycine max
  Coding DNA Sequence Number=SeqID_16015
  Gene Ontology: Mol. function=oxidoreductase activity, acting on NADH or NADPH; Cellular component=mitochondrial respiratory chain; Biological process=mitochondrial electron transport, NADH to ubiquinone
  Homolog annotation: Hit_ID=A2ZXB2; Match level="QueryCoverage=25%, HitCoverage=55%, E-value=3e-17, Identity=57%"; Hit description =Putative uncharacterized protein
MATKGWSFVGASMVEEEEENGNSLAFLCAHRGQFSKVGNIYIKTLRIKPRVWFRGCHTSPLDLNLALAAVASARFPFQHFTGAVLWETFFCTTTLFYAPAWAVHVALHLTTIIIPLRRLTSDSDSSSSSVIDLMRAAKFVMLKVDDLMNWARCSSIWPMTFGLACCIVEMMHTGTALTSFLGPAPANLIIVSTLTNNMAPALDKTAPAGESDNDNFPIKRYIAKYTINPAIANGLSQYVGSVENVALWHFSIAYGNLIQNERSETEVIFPVKKQGCKCHQYLLTYVGH

SEQ ID NO: 107701 - protein, 155 aa, Glycine max
  Coding DNA Sequence Number=SeqID_16016
MASRKRKSISTRPTSQYDTKRFSSLDAWTKYTDNVIGRNILPERKLELYHTELNDFKAELERRNFHKCLTNLVDGSIDLALVKEFYANLYSSEDHPPKQSRVRGHLVKIDADSHNTFLETPVVLAEGETLPGYSRYCRLPTDFREIEVALCILGP

SEQ ID NO: 107702 - protein, 55 aa, Glycine max
  Coding DNA Sequence Number=SeqID_16017
MNPECVFAEICYPNLMRIMKLAKYRLKAQVEKDEGLSGEGQNPRVEKDEGPSGEG

SEQ ID NO: 107703 - protein, 189 aa, Glycine max
  Coding DNA Sequence Number=SeqID_16018
  Homolog annotation: Hit_ID=B0HC01; Match level="QueryCoverage=17%, HitCoverage=70%, E-value=6e-11, Identity=100%"; Hit description =Putative uncharacterized protein
MRKRHASRREKGGQVSGKRQGRNRRAHEGSFQGETPGIFIVLSGFATSDLSVDFCDARQGGGAYGKTPATRPFYGSWPFAGLLLTCSFLRYPLILWITVLPPLSELIPLAAAERPSAARNSYDHDYEFELGTQRHRRRHGAAHAIFARRIVGGADDPPLNAAAAYRNGDIPQRRVVTHLHCGKKAVGIL

SEQ ID NO: 107704 - protein, 76 aa, Glycine max
  Coding DNA Sequence Number=SeqID_16019
MACTKKTGQMMSEAAKEIAEKIDSLEEQDLLTVAIGRPEHPGRMHAAGAAVTIKQYFESAPRTSRTSSSMAPEELE

SEQ ID NO: 107705 - protein, 79 aa, Glycine max
  Coding DNA Sequence Number=SeqID_16020
MHHRPQDALPPPHQADHAGSLGMEQYLQHLFRAEVAWPGDWPEAQAGEAPAGSPGDAEEARMDEEMMDLLGFLGGSGAM

SEQ ID NO: 107706 - protein, 75 aa, Glycine max
  Coding DNA Sequence Number=SeqID_16021
MRGRFIALVSSVREQEISWALFLYLVEAKLHGESKMMTKVMTKSSKINQRITQVNQRSIKNNSRVQDKNQEEFMT

SEQ ID NO: 107707 - protein, 255 aa, Glycine max
  Coding DNA Sequence Number=SeqID_16022
  Homolog annotation: Hit_ID=Q6WAY6; Match level="QueryCoverage=86%, HitCoverage=37%, E-value=2e-16, Identity=29%"; Hit description =Putative uncharacterized protein
MVGDSTRELDRMKQTHNGVVGLPRKYLEGKARDRASQEKWGSFADILALLIFGVVLFPNVDGLLDLAAIDAFLAYHHSKESSVVAILADLFDTFDRRCEKNSAQIVCCLPALCVWLVSHLCQQDTRHPCPLQSYRSCAEKGRVDWDQHLAGIGGNAINWFPRWKEGKEGVLFLWTRGCINYNPTLAIRQLGYPMRGAPTEESLSPFLVRDLGAQSLKVIQRVHKAWRSPLRKDKELRGIQNGVIGGYHGWLRVHT

SEQ ID NO: 107708 - protein, 71 aa, Glycine max
  Coding DNA Sequence Number=SeqID_16023
MNPVNLLIQRNTEIVSQRALRGQARARLTGALSKGGKMRGVATNVYLWKTSGKPKETGQNENSKFGSCIYA

SEQ ID NO: 107709 - protein, 225 aa, Glycine max
  Coding DNA Sequence Number=SeqID_16024
  Gene Ontology: Mol. function=helicase activity; Cellular component =chromatin; Biological process=viral genome replication
  Homolog annotation: Hit_ID=Q8RV60; Match level="QueryCoverage=76%, HitCoverage=13%, E-value=1e-48, Identity=54%"; Hit description =Putative uncharacterized protein At2g05640
MTYDKEMLAEQYNTAYQLLTDEQKTIVDTIMSVVNTQSTAVYFLYGYGGTGKTFIWTTLSSGIRSNGGIVCTVASSGIASLLLPGGQTAHSKFAIPVPATENSTCNIHQGSELAELLKVTKLIVWDEAPMCHKFAFEALDKSLKEIMQNNLPFGGKIMVFGGDFRQILPIVTKLIVWDEAPMCHKFAFEALDKSLKEIMQNNLPFGGKIMVFGGDFRQILPIVPK

SEQ ID NO: 107710 - protein, 65 aa, Glycine max
  Coding DNA Sequence Number=SeqID_16025
  Gene Ontology: Mol. function=endonuclease activity
  Homolog annotation: Hit_ID=Q9AY32; Match level="QueryCoverage=89%, HitCoverage=87%, E-value=6e-24, Identity=96%"; Hit description=RRNA intron-encoded homing endonuclease
STLEDPPVLVSTINDADQGSADVAFRTPLAPYEKSKSLGSGGSMVARLKLKGIDGRAPPGVEPAA

SEQ ID NO: 107711 - protein, 199 aa, Glycine max
  Coding DNA Sequence Number=SeqID_16026
  Homolog annotation: Hit_ID=Q6WAY4; Match level="QueryCoverage=96%, HitCoverage=34%, E-value=5e-24, Identity=35%"; Hit description =Putative uncharacterized protein
MGPLQMQAFRKAYGKILDLTIAEISTKAIASLTQYYDQPLRCFTFGDFQLVPTVEEFEEILGCPLEGRKPYLFSGFLPSLGKIAIVVRDSTRGLDRVKQTRNDIVGLPRKYLEGKARDMANQEEWVPFMDVLALLIFGVVLFPNMDGLVDLAAIDAFLAYHHSKESPVVAILADLFDTFDRRCEKSSARIICCLPALCV

SEQ ID NO: 107712 - protein, 177 aa, Glycine max
  Coding DNA Sequence Number=SeqID_16027
  Subcellular localization annotation: CTP_CleavageSite=41; ConfidenceScore=5.66e-01
MAEPSKKRKGSSSTAAAAAHRRHGPSEASTTPIHPSLSSPRSSTLFSSNNQRLRYLSQFSSRIILDPKYLDVEFFNDGTLDCYQVFQNSGLVDFMSLKLPHYPELVKVFYCNLKIQDGIISSEVHGIPMIIDQSLFFSLTHLPSQGAPFEGTIVDDWKFDYSSHDARRMVCNDQGIL

SEQ ID NO: 107713 - protein, 81 aa, Glycine max
  Coding DNA Sequence Number=SeqID_16028
MVGRGRDQNRDVLDRITVVLETIVQERDVEPAEYRRLMAFRKNQLPKFSGDYDPEGARLWSIRSLMRCSCSKEKLRTGGSS

SEQ ID NO: 107714 - protein, 198 aa, Glycine max
  Coding DNA Sequence Number=SeqID_16029
  Homolog annotation: Hit_ID=A6E762; Match level="QueryCoverage=97%, HitCoverage=98%, E-value=8e-20, Identity=32%"; Hit description =Putative uncharacterized protein
MKQRFLAVSSLLLCITCSVEANAQQTPIVHIGVKAGTNFTKTSSASSDLSGKYGIGYQAGLMARVDFNRIYLQGEAIFNKRKTSYDLKDGSSSQLKWNSIDIPVVAGYKIVSSKDFNVRAFAGGVYSYGFNDNISTSKALREGLKKFDKSNIGITGGIGVDYKNFTVDLRYETGLTSISKEFKSKPHSFSLGIGYFLF

SEQ ID NO: 107715 - protein, 70 aa, Glycine max
  Coding DNA Sequence Number=SeqID_16030
LKHDIKIPNVENTWNWAANIVLKFHDNPTVNESEIIVFLRQVRWPAGKREGFGRREKKRNCEAEEAEESV

SEQ ID NO: 107716 - protein, 183 aa, Glycine max
  Coding DNA Sequence Number=SeqID_16031
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPGRRHARSRRQTQDCGRKIRLLPQTRPLKDLLLKGQVLLRE

SEQ ID NO: 107717 - protein, 104 aa, Glycine max
  Coding DNA Sequence Number=SeqID_16032
  Homolog annotation: Hit_ID=A2Q5X7; Match level="QueryCoverage=76%, HitCoverage=7%, E-value=1e-08, Identity=36%"; Hit description =Ovarian tumour, otubain, putative
MHDFIDKIVDVKADGNCGYRSVAGLLGMGEDFWSVVRYHLLKELGNFSEDYTRLFGGTKRFEELRMSLHVDGLTKHCCDLAIIILRRSRDQLHILAECSITRAS

SEQ ID NO: 107718 - protein, 70 aa, Glycine max
  Coding DNA Sequence Number=SeqID_16033
  Gene Ontology: Mol. function=catalytic activity; Cellular component =peroxisomal membrane; Biological process=metabolic process
  Homolog annotation: Hit_ID=Q946Z2; Match level="QueryCoverage=88%, HitCoverage=11%, E-value=1e-22, Identity=82%"; Hit description =Putative acyl-CoA synthetase
MELALDYHIYCAVIPREGSNIDDADVLRYCKKNLASFKVPKKVFITDSLPKTATGKILRRLVAEHIVSQI

SEQ ID NO: 107719 - protein, 84 aa, Glycine max
  Coding DNA Sequence Number=SeqID_16034
  Homolog annotation: Hit_ID=A6FJQ2; Match level="QueryCoverage=45%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNASVFPHHDVVKRRPVPSLHACRSTLEDPQQKPCMSR

SEQ ID NO: 107720 - protein, 264 aa, Glycine max
  Coding DNA Sequence Number=SeqID_16035
  Homolog annotation: Hit_ID=A5BSR3; Match level="QueryCoverage=41%, HitCoverage=34%, E-value=6e-10, Identity=35%"; Hit description =Putative uncharacterized protein
MARTNRYGKMTSEAARKIADKIDSLEEQVTQGEFVPQGHQDILNTAIGRPDHGGHVRAAGSGVTISQYYGKTSCASTTSSISFTKEQLAEIVVTIREQVRNEIQEEKKRSLQAWKNELKDAIITDIFDGDKVSAPANFDLNVLGARVSTKESNAEIVVNPSREEHVGRVTPPMGLYVQSQDCTKLVALVKIHDGPSTIHCVAYADDVVRVSIEKVIDGEAEVPFATSEIKYVREALNTFIAWPLPLVKLVSNEVVYFMFCKGIL

SEQ ID NO: 107721 - protein, 138 aa, Glycine max
  Coding DNA Sequence Number=SeqID_16036
MYPSQEPYLLLREKVGFPVLRYLSRYRMHHSRPPSLSHSFLKQVRQEDATRERSPQISPDPPSPMVDQSSLQQPVDPPTPVHEIPADPSTPLLDLPEDPSTPVLGLTTTPPATLVLHLTDEEGTQDEDTQSQDMSQEF

SEQ ID NO: 107722 - protein, 51 aa, Glycine max
  Coding DNA Sequence Number=SeqID_16037
MSQHICHTFVDSASDMNSMRAGNPMCMNPLAVIQRSEQSQFELESYMKSWM

SEQ ID NO: 107723 - protein, 121 aa, Glycine max
  Coding DNA Sequence Number=SeqID_16038
MVDTLPVFYYEKLVGYMPSSFADLVFAGERIEVGLKRGKFDYVSPIGANSRRIGIDGAKKKEGDAHTVTSTLAIIHLVAWYKVCHLAKPIHHHKDRVYTSLDSRKPKDKVHTNIYPRCRWD

SEQ ID NO: 107724 - protein, 160 aa, Glycine max
  Coding DNA Sequence Number=SeqID_16039
  Homolog annotation: Hit_ID=A0ST23; Match level="QueryCoverage=28%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLIPQQRVERPAGRARHDPAGLALQGTELEFVIMVIAVSFGKPVVPAALMNRPTRGERRFAYWALFRFLAH

SEQ ID NO: 107725 - protein, 212 aa, Glycine max
  Coding DNA Sequence Number=SeqID_16040
  Homolog annotation: Hit_ID=Q6WAY6; Match level="QueryCoverage=40%, HitCoverage=15%, E-value=2e-09, Identity=37%"; Hit description =Putative uncharacterized protein
MGTRGCINYNPVLAIRQLGYPMRGAPSEESITPFIAWGFSDPNARVLQEVQKAWGAVQSKDKELRGSSNGIAGGYHKWLRVRTQKLDWLPKLKAAREEEAETLEESEEVQTLKAKLERAQVVKENFKSMAIKVWKEYDELTDINMATAEALERETKRARKEEHDRNKFRGALWGSNSELRLLRAKKDQSRVKGMILKDELKACHWSKRCLSE

SEQ ID NO: 107726 - protein, 24 aa, Glycine max
  Coding DNA Sequence Number=SeqID_16041
MSYHKGGESERLTVKCFSLRFRLS

SEQ ID NO: 107727 - protein, 55 aa, Glycine max
  Coding DNA Sequence Number=SeqID_16042
MYRSTGIKDFATYGIEEKAQASMANLTLLGKSLVWPRLTIVASTRDNRETLTLLA

SEQ ID NO: 107728 - protein, 93 aa, Glycine max
  Coding DNA Sequence Number=SeqID_16043
MSAEKYHSGPFHDRCRLLSFLTSIGHLSMPTSAIIFFDQFLMRIVKLAKYRLKAQVEKDEDPSGEGQSPRVEKDEGPEAETLARLIIVAEGPN

SEQ ID NO: 107729 - protein, 186 aa, Glycine max
  Coding DNA Sequence Number=SeqID_16044
  Gene Ontology: Mol. function=helicase activity; Cellular component =nucleus; Biological process=viral genome replication
  Homolog annotation: Hit_ID=Q2A9E0; Match level="QueryCoverage=94%, HitCoverage=11%, E-value=8e-53, Identity=58%"; Hit description =Putative uncharacterized protein
  Pfam annotation: Domain name=DUF889; Domain location=1-119; Score =15.5; E_value=1.6e-12; Accession=PF05970.5; Description=Eukaryotic protein of unknown function (DUF889)
MTTEIGILQTIGDHMEYLSSDSVDKLETIEDSYFQSITTKFLNSLTTSGLPTHSIKLKIGSPIMLLRNLDQNQGMCNGTRLVVTKLAKHVIAAEIISGKNIGLGVYIPRMSMSPSQSPWPFKPLRRQFPIMLSYAMTINKSQGQSLSMVGLYLPKPVFTHGQLYVALSRVNSAKGLKIMIHDNEQK

SEQ ID NO: 107730 - protein, 310 aa, Glycine max
  Coding DNA Sequence Number=SeqID_16045
  Gene Ontology: Mol. function=transferase activity, transferring phosphorus-containing groups; Cellular component=integral to membrane; Biological process=two-component signal transduction system (phosphorelay)
  Homolog annotation: Hit_ID=A8GI87; Match level="QueryCoverage=100%, HitCoverage=57%, E-value=7e-75, Identity=49%"; Hit description =Signal transduction histidine kinase regulating citrate/malate metabolism precursor
  Pfam annotation: Domain name=PAS; Domain location=212-305; Score=9.7; E_value=0.051; Accession=PF00989.15; Description=PAS domain
MKRRLSFQVKLFLALVCFSCLLLVLLGTILFHFIDRQLHHDLGQRARVQASQIALMPGLADKVAARDIPGIARLIQPLRAESDASYIVIGDTREQHLYHSESPERINLPMIGGDNAEVLKGKTIISVRQGGIGVSLRSKAPIFNAQHQVIGIVSVGYLTSYIANINARILWQSGLYGVALLLLLFMFSWLFTRNLKKQMFRLEPKDIAQLVLQQRALLEAMYEGVFAVNEEKQLILINRAAREMLDIRQSEKELIGKPLEDVLQTSPGFLSQRYASVSSGSHDQIAVLNQREVIVNRVAIEVEPGVESGW

SEQ ID NO: 107731 - protein, 65 aa, Glycine max
  Coding DNA Sequence Number=SeqID_16046
MEGSQEVLKRKPRAKRIFVHALSRESQALSAQPLNLRLIWCAELAKAELSQLQFDLDLAKRKPNH

SEQ ID NO: 107732 - protein, 169 aa, Glycine max
  Coding DNA Sequence Number=SeqID_16047
MEDCRIFSTESLRRILRIPLQLKCSSWCGGFNGKQRRLTVATGGLRWWKNEVLGFGWHFGEEESEKSCFSRSERIYNLHISLSEPVALSRSRLLWLELGLAHLWALSAIPSLVGIALNAPFSPSERPNVVILKIPTVRLWVLHHSSSPTFKLLSIASYGGELLLDSSSP

SEQ ID NO: 107733 - protein, 142 aa, Glycine max
  Coding DNA Sequence Number=SeqID_16048
ALGFPALITGLCQSFGVPVAPTKGDAPQAAGAPPPPHQAGQAGAFDMEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGD

SEQ ID NO: 107734 - protein, 82 aa, Glycine max
  Coding DNA Sequence Number=SeqID_16049
  Homolog annotation: Hit_ID=Q1KSA7; Match level="QueryCoverage=64%, HitCoverage=35%, E-value=5e-10, Identity=61%"; Hit description =Putative complex 1 protein, LYR family
MRGRLQKWRCVWNCIDSPSQQLRLLHEGPDTVEELLKRHLVKNNNENELENRRQLTSTRREALSLYRDILRATRVVRSCRIR

SEQ ID NO: 107735 - protein, 78 aa, Glycine max
  Coding DNA Sequence Number=SeqID_16050
  Homolog annotation: Hit_ID=A6FJQ2; Match level="QueryCoverage=48%, HitCoverage=84%, E-value=1e-10, Identity=89%"; Hit description=50S ribosomal protein L5
MRKEKIPHQAPFAIQAAQLLGRAIGAALFAITPAGERGMCCKAIKLVPSLHACRSTLEDPLGASSKGGKCAESPPMFI

SEQ ID NO: 107736 - protein, 132 aa, Glycine max
  Coding DNA Sequence Number=SeqID_16051
  Homolog annotation: Hit_ID=Q6WAY6; Match level="QueryCoverage=33%, HitCoverage=7%, E-value=2e-10, Identity=61%"; Hit description =Putative uncharacterized protein
MEGLVDLAAIDAFLAFHHGKESPVVAILAMYDTFGRGCEKSSARIVCCALALFVRLKEGRIRILSLCEGFPNVPLIGTRGCINYNPVLAIRQLGYPMRGAPLDESITPFITRGFSDPNAKVLQGVRKACDAA

SEQ ID NO: 107737 - protein, 63 aa, Glycine max
  Coding DNA Sequence Number=SeqID_16052
MKSGDRRRYPSGSPYKRFLLTLTREVRWQTGVPYGYPHLSSTKVNEFDGFYSRHPKTFKPDVA

SEQ ID NO: 107738 - protein, 111 aa, Glycine max
  Coding DNA Sequence Number=SeqID_16053
DAGSRQARQGASAGVGGCRAWLNYAASEQIVLRVHHMRAIGAGLFAITPAGERGMCCKAIKLGNARVFPGALPLPRSLTRCARSYGCGERYQLTQRRNTESTESGDNAGQN

SEQ ID NO: 107739 - protein, 120 aa, Glycine max
  Coding DNA Sequence Number=SeqID_16054
MAAQLIHDQVEMECLEGAWETLEGNARCRFRGTIRFTATSLVHPDEPARTLQRTVEWILPTPTPYRLVEPVQVIEVTSSEEDPEEDLEGLPLEPAVDALDFLEDDEDPVTEVDSPEEVMS

SEQ ID NO: 107740 - protein, 152 aa, Glycine max
  Coding DNA Sequence Number=SeqID_16055
MGMRGCINYNPVLAIRQLCYPMRGASLEEGLTPFIARGFNSPNVEVVKGVRRAWEMVQKKDKELRVSSNGAISDYHSEEVQALKTELEKAQAVKEKFKSTAVRIQKENVELRDVNIATAKALEQETKRTRKEEHDRNKFRGDLWGSNSELKL

SEQ ID NO: 107741 - protein, 83 aa, Glycine max
  Coding DNA Sequence Number=SeqID_16056
MNVLSSATIFCKITHASNIFMIHIHSDSLGVEGRSPEFQEPLDLRSNPFQGGGNDAILPPQGYWIEDSKKIGPKMQKKALGFS

SEQ ID NO: 107742 - protein, 37 aa, Glycine max
  Coding DNA Sequence Number=SeqID_16057
MVLNHFNKSASSWTSHPLEGIVKRSSIPNEMDVSGIL

SEQ ID NO: 107743 - protein, 108 aa, Glycine max
  Coding DNA Sequence Number=SeqID_16058
MVGYTPSSFADMVFAGKRIEVGLKRGKFGHPALIKTGANEEVTMLNKMDKFDIFVPHPLTNASLLIQLSPECGCKPLFCLLKRPALLSVDFQDRSIRDYSSCTLVGVP

SEQ ID NO: 107744 - protein, 157 aa, Glycine max
  Coding DNA Sequence Number=SeqID_16059
DAGSRQARQGASAGVAGCRGWLNYAASEQIVLRVHHMPAPFAIQAAQLLGRAIGAGLFAITPAGERGMCCKAIKLGNARDCHHQKGGDCGSNDFQDYFDDAKESRVKQVPKNQASRIKSQRIKIQEQLSFKIQDSRTIKIKIQEKKSRSNSQDFTRE

SEQ ID NO: 107745 - protein, 83 aa, Glycine max
  Coding DNA Sequence Number=SeqID_16060
MEVNGKYLHLDIHWNYCTHVVALNLVAIVDQDPEWVRWFGLKAQSLDQMSLNKIVGEPNSSGGLGKRSRDGASSIGSSSSFTI

SEQ ID NO: 107746 - protein, 200 aa, Glycine max
  Coding DNA Sequence Number=SeqID_16061
  Subcellular localization annotation: CTP_CleavageSite=33; ConfidenceScore=5.03e-01
MTVKTSDTCSSRRRSQLVCKRMPGSRQARQGASAGVVGCRAWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPTLAQGPSFTDLITPPPRLFPPLFQPSPIIFLPPSMLPTSPSPMVPLSSVHSAKTPPFPS

SEQ ID NO: 107747 - protein, 115 aa, Glycine max
  Coding DNA Sequence Number=SeqID_16062
MPKSSPNMHVKQEVSTRVKPRLLCKQSMGQNTLNKIDDDGSNSHQGKTRVSIHKMPRNSYFKNNYPLPVHNPKFKEEHVMLYTKHKTKMIEAIPESNKHGNAVLGSDPRSFPNEQ

SEQ ID NO: 107748 - protein, 189 aa, Glycine max
  Coding DNA Sequence Number=SeqID_16063
  Subcellular localization annotation: CTP_CleavageSite=83; ConfidenceScore=5.30e-01
MPPKVSSSSGRGGRSSTKGKEVLLALPEPITKKETTSSSGSPTQTGSSTQKGNLEGSLTQITTVKPESSTQESPKSTTTKQTVADYAWSIQTLLALEDIGLTKVPKLAKKTWAEMASESDDDFETDLQKQIQKAKQTKTVCNQKPIQSLTQQESTPQPSNSYIAKKKNFNVSQMEPEYWDKNPFKATAK

SEQ ID NO: 107749 - protein, 18 aa, Glycine max
  Coding DNA Sequence Number=SeqID_16064
MAPNLIEAVPESNKHENT

SEQ ID NO: 107750 - protein, 98 aa, Glycine max
  Coding DNA Sequence Number=SeqID_16065
  Homolog annotation: Hit_ID=P62521; Match level="QueryCoverage=89%, HitCoverage=13%, E-value=3e-08, Identity=34%"; Hit description =Probable Coiled-coil domain-containing protein 8
MRGIVHEPQRTTRPRLERTTCPRHQRTTCPRHQRTTCPRHQRTSCPRHQRAARPHLQKTTRPRLERTTCTHHQRAARPHLQRTTRPRLERATRPRLGY

SEQ ID NO: 107751 - protein, 262 aa, Glycine max
  Coding DNA Sequence Number=SeqID_16066
  Gene Ontology: Mol. function=ATP binding; Cellular component =cytoplasm; Biological process=cellular response to phosphate starvation
  Homolog annotation: Hit_ID=A4W947; Match level="QueryCoverage=99%, HitCoverage=73%, E-value=1e-131, Identity=89%"; Hit description=PhoH family protein
  Pfam annotation: Domain name=PhoH; Domain location=56-262; Score =462.6; E_value=5.1e-136; Accession=PF02562.7; Description=PhoH-like protein
MGRQKAVIKARREARRVLRSDSRSHRQREEESVTSLVQMGGLDAIGMARDVRDRSPIEARNDAQAHYLNAIETKQLIFATGEAGCGKTWISAAKAAEALINKDIERIIVTRPVLQADEDLGFLPGDISEKFAPYFRPVYDVLVKRLGASFMQYCLRPEIAKVEIAPFAYMRGRTFENAVVILDEAQNVTAAQMKMFLTRLGENITVIVNGDVTQCDLPASVKSGLADALARFEEDEMIGVVRFGKDDCVRSALCQRTLHAYS

SEQ ID NO: 107752 - protein, 173 aa, Glycine max
  Coding DNA Sequence Number=SeqID_16067
  Homolog annotation: Hit_ID=Q5QJQ3; Match level="QueryCoverage=18%, HitCoverage=25%, E-value=7e-12, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIVLSPTR

SEQ ID NO: 107753 - protein, 147 aa, Glycine max
  Coding DNA Sequence Number=SeqID_16068
MVIPHTFSPFRHSRVRWHAETNIVFCALLSSRGDGPDDMRRQIMVIPHTFSPFRHSRVQCHTETNVVFYALLSSRGSGPDDMRRQIMVIPHTFSPFRHSRVRWHTKTNVVFCALLSSRGGGPDDMRRQIMRLTTSSAPFAIQRQRAR

SEQ ID NO: 107754 - protein, 84 aa, Glycine max
  Coding DNA Sequence Number=SeqID_16069
  Gene Ontology: Mol. function=heat shock protein binding; Cellular component=cytoplasm; Biological process=chloroplast accumulation movement
  Homolog annotation: Hit_ID=Q2QNZ9; Match level="QueryCoverage=86%, HitCoverage=7%, E-value=1e-29, Identity=82%"; Hit description =Expressed protein
MMDFSRVFYFLLVVLWPECGWQPVSLTDMITSSAVKKVYRKANLCIHPDKVQQKGATLEQKYTAEKVFDILKEAYTKFNAEELS

SEQ ID NO: 107755 - protein, 70 aa, Glycine max
  Coding DNA Sequence Number=SeqID_16070
MNGVFGHVSCTFEFGAMRSDCLVQFSILNPFSEPHEEEKEGVETKVVITERAGQTKSVSYLCFPLIPNER

SEQ ID NO: 107756 - protein, 98 aa, Glycine max
  Coding DNA Sequence Number=SeqID_16071
MVYSKINAKTCHYCMKKGYTSYNFYVRRFDIQRGQCTWIPKDLFVKINPIRPNLNWVCLKARDSLRYLDSGCSRHMMGDKSKLSDFVSKDGGYVTKLR

SEQ ID NO: 107757 - protein, 120 aa, Glycine max
  Coding DNA Sequence Number=SeqID_16072
  Homolog annotation: Hit_ID=A7QB13; Match level="QueryCoverage=37%, HitCoverage=14%, E-value=8e-13, Identity=75%"; Hit description =Chromosome chr5 scaffold_72, whole genome shotgun sequence
MVFFGYVKSCCTDYINGNLNPTVEVNIFGYSEAADVVFTSGVDVLAVGINVTHQVVLTEFMHKAPVPPQSLIVTVFGVSSTSSASRPSRDGLSTGRGVSSSGKTTILTSREISLADIGHD

SEQ ID NO: 107758 - protein, 91 aa, Glycine max
  Coding DNA Sequence Number=SeqID_16073
MAGSNSIIQGSLPVFDGKLFDDWKVKMLAIFGFQDVFEVVTFGFEDPGRKATEEQQLDFKQNAETGLQSSISHLPMCELKDFQQDLEGLYL

SEQ ID NO: 107759 - protein, 88 aa, Glycine max
  Coding DNA Sequence Number=SeqID_16074
  Homolog annotation: Hit_ID=A6FJQ2; Match level="QueryCoverage=43%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARLHEPCKHGGVEAEIGFWRGSTNWGRSEESGGGKRNIFF

SEQ ID NO: 107760 - protein, 205 aa, Glycine max
  Coding DNA Sequence Number=SeqID_16075
  Homolog annotation: Hit_ID=A0ST23; Match level="QueryCoverage=21%, HitCoverage=91%, E-value=2e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPILEGVDRQDNNRNASASTVSHDTEFANSRSSSSSNTKSGKPSRFELAAFSAAPASFFPRVSDKFTGNGLAGLGTELEFVIMVIAVSFGKPVVPAALMNRPTRGERRFAYWALFRFLAH

SEQ ID NO: 107761 - protein, 34 aa, Glycine max
  Coding DNA Sequence Number=SeqID_16076
FYPMPLRGRIASQSPVESPTVATYPSTGGRRVTR

SEQ ID NO: 107762 - protein, 175 aa, Glycine max
  Coding DNA Sequence Number=SeqID_16077
MTGRLLSGSLAFEIHILHYLIVRILLPRSSNLAQVSEEDLIVMWAFHTVTLFLQHFNIPLDFEPYIPIKRSFLIGAAVIATFGYRKEHDDSWVKKGAQPIDDEGHLPVGEDSSLLQRILDRFDGLQTYVGERFDALELQVDMRFNEMESRITKVEGDVTYIRICFDLPPALPPSS

SEQ ID NO: 107763 - protein, 150 aa, Glycine max
  Coding DNA Sequence Number=SeqID_16078
MAKFDPYIVLEFYDNAWPTEEGVRDMRSWVRGQWIPFDADALSQFLGEPLVLEEGQECEFSQRRNRADGFDKEAIAQLLCIPGQDFARTAAGRRVRIMRTSMTNLTQMWMTLLLSNVLPSDQNSDLPFPKCQLVYVILTQMSIHVAQLIA

SEQ ID NO: 107764 - protein, 88 aa, Glycine max
  Coding DNA Sequence Number=SeqID_16079
MKSGDMRGYRMGQQVRWQAEIPYGHLHLSSTEANEFDGFYSCRPETFKPDDARDSSLLDGGRSSSMAWGNVVVVPFYRFQDTEVLGIL

SEQ ID NO: 107765 - protein, 164 aa, Glycine max
  Coding DNA Sequence Number=SeqID_16080
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPSDAPYP

SEQ ID NO: 107766 - protein, 86 aa, Glycine max
  Coding DNA Sequence Number=SeqID_16081
MTVPNEEPAHEVNYMGNQLRHNFNAGGFSVFLHGQQYNQQQGQWRNHLGNPFNKDQGGPSTRPQQQGPSLYDRTTKLEETLAQFMQ

SEQ ID NO: 107767 - protein, 32 aa, Glycine max
  Coding DNA Sequence Number=SeqID_16082
MGLSLVLFIVLPLVLALMVDEGKGRKRGWEGW

SEQ ID NO: 107768 - protein, 130 aa, Glycine max
  Coding DNA Sequence Number=SeqID_16083
MKAAWKSQLRKKERPFPLILDELGHDALQVHRVAHALWHYRRKVLTLALQSRVSEINKAEDLDLGIVGLDTFSEHGQMSYRMSRHHASEHADCMCPYEQIKQVNNTRELLTQFGATSPTSGGYQAREEIH

SEQ ID NO: 107769 - protein, 87 aa, Glycine max
  Coding DNA Sequence Number=SeqID_16084
  Homolog annotation: Hit_ID=A6FJQ2; Match level="QueryCoverage=43%, HitCoverage=84%, E-value=3e-11, Identity=92%"; Hit description=50S ribosomal protein L5
MPGTDKPVRARQRLLPGCRGWLNYAASEQIMRKEKIPHQAPFAIQAAQLLGRAIGAGLFAITPAGERGMCCKAIKLGNARVFPVTTL

SEQ ID NO: 107770 - protein, 127 aa, Glycine max
  Coding DNA Sequence Number=SeqID_16085
MRLSIWTIKRAVMRLLILRMLCCLGLILSLPACAGPANLRVIGHGMPDVDLDNAIYEVPVKSGVTYQDLIDSLKSISEGMNFVNPANFPIGDHMKQRGQDPQGVKEVRTFCNLSMGTEIILDHPEFL

SEQ ID NO: 107771 - protein, 186 aa, Glycine max
  Coding DNA Sequence Number=SeqID_16086
TLVSIATPLRLEFIPQVKELLDEGLVRKSLNPCALLVPKIGIIRHQIPMIGGMMNVLSGATLFRKITHAPNIFMICVHRDSLGRNNQHENKEKGMFYSITFLNFLNSDQGLPMDPKRIKVIPEWPTPPMLRKESMSFKNLVDLRSNPFHGVGNDAILPPPKALDRRLQEDWARDARVDPRSLMSPR

SEQ ID NO: 107772 - protein, 136 aa, Glycine max
  Coding DNA Sequence Number=SeqID_16087
  Gene Ontology: Mol. function=aspartic-type endopeptidase activity; Biological process=RNA-dependent DNA replication
  Homolog annotation: Hit_ID=Q5MG92; Match level="QueryCoverage=98%, HitCoverage=12%, E-value=2e-10, Identity=31%"; Hit description =Putative retrotransposon polyprotein
VKAQIEKKIEPYARYSNKGRKKIVIKSGDWGINYNAYKTALPLDYGESNTFSVTDLTLCDVGIFDINSRENSPQEGGYDRGLSKEEEFGLGGLNMDGPITRARSKRFQEELDERLNSLMEGREEEAQLIFFSQLLE

SEQ ID NO: 107773 - protein, 91 aa, Glycine max
  Coding DNA Sequence Number=SeqID_16088
LSLAHHWAKRASTAKRNFSVIEESGRASISRPHAKREISVLSTTVVFSQAQHTIGAKLKSTYSQDSRAHHSAYFGNRALEAAKGVAFAKIP

SEQ ID NO: 107774 - protein, 155 aa, Glycine max
  Coding DNA Sequence Number=SeqID_16089
MELIENMGASDHAILRDRTHVLTKRSLLELSSQDAILAQNKLLAKQLESLTETLSKLPTQLQVAQPFHSAVMQVGGCSICGGPHESGCCIPLDDVAKEVNYMGNQNRQGFHAGGFSGGQSTKPQNQGPNMYERTTKQEETLAQFMQVSMSNHKST

SEQ ID NO: 107775 - protein, 198 aa, Glycine max
  Coding DNA Sequence Number=SeqID_16090
  Homolog annotation: Hit_ID=Q5QJQ3; Match level="QueryCoverage=15%, HitCoverage=24%, E-value=4e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTLDREGMTINFLRGYRARIRNHGHSCFLRETCRASCINESANARGEAVCVLGALPLPRSLTRCARSFGCGERYQLTQRRSFAPSWAVCTNPPFSPTAAPYPVTIVLSPT

SEQ ID NO: 107776 - protein, 82 aa, Glycine max
  Coding DNA Sequence Number=SeqID_16091
MEKEKHVSYCSHDFCKSLSEELSDYYRGRHRSHPRAHSHMREKEGKPQEANINLPYYHGKDVEAMSSKVILMMPKNQELSKD

SEQ ID NO: 107777 - protein, 67 aa, Glycine max
  Coding DNA Sequence Number=SeqID_16092
MELSRYSNGHNFSLGCTIQANHISRRSYLINGSSREIEMVITFARMYDSGVSHIETLEIEQRKLSGN

SEQ ID NO: 107778 - protein, 84 aa, Glycine max
  Coding DNA Sequence Number=SeqID_16093
MCFREENPRRDTSVTLPLPTSIVQSCEFGMTSPLNESISCFLIRVDPWVLVPIALRGLHVLAFKGLHVLAFRGLHALAFTCPRL

SEQ ID NO: 107779 - protein, 72 aa, Glycine max
  Coding DNA Sequence Number=SeqID_16094
MYPLLVPQRMYRPMCWDKEFSGGKETNQKNSQRGHLNSLGKGEERHNRIQAVSPSFFWQREKRMKKMNNTNF

SEQ ID NO: 107780 - protein, 126 aa, Glycine max
  Coding DNA Sequence Number=SeqID_16095
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=1e-11, Identity=34%"; Hit description= UPI00006A17C9 related cluster
  Subcellular localization annotation: CTP_CleavageSite=20; ConfidenceScore=5.15e-01
VWIWSPLKVRTRSPLKVRVCSPTKVKAHDPLTVRTCSPLEVRECSLLMARTCSPLKVRACSPLLARTCIPLKVKARTYSPLEVRACSPLVVRTCSPLKARTCSPLEVRACSPLKARTCSPLEGEGN

SEQ ID NO: 107781 - protein, 74 aa, Glycine max
  Coding DNA Sequence Number=SeqID_16096
MAPELPKICFIPLRWRYAFHSAITEPWFNLIHDKNLTPRDEVAFYYRFHEHAWELLIRKTIEWDNNDTDFDFDD

SEQ ID NO: 107782 - protein, 225 aa, Glycine max
  Coding DNA Sequence Number=SeqID_16097
  Homolog annotation: Hit_ID=Q094X0; Match level="QueryCoverage=52%, HitCoverage=24%, E-value=6e-07, Identity=38%"; Hit description =Putative uncharacterized protein
VDPAVPGIGEAVAAGTSRHHAIEHVDAAHHRLHQVVGGSDAHEVARLGGRQVRLHGLDHREHHRLRLAHREAADGVALEIEIGQRPRALDPQLRHVAALDDAEHRLARLLAEGDAAALGPAQERCIAFSISGRSAGRRTHSSSCIWMSEPSSPWISMERSGLIRWAVPSICERKVTPSSSIFLSAESDITWKPPESVRMGPSQRMKRCRPPSRAIRSAPGRSIRW

SEQ ID NO: 107783 - protein, 399 aa, Glycine max
  Coding DNA Sequence Number=SeqID_16098
CFTFEDFQLVPTVKEFEGILGCPLGGRKPYLFSGSIPPRQELPGPWKIKANGLSFIDILVLLIFGVVLFPNMEGLVDLAVIDAFLAFHHGKESPVVAILVMYDTFDRGCEKSDARIFCCALALYVWLVSHPFLQEGRPVYPLQGHRSCVEKGKANWDQLLASMEGRLGCINPVLTIRQLGYPMRGVPSDESITPFIARGFGDHNARDRELRGSSNGIIGGYHKWLRVRTQGLDWLPNLKTVRDDEVKASEESDEVQALKAELERARVVEEKFKSIAIKESSRVKGMISEEVKGIITGQRHDLEGRAKGNMWAIIDKCKEKLNLAATHEQRLEDEYAKISAEREARERVIDSLHQEATMWTDRFALTLNRSQELPRLLAKAKAMADTYSAPKEIHGLLSY

SEQ ID NO: 107784 - protein, 108 aa, Glycine max
  Coding DNA Sequence Number=SeqID_16099
DGAECGHGWYQLALAASRSRGIPRGGINTLGANAGSALARLGRTGGAERANSGAAAAAPAEQHRERLALVLATLIEPVACRGRIAGRSTMLNHAPGAATAGDWPLRPI

SEQ ID NO: 107785 - protein, 84 aa, Glycine max
  Coding DNA Sequence Number=SeqID_16100
MRELSQLVIQQQVSDRWVWKPEPNGLYSTRSVYKLLQGKPGLQRYMGSQDRRECTIQWNQAAGGCCVFALDVAQTYGERFFYAL

SEQ ID NO: 107786 - protein, 202 aa, Glycine max
  Coding DNA Sequence Number=SeqID_16101
LLKDRLSTKGNLLRRNVAIQDVGCPLCGEVQEEVAYPANHFAQFCDGFGANINHSIWSGWWVALTSTIWQHRNLLIFQGNSFDSSKVMEEAMFLVWSWLKAKEKGFNITFNHWSSNISESFEQAQEVALVCIKNKLKRLLKRLALTDPLKLLQEHNKGKGNFTKEKKHRVVTMLELNMRYPSHEKKHRLLTMLECDEHDARP

SEQ ID NO: 107787 - protein, 377 aa, Glycine max
  Coding DNA Sequence Number=SeqID_16102
  Gene Ontology: Mol. function=transcription regulator activity; Cellular component=nucleus; Biological process=regulation of transcription
  Homolog annotation: Hit_ID=A7QN80; Match level="QueryCoverage=84%, HitCoverage=81%, E-value=1e-35, Identity=32%"; Hit description =Chromosome undetermined scaffold_131, whole genome shotgun sequence
  Pfam annotation: Domain name=HLH; Domain location=248-297; Score =34.9; E_value=3e-07; Accession=PF00010.17; Description=Helix-loop -helix DNA-binding domain
MRRSVSGVHTWEICRPSNKMRPILVLWHTHLQLGQRIPFFNRSRTTCRQRSMSSVWCGPKMYEESSCYDPDAMMAEGAEDCFPQMVSESEAVMSATPTQTHTHNTFAYSYSCGEDAANANGPIAMEHPQQNPYNYSNTQFVEELYSNQQFTYHTPTPDLLDLLHLPNPIPGDNRTNVSSVSYDPYLHLNLQQQQQPTLRELLPHMPALRNDFPFGGAAGGDDIQDFGNGLVDFTQQEVGKRRGGKRTKQFTSTTTERQRRVDLSSKFDALKELIPNPSKSDRASVVGDAINYIRELKRTVEELKLLVEKKRLEKQRVMMRHKVETEGESSNLDPAEYSESLRSSWIQRKTKDTEVDVRIVDNEVTIKLVQRKKIDCL

SEQ ID NO: 107788 - protein, 98 aa, Glycine max
  Coding DNA Sequence Number=SeqID_16103
MFQRWILLDELVTGKNEGSGGSEEAKERCGFVAAEGSYFVFVWRETEIYCGFVAAELMQKKRTIYIFYLGQSGGKERWCRPLTPSLILPTNTNLKPIN

SEQ ID NO: 107789 - protein, 327 aa, Glycine max
  Coding DNA Sequence Number=SeqID_16104
VDSRGSHLRRALQVHADVGAHRVAHGIHGVVRLVAVDRPVPQVVGVELDSPHLADRDVRRDLEPLALGRDPAAVGARDLEVDAVHVDRVVGHGQVAEAHPHLVALARDHGFDARPDPAVEAPHVHVEHRVDLGHVGPGLDVVGVQEPDEVAVDPPLGGIARMHDEEAHHAHNHLDHLVRVRVVHEGARAPQDELVDEGLARRDAGLVQARHPVHPVGQGLAVPVDGGRLRQLVGDEDADLVALDRLDGRPGRLPVIAPEMRLHPGGHLAHDRLGHEMELLPVPAHAPRQRPAVERHHRLVVHPGGRHERRLRRRLVHRGRLGQAGAL

SEQ ID NO: 107790 - protein, 74 aa, Glycine max
  Coding DNA Sequence Number=SeqID_16105
MWTTTGKIGEELATQLAQASKGCFLQKYSLPGRKGSGRPQLSKKLRKLTDCAKTPLFDFLHITKFHGSRKPPSF

SEQ ID NO: 107791 - protein, 109 aa, Glycine max
  Coding DNA Sequence Number=SeqID_16106
  Homolog annotation: Hit_ID=Q8H6W2; Match level="QueryCoverage=52%, HitCoverage=63%, E-value=2e-07, Identity=48%"; Hit description=Gag -protease polyprotein-like protein
MASSNFPFPEGNSINRPFVFNDEGYHYWKTRMQIFIEAIDLNIWEAIEFGPFIPTMVVENATIEKPREEWDDDERRMENPARGISKKRKHTSLGKIMTWILQVIQKIKS

SEQ ID NO: 107792 - protein, 20 aa, Glycine max
  Coding DNA Sequence Number=SeqID_16107
MNRFFWTMETSASLRQAATA

SEQ ID NO: 107793 - protein, 129 aa, Glycine max
  Coding DNA Sequence Number=SeqID_16108
  Gene Ontology: Mol. function=phosphoprotein phosphatase activity; Biological process=intracellular signaling cascade
  Homolog annotation: Hit_ID=A5C0F5; Match level="QueryCoverage=87%, HitCoverage=18%, E-value=1e-17, Identity=41%"; Hit description =Putative uncharacterized protein
MERVDNDNQHIGNDDLRVFHCKLDLMKRHEEPYTATMMAALPPICVVGSVAWFAVVPLICFHVVEWHQPDRVLRQFGLQQPILGCPSQPQNLHGIMLKGKQDENWFHLLAPMISQWNNRVEFRVDVYPR

SEQ ID NO: 107794 - protein, 85 aa, Glycine max
  Coding DNA Sequence Number=SeqID_16109
MSLPSVVHVSSTFESGAPRMSLPSAVRQFSILHFFSEPHEGHYLALFMHPPPKEFGAMLHECLSVDPLVQSSILHFFRSPMNVIA

SEQ ID NO: 107795 - protein, 72 aa, Glycine max
  Coding DNA Sequence Number=SeqID_16110
MFSWPNKWEHTSFDENPEIGQIQAKGPSGEGQRPRLIKVILVASTQTYLPSPEVASTLTYLPSSEVASSKPS

SEQ ID NO: 107796 - protein, 291 aa, Glycine max
  Coding DNA Sequence Number=SeqID_16111
  Homolog annotation: Hit_ID=UPI00006A2D9E; Match level="QueryCoverage =51%, HitCoverage=77%, E-value=1e-10, Identity=16%"; Hit description =UPI00006A2D9E related cluster
GLHALAIRGLRVLTFRGLHALAIRGLHVLTFKGLHALAIKGLHVLTFIGLHALTFRGPHVLTFRGLHALAIRGLHVLTFVGLHALTFRGLHVLANRGLHALTFRGLHVLANRGLHALTLRGLHALTSRGLYILALRGLHALTFRGLRVLIFHSFLLTVPGPPPNIGGGPTVQAQPEREAITQLLCIPGQDFTRAAAKRRQHSAQRPQCQSPPAKVSVGLCRPDVGIAPTKTPSGPEKVKQGPGVSSSGYGPLSVLQGARTPPARSRHHRDRACKTPSGPEEVQQGLGVVKL

SEQ ID NO: 107797 - protein, 111 aa, Glycine max
  Coding DNA Sequence Number=SeqID_16112
MPRQAQGDAPQATDAPPPPHQADPTGSLGMERYLQHLVRQQAANHQGQVQIHECLYQLGLNHFRAEVAWPGDWPEAQAREAPAGAPGDAEEARMDEEMTDLLGFLGGSGAT

SEQ ID NO: 107798 - protein, 97 aa, Glycine max
  Coding DNA Sequence Number=SeqID_16113
MTTLCKSRRKVSKGNNCQFCEIKTFPKGLPKVENKQNIQRKELQEALSFLKLCILIFVDLLMLVLSERNDTLSPLLMIIHVTVMSTYCPRFLRQWMP

SEQ ID NO: 107799 - protein, 164 aa, Glycine max
  Coding DNA Sequence Number=SeqID_16114
MSHHSTSVNDEGTSHKDPLSRILDELSSLKLWKEKQERKEKGKKRVEEISQDEREKIREEERRKIIKEMKREKHASYSSHNSCKSLSEELRDYYEGRHRSHLRPHSHRREKERKPQEANINLSYFHGKDNVEANLDWEIRVEQQLKKKSTSKSYGSHSYPKKDQ

SEQ ID NO: 107800 - protein, 138 aa, Glycine max
  Coding DNA Sequence Number=SeqID_16115
MANFESDYTRKLEKPLSVASLIPIAMAPSSARLTKKANMTRPLCEMETSQINLKLFSGGASQQMEECFSQSKNHYNTQTETSLISTNSLINIYCRVLLPIPHRRSLSFACDTTISVFLSHSLLACDIVATFILSCDHV

SEQ ID NO: 107801 - protein, 39 aa, Glycine max
  Coding DNA Sequence Number=SeqID_16116
MWVSRKRFPADFRREEKEKSDFRQEDDKEKREGKLTSVL

SEQ ID NO: 107802 - protein, 245 aa, Glycine max
  Coding DNA Sequence Number=SeqID_16117
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSITYGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107803 - protein, 84 aa, Glycine max
  Coding DNA Sequence Number=SeqID_16118
MWGANTFPVCKYNSRAFHLKFVDHVFFRFFRSLPQINVGGDSARIPFLEDAPVSHASPSHRRRDQPDEAVAVRLRPDVHHPTPA

SEQ ID NO: 107804 - protein, 128 aa, Glycine max
  Coding DNA Sequence Number=SeqID_16119
VLTFKGLHVLTFRGLHVITFKGLHALAFRGLHVLTFGGLHVLAFRKLHLLHFRGLHVLAFRGLHALAFSGLHIHTLIEFKVLCPAPTVRIQPEREAITQLLCIPGQDFTRATAKRRVRIMRTNMTTLT

SEQ ID NO: 107805 - protein, 32 aa, Glycine max
  Coding DNA Sequence Number=SeqID_16120
MSRNLARWRSLSFLEGDLCIQNTDSNSGYPIQ

SEQ ID NO: 107806 - protein, 52 aa, Glycine max
  Coding DNA Sequence Number=SeqID_16121
GEKVASAQDFGWPSKGEDHFRSWFLFFPYLVVTILHRSDIKLIDTVDLEGGP

SEQ ID NO: 107807 - protein, 80 aa, Glycine max
  Coding DNA Sequence Number=SeqID_16122
MIIISCQWKERVTMHTEKGHENSKRSTMVMKDERRIAKDKKLLGIIRNSPVVLQKVRKLRRFCNESHCVFGKLNLDYSIS

SEQ ID NO: 107808 - protein, 66 aa, Glycine max
  Coding DNA Sequence Number=SeqID_16123
  Homolog annotation: Hit_ID=Q1J7G7; Match level="QueryCoverage=62%, HitCoverage=55%, E-value=5e-09, Identity=78%"; Hit description =Transposase
ASRYQQGHQDLFILRSDIPSQWLPFLSAVPPVQLRTGWCVTAKAPPDISAGKCSGHAARKHHTRRA

SEQ ID NO: 107809 - protein, 129 aa, Glycine max
  Coding DNA Sequence Number=SeqID_16124
DRAHKTPSRPEEVQQGPGVSGSGYGPLSVLQGARSPSEESHPQRHPVDPEKSNRDLGFPALVTGLCSPTGCPFPRARSCHHDIGKYAPARHPVDSKKSNKVLELSSSNYGFLSVLRSTCHLQQGHQAPY

SEQ ID NO: 107810 - protein, 16 aa, Glycine max
  Coding DNA Sequence Number=SeqID_16125
MENCTKQSLRMAPNSK

SEQ ID NO: 107811 - protein, 184 aa, Glycine max
  Coding DNA Sequence Number=SeqID_16126
  Gene Ontology: Mol. function=pyridoxal phosphate binding; Cellular component=cytosol; Biological process=peptidoglycan biosynthetic process
  Homolog annotation: Hit_ID=A4WBF1; Match level="QueryCoverage=100%, HitCoverage=51%, E-value=5e-88, Identity=84%"; Hit description =Alanine racemase
  Pfam annotation: Domain name=Ala_racemase_C; Domain location=60-184; Score=219.3; E_value=9.2e-63; Accession=PF00842.12; Description =Alanine racemase, C-terminal domain
MVRIEQAAEGLDCPRSLSNSAATLWHPEAHYNWVRPGIVLYGASPSGQWQDIANSGLKPVMTLRSEIIGVQTLKAGDTVGYGSRYRATGEQRIGIVAGGYADGYPRIAPTGTPVWVDGVRTGTVGTVSMDMLAVDLTPCPQAGIGSPVELWGNEIKIDDVAAAAGTVGYELMCALAPRVPVVTV

SEQ ID NO: 107812 - protein, 309 aa, Glycine max
  Coding DNA Sequence Number=SeqID_16127
  Homolog annotation: Hit_ID=Q2HW90; Match level="QueryCoverage=55%, HitCoverage=39%, E-value=7e-27, Identity=38%"; Hit description =Putative uncharacterized protein
AKVLASQGEWAPFIDILALLIFGVVLFPNVDGLVDRAAIDAFLTFHDRKESPVVTILADLYDTFDRRCEKNSARIVCCTPALYVWLVSHLFRQEFPRWKEGRTGILISCGGFPNVPLMGTRGCINYNPILAMRQLGYPMRGAPLEESLTPIIARGFNSTNAGVFQKVRKAWEMVQKKDKELKGSSNGPIGGYHRWLKAYAQGLDWLPNLRTTKRVEVETLEEDEEIQVLKTELEKAQTVKEKFKSAAVRIRKENAELRDINIATAKALEQETKRAHREEHGRNKFRGALWGSNSELKLRRKEKDQSGIL

SEQ ID NO: 107813 - protein, 120 aa, Glycine max
  Coding DNA Sequence Number=SeqID_16128
  Subcellular localization annotation: CTP_CleavageSite=50; ConfidenceScore=5.11e-01
MAQIQPTILLMNALNWATVYQASGVGECRMYTRRKKQKTSVAAAQTTKKQAMVVGSSSRKQKAVQENDEDLDVEENIDVESEEEEIMVNFEASDGEEGEGDAPLPYDNNEDDYVGIGEDD

SEQ ID NO: 107814 - protein, 56 aa, Glycine max
  Coding DNA Sequence Number=SeqID_16129
MRAIEGGENYAFFDMAELYLVLDVVIPLKFKVPDFDKYKWNGEGRKMIGDPTSRRR

SEQ ID NO: 107815 - protein, 124 aa, Glycine max
  Coding DNA Sequence Number=SeqID_16130
  Homolog annotation: Hit_ID=Q6UUU1; Match level="QueryCoverage=48%, HitCoverage=40%, E-value=9e-19, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNSLQAGLYARTPVQSDRCALS

SEQ ID NO: 107816 - protein, 119 aa, Glycine max
  Coding DNA Sequence Number=SeqID_16131
  Homolog annotation: Hit_ID=Q2HW89; Match level="QueryCoverage=29%, HitCoverage=3%, E-value=1e-08, Identity=80%"; Hit description =Integrase, catalytic region; Ribonuclease H
MDPVKYISEKPALTGRIARWQVLLFEFDIVYFTQKPGGSTSSRAAATAVELQFALYWRNSEEARTDRPSQQLRSLNGEWDAPCSGALSAAGVVVTRSVTATLASADVRRCFCRYAPPRQ

SEQ ID NO: 107817 - protein, 288 aa, Glycine max
  Coding DNA Sequence Number=SeqID_16132
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIAIHPKNTGKRDQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107818 - protein, 103 aa, Glycine max
  Coding DNA Sequence Number=SeqID_16133
  Subcellular localization annotation: CTP_CleavageSite=29; ConfidenceScore=5.50e-01
LPSLVTDVWGANTFPARKYNSRTFHLKVRRSRLFRFFRRFPQINVGGDSARIPFVEHASRESRVALPPKGRLRHLLRTSSGQRSHGLEIGLRPRQERHQQGHQ

SEQ ID NO: 107819 - protein, 170 aa, Glycine max
  Coding DNA Sequence Number=SeqID_16134
  Gene Ontology: Mol. function=helicase activity; Biological process =viral genome replication
  Homolog annotation: Hit_ID=Q2A9I1; Match level="QueryCoverage=70%, HitCoverage=8%, E-value=1e-24, Identity=43%"; Hit description =Putative uncharacterized protein
MFMPDTFLPVKLLGEFLVFQYMLGSLLLKDYISIFQANTVFFMRTMKEGYNIGRLIWVPPTTGELFYLRMMLTACKGATSFEDIRTVTNIQYPTCREACFAMGFLQYDKEFIEAIKEAKDWGTTNYLRKLFVLMLLTGAINKAEEVWNQTWHWLADDIAYHYSKSTINTN

SEQ ID NO: 107820 - protein, 105 aa, Glycine max
  Coding DNA Sequence Number=SeqID_16135
MTHYNPYPRKQKRKEGKFPIKEKAKRKEKKFPIKEWGKEKKREGRKISNQRKKERKEIPNQRVGERKKKRKKIPNQRMGESKKEGSSWSKKPEEMCREVFGPDNI

SEQ ID NO: 107821 - protein, 284 aa, Glycine max
  Coding DNA Sequence Number=SeqID_16136
  Homolog annotation: Hit_ID=Q6WAY6; Match level="QueryCoverage=27%, HitCoverage=13%, E-value=7e-10, Identity=40%"; Hit description =Putative uncharacterized protein
MGTNQNGKRFYQVKVKSLDVTSLKELGRLMGPLQRQAFRKVYGKILDLTVAEVFTEAVVSLAQYYDQPLRCFTFGDFQMSKIAAVVGDSAKELDRMKQTRNDIVVLPRKYLEVVLFPNVDGLVDLATIDAFLAYHHSKESPVEGKEGVLFSCGDYPNVPLIGTRGCINYNPALAIRQLGYPMRGAPTEESLSPFLVRDLGAQSLQVIQRVHKACRSPLKKDKELRGIRNGVIGGNHGWLRVHTRGLDWLSKLKVINEENFEALEEDEEVQALKLDLGKARLAKE

SEQ ID NO: 107822 - protein, 99 aa, Glycine max
  Coding DNA Sequence Number=SeqID_16137
MAKFDPDIVIEFYANAWPTEEGKCEYGQRRNRANGFDEEAIAQLLCIPGQDFARTAAGRRVRMMHTNMTTLTQTWMTLLLSNILPSDHNSDLPLSKCQL

SEQ ID NO: 107823 - protein, 133 aa, Glycine max
  Coding DNA Sequence Number=SeqID_16138
  Subcellular localization annotation: CTP_CleavageSite=45; ConfidenceScore=5.31e-01
MVKVGTSYVPINVSFSKSWPSFPVSTGTPKSDLFLETSPSHHQLIAQMRVNFELQWRIWFLSAVFLFSDCYGVVRNSAKAPAGHQRGKCKAGVLSELTTTPAALNCVAATGRCPFAISGCATVGKRASVRLLH

SEQ ID NO: 107824 - protein, 265 aa, Glycine max
  Coding DNA Sequence Number=SeqID_16139
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWPRLSHSTPDTQFR

SEQ ID NO: 107825 - protein, 154 aa, Glycine max
  Coding DNA Sequence Number=SeqID_16140
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=69%, E-value=2e-24, Identity=69%"; Hit description=LacZ protein
MGATLMATTSILLCSGLAAVISSTYSVKKPLNDAVPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107826 - protein, 263 aa, Glycine max
  Coding DNA Sequence Number=SeqID_16141
  Gene Ontology: Mol. function=structural molecule activity; Cellular component=flagellin-based flagellum basal body, distal rod, P ring; Biological process=ciliary or flagellar motility
  Homolog annotation: Hit_ID=A8GG24; Match level="QueryCoverage=100%, HitCoverage=71%, E-value=1e-123, Identity=88%"; Hit description =Flagellar P-ring protein precursor
  Pfam annotation: Domain name=FlgI; Domain location=7-263; Score =417.3; E_value=2.2e-122; Accession=PF02119.7; Description=Flagellar P-ring protein
LPATAERIRDLVTVQGVRDNALIGYGLVVGLDGSGDQTMQTPFTTQSLSNMLSQLGITVPPGTNMQLKNVAAVMVTAKLPPFARAGQNIDVVVSSMGNAKSLRGGTLLMTPLKGVDNQVYALAQGNVLVGGAGAAAGGSSVQVNQLAGGRISNGATIERELPTTFGSGGVLNLQLNDEDFTLAQQISDAINRQRGGGTASPLDARTIQVLVPQGNSSQVRFLAEIQNINVNVGAMDAKVIINSRTGSVVMNREVILDSCAVAQ

SEQ ID NO: 107827 - protein, 169 aa, Glycine max
  Coding DNA Sequence Number=SeqID_16142
  Pfam annotation: Domain name=G-patch; Domain location=2-41; Score =25.4; E_value=0.00016; Accession=PF01585.14; Description=G-patch domain
MARVMLGNGYEPGMGLGKDNGGITSLINAKGNRGKYGLGYKPTQADIKRNIAGRKSGGQSSRLRQESEGSPPCHISRSFISAGLGDEGQVVAIYEDDVPSTLDLDLSSSVPTSLPILIHLHVYFFISETADPMTSPPKVLIPGTRLSTSSKKRIKRKMKGTRMWDFPQN

SEQ ID NO: 107828 - protein, 207 aa, Glycine max
  Coding DNA Sequence Number=SeqID_16143
APLEEEITPVISRGFNKTNVETLQKVCKAWEVVRRKDKKLRGSNNGPIGGYRKWLRAHVQGLDWLPSLRTTKRKEVEAPEDDEEVQALRTELKQTQTVKERFKSAALKIRKENAELRDINTATTKALEQETKRACREEHGRNKSARVEEGQHGGHERANDHNDGGHDEHEEDNGSQCGAVAATSAIAKVNPMPPSGLNQMNHPTSAR

SEQ ID NO: 107829 - protein, 94 aa, Glycine max
  Coding DNA Sequence Number=SeqID_16144
MALNHTPESKVTPFEFIKSFCCSISCVSIYDEDMTKSKDKDPLEGLGGPMTRARARKAKETLQQVLSILFEYKPKFQGEKSKVVSCTMAQMEED

SEQ ID NO: 107830 - protein, 82 aa, Glycine max
  Coding DNA Sequence Number=SeqID_16145
MEKSEKKSFSEKKVKKAYITRDDNDMESYEDSENEVINLCLMAKSYESDEEVTSSNNNLSISFDELQDAFTDLQRESIKLAK

SEQ ID NO: 107831 - protein, 54 aa, Glycine max
  Coding DNA Sequence Number=SeqID_16146
MTLRRKDFQVQAIGQFAQATCAPEFGLPRPFNQRLLVLHVGGGCRKTMSKVQNK

SEQ ID NO: 107832 - protein, 161 aa, Glycine max
  Coding DNA Sequence Number=SeqID_16147
MSSKVILMMPKTQESSKIQRFKNQVSIIKIQDSRIKFQESRFKNNQDQDSRLKIQESREDSIKIRYILCGTSRGYIYLGIVILRTREGTSLVDQFKWRVHPLGFSKRTRDGTSLVDLWLLKDFTRLKEISETAGCLGTGCRYGLWPNQYKSCICLLLPYTL

SEQ ID NO: 107833 - protein, 118 aa, Glycine max
  Coding DNA Sequence Number=SeqID_16148
MARSAPDVVATADAGVTHSAKFFCHFAKYLFAPGLQALVAEIVLIGFIQGESDKQLAVGNDRFLTGELVSFGWPVADKRRPFRYQFVMQHAKCIKKPFAVAQLIAHAVHRNDFAVEID

SEQ ID NO: 107834 - protein, 58 aa, Glycine max
  Coding DNA Sequence Number=SeqID_16149
MGVQIAPRPTWALHPPPPEGSEALPKRFHNVFREEFRKDFNRSSTFFIRSSSFFDLQR

SEQ ID NO: 107835 - protein, 50 aa, Glycine max
  Coding DNA Sequence Number=SeqID_16150
MFERLLLEFKFGCPMRNTLHLGSMENTFQRNGPEEACLKEVQEGQGGRRN

SEQ ID NO: 107836 - protein, 182 aa, Glycine max
  Coding DNA Sequence Number=SeqID_16151
MTLLVSNILPSDRNANLPLQKYQLVCVVPTWVGIAPTRHPVDLEKSNRALGFPALVTGLYQSYRVPVPPRQGHVIIGIAPARHPVDPKKSNRVLELSSSNYGSLASGPPTNRAFIKKCCAPRQAQGETPQQHWDGRQQATDAPPSPLEFTSAHPQKGLSIAYTTWPTNRRPSPKPNDAPSCS

SEQ ID NO: 107837 - protein, 187 aa, Glycine max
  Coding DNA Sequence Number=SeqID_16152
  Homolog annotation: Hit_ID=A5B939; Match level="QueryCoverage=67%, HitCoverage=78%, E-value=9e-14, Identity=45%"; Hit description =Putative uncharacterized protein
MSRRARRSLQNPGREPGRSGRRCRSWCLPILETAQREVGSCGWKSTARRVLSGAPPVALENPEDRVPPTPGRTHNRIRSPRQGKSAKWIRNLGKRIGSEGWARGSQSRSRRLSVDCSSCFRGESASSRAGRGTDWERALRGLFPGRRTVNSELRGTAPLFGPKVGFGRSIRAEDIVRWGVWLGRHIR

SEQ ID NO: 107838 - protein, 267 aa, Glycine max
  Coding DNA Sequence Number=SeqID_16153
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=19%, HitCoverage=50%, E-value=2e-23, Identity=100%"; Hit description=LacZ protein
MTPVNRKAGTGERTREPPGGNAGIFIVLSGFATTDLSVRFRDACQGGGAYGKTALPRPSHFPVKYLPGIFQEISAPFPFFSCHMKHFTDTLISANIETAMTMITPSSKLTLTKGNKSWYRAPPRGRRHCRRHCHPDPAAAAGGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107839 - protein, 36 aa, Glycine max
  Coding DNA Sequence Number=SeqID_16154
MWEGCDLISGSRIKDLLILASLANTTTMTSRLYIVE

SEQ ID NO: 107840 - protein, 233 aa, Glycine max
  Coding DNA Sequence Number=SeqID_16155
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGHAARRVPFAIQAAQLLGRAIGAGLFAITPAGERGMCCKAIKLGNARVFPVTTFRLMFEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107841 - protein, 286 aa, Glycine max
  Coding DNA Sequence Number=SeqID_16156
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTLRADQRLISPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMNAHQSLKGHGLHIRVPVILLSLRSPSVVFLGQAELTSTRCIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107842 - protein, 274 aa, Glycine max
  Coding DNA Sequence Number=SeqID_16157
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIIYGYKRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107843 - protein, 137 aa, Glycine max
  Coding DNA Sequence Number=SeqID_16158
MGLVLELNPNTLLLQMMTIHAWCPCLTLESLKKSRSLIMLNSFTWLHHRAPILLNFIFWKHPVATCPSRASEGEAHGCAFQRRKDARSRHQRLFVENVGKNRRKPVKMKILSSGVVFTLEEGISTSHVCLKGQQPIF

SEQ ID NO: 107844 - protein, 113 aa, Glycine max
  Coding DNA Sequence Number=SeqID_16159
MIMRGQDIYSSQDEATTSPSSSESEKAKGEESSEEIYPQEEGQPLVVKEKCKEGPISDQGVPMNPKRIKVIPEWPTPPTPLIELVRNHVPSCKDTQEMGVLRKKAQSFKNLGI

SEQ ID NO: 107845 - protein, 271 aa, Glycine max
  Coding DNA Sequence Number=SeqID_16160
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLILPSGNMDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107846 - protein, 98 aa, Glycine max
  Coding DNA Sequence Number=SeqID_16161
NLARLGELDGHHTPRVVEKWDSGASGTPVMLPKQPSSPGRAKVAWVSWAATSSPFFPINRLKGAVLKIPQPPGYVFQLKSVKVFVRSSSFFIRSSFFN

SEQ ID NO: 107847 - protein, 88 aa, Glycine max
  Coding DNA Sequence Number=SeqID_16162
MLTYFLYNLHLLFHLKVSEISFLNSRLFPHADDPLLQETSFELVEHRLSAGVGGHAELHPPVRGVAVTAYHATEMLADAEGLGHALHC

SEQ ID NO: 107848 - protein, 42 aa, Glycine max
  Coding DNA Sequence Number=SeqID_16163
MDKSLKVGEDEWKEREGGGHEIYASNKPTNPRSSQRFSTKCA

SEQ ID NO: 107849 - protein, 204 aa, Glycine max
  Coding DNA Sequence Number=SeqID_16164
  Pfam annotation: Domain name=G-patch; Domain location=81-125; Score =4.1; E_value=0.06; Accession=PF01585.14; Description=G-patch domain
MVVRAFDGSRREVMGEIDIPIQIGPHTCNVSGEENMLVSCPSSTLYVEAAEESLETAFQSFEMVSCASMEMSPLLPCLSNAALMVVRVMLMHAYEPGMGPGKDSHGNADVVDIKGNPYKYGLGYETGKPRRRNAPSRLRADRTWPGHVIQCFTSAGIMFEEEVAAIAEESPQDPPSFVRPCHANSQMGNWRVMSQSEAYTTDSM

SEQ ID NO: 107850 - protein, 140 aa, Glycine max
  Coding DNA Sequence Number=SeqID_16165
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=73%, E-value=1e-25, Identity=70%"; Hit description=LacZ protein
MVLWELMVRHQLHMITSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107851 - protein, 101 aa, Glycine max
  Coding DNA Sequence Number=SeqID_16166
  Gene Ontology: Mol. function=iron-sulfur cluster binding; Biological process=metabolic process
  Homolog annotation: Hit_ID=P0AEI3; Match level="QueryCoverage=100%, HitCoverage=21%, E-value=3e-51, Identity=100%"; Hit description =UPF0004 protein yleA
  Pfam annotation: Domain name=TRAM; Domain location=5-67; Score=97.1; E_value=5.5e-26; Accession=PF01938.11; Description=TRAM domain
MAWSRRMLGTTQRILVEGTSRKSIMELSGRTENNRVVNFEGTPDMIGKFVDVEITDVYPNSLRGKVVRTEDEMGLRVAETPESVIARTRKENDLGVGYYQP

SEQ ID NO: 107852 - protein, 114 aa, Glycine max
  Coding DNA Sequence Number=SeqID_16167
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=57%, HitCoverage=52%, E-value=1e-25, Identity=87%"; Hit description =Putative uncharacterized protein
MAFQYPVAIPGVTIVNESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107853 - protein, 256 aa, Glycine max
  Coding DNA Sequence Number=SeqID_16168
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 107854 - protein, 217 aa, Glycine max
  Coding DNA Sequence Number=SeqID_16169
  Homolog annotation: Hit_ID=Q6UUU1; Match level="QueryCoverage=27%, HitCoverage=40%, E-value=2e-18, Identity=78%"; Hit description =Putative uncharacterized protein
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107855 - protein, 67 aa, Glycine max
  Coding DNA Sequence Number=SeqID_16170
MAERGGEGNRPPRRTLGDYAYQQGPKHYNIIAIPPFSNKVVELKPALLSPIGSHPFAGMDHEDPYTH

SEQ ID NO: 107856 - protein, 196 aa, Glycine max
  Coding DNA Sequence Number=SeqID_16171
  Subcellular localization annotation: CTP_CleavageSite=57; ConfidenceScore=5.22e-01
MTTLTWIWMTSLFSNILPSDHNANLPLQMYRLGSRPQDAQWARRSPTRPWGFQLWLRASVVLQGARPPSEESRPQDAQWARRSPTGPWGFQLWLQASVCPTGCPFPPTRSRHHRDHACKTPSGPEEVQQGLGVFYGVLVTSGKGIRPPTNRAFIKKYCVPRQAQGETPQQPGDGRQRATDALPSPLEFTSAHPQKG

SEQ ID NO: 107857 - protein, 131 aa, Glycine max
  Coding DNA Sequence Number=SeqID_16172
MWMDRFALTLNGSQELPRLLAKAKAMADTYSAPEEIHGLLGYWNNTITKRATRHPYRTRSKSRMMGDQEETQEQMKADMSALKEQMASMMEAMLGMRQLIEKNVATAAAVSSAAEANPTLLAIAHHPPSNI

SEQ ID NO: 107858 - protein, 74 aa, Glycine max
  Coding DNA Sequence Number=SeqID_16173
  Homolog annotation: Hit_ID=A5BW26; Match level="QueryCoverage=48%, HitCoverage=1%, E-value=2e-09, Identity=75%"; Hit description =Putative uncharacterized protein
MHVEKNVCDSVIGTLLNIQGKMKDGLNTCQDLAQMGFDDTPQSKSKAVARWIVVKYFNDARPLEPKTLKALRIQ

SEQ ID NO: 107859 - protein, 216 aa, Glycine max
  Coding DNA Sequence Number=SeqID_16174
  Homolog annotation: Hit_ID=Q2CDM2; Match level="QueryCoverage=50%, HitCoverage=29%, E-value=5e-20, Identity=47%"; Hit description =Putative uncharacterized protein
TPSAPGRSSRFCCRECRAGSVRRRAAANGREREYPLAGSSLAEKAAAAGWRAPKRSCLNPIHPPGPAFHRAGSAASGAGSSYTALFGSKASRTASPIKISSDSSTATERKAAMPNHGACRLFLPCSSSSPSDGEPNGNPKPRKSSEVRVVMELHRINGRKVSVATTANSALTTPTSAIQPNRTVMPNSHQKLGCTTLESRMIRNSVGMPDQTSIIR

SEQ ID NO: 107860 - protein, 276 aa, Glycine max
  Coding DNA Sequence Number=SeqID_16175
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGIRSPSMQMRGRLLAVLAIADPVRFESASVIVALEKRGIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107861 - protein, 94 aa, Glycine max
  Coding DNA Sequence Number=SeqID_16176
  Gene Ontology: Mol. function=cysteine-tRNA ligase activity; Cellular component=cytoplasm; Biological process=cysteinyl-tRNA aminoacylation
  Homolog annotation: Hit_ID=A7R3J0; Match level="QueryCoverage=82%, HitCoverage=15%, E-value=5e-31, Identity=80%"; Hit description =Chromosome undetermined scaffold_528, whole genome shotgun sequence
  Pfam annotation: Domain name=tRNA-synt_1e; Domain location=20-94; Score=-218.9; E_value=0.031; Accession=PF01406.10; Description=tRNA synthetases class I (C)
MAEEQGEFRIYNSMTQQKEIFKTKVPGKVSMYVCGVTAYDFSHLGHARAAVSFDILFRYLKHLGYEITYVRNFTDVDDKAICTYVVAVAVAFPS

SEQ ID NO: 107862 - protein, 55 aa, Glycine max
  Coding DNA Sequence Number=SeqID_16177
MAHYGILESSDEEIKSALQHWRFLFIKSAYEENNSALVQISEVLVHQKFLFAVLL

SEQ ID NO: 107863 - protein, 145 aa, Glycine max
  Coding DNA Sequence Number=SeqID_16178
MRLLQRAQLAAKTIRAVRHSNERVGYGYCLPNPLSRLLNIFLYRYLISDGFEFIDGFEFIVPSSYPSGTRQILSGGRVRVRGRDGSSNLIPVSVPDFWLSGKTRTRTHTRSTRVLPVKVGTDSGGYPQIRVFFAISTCGDKSINI

SEQ ID NO: 107864 - protein, 81 aa, Glycine max
  Coding DNA Sequence Number=SeqID_16179
  Subcellular localization annotation: CTP_CleavageSite=48; ConfidenceScore=5.03e-01
MGKKPQSGRSVVVKGKLILPRSPQESRGGQAAANRSGIRKISQGKGPESTRVWKCSGPLRLKYLKRGRKKEYRMTLKECGK

SEQ ID NO: 107865 - protein, 428 aa, Glycine max
  Coding DNA Sequence Number=SeqID_16180
  Gene Ontology: Mol. function=metal ion binding
  Homolog annotation: Hit_ID=A9P9W8; Match level="QueryCoverage=91%, HitCoverage=96%, E-value=1e-117, Identity=58%"; Hit description =Putative uncharacterized protein
  Pfam annotation: Domain name=DUF789; Domain location=86-391; Score =473.5; E_value=2.6e-139; Accession=PF05623.3; Description=Protein of unknown function (DUF789)
MLGTGLNFGRARGEDRFYSPAKARRSLLTMENDKLRRAQSDVAASRSVRDKSVDSGNRIPENRVGSDEAKKSGAVPSCEPVANRLSNLERFLQAITPSVPAQCLPKRTTRGLRACGAEFQPYFVLGDLWESFREWSAYGAGVPLVLNDKDSVVQYYVPYLSGIQIYSQNVKPTVKSRQLGEDSDSDFRDSSSDGSSDSEPVHGRGLRNLPHLLEEVPQWMGGLSLRDHHSLPPDGFSSDDGESVNSQGYLIFEYLERDPPYSREPLADKIMDLAFQFPELVTLRSCDILPSSWISVAWYPIYRIPTGPTLKDLDACFLTYHSLYMPMGGSQRVQAPMPHPTEMDNVHKMSLPVFGLASYKFKGSLWTPNGGHECQRSLLQGADDWLRLHQMAILDEVGVNNIIDRRKMKNGEKMFSTVLGNFLYRFLP

SEQ ID NO: 107866 - protein, 49 aa, Glycine max
  Coding DNA Sequence Number=SeqID_16181
MADGPGRRDGMGVCGITIQKVRRGEEEKGGRGCREMRIERRGVKIAARL

SEQ ID NO: 107867 - protein, 168 aa, Glycine max
  Coding DNA Sequence Number=SeqID_16182
  Gene Ontology: Mol. function=hydrolase activity; Cellular component =integral to membrane; Biological process=plant-type hypersensitive response
  Homolog annotation: Hit_ID=A7P3E6; Match level="QueryCoverage=85%, HitCoverage=41%, E-value=2e-49, Identity=60%"; Hit description =Chromosome chr1 scaffold_5, whole genome shotgun sequence
MASPGFFSFGRFWPPFQGQGGMRQQLDPSAHTMKSHGSALARKHVRDWLILLLLIVIEIVLFVIHPFKRFVGRDMMEDIRYPMKENTVPVWAVPLYAVLLPMAVFLLFYMRRRCVYDLHHSILGLLFAVLITGVFTDAIKNAVGRPRPDFFWRCFPDGVEVGKLSATV

SEQ ID NO: 107868 - protein, 93 aa, Glycine max
  Coding DNA Sequence Number=SeqID_16183
MQGPRNNKDPKGEFELGNWVVFKLRFWYWNCGICTTVSNSCCYASCWLTHLKCVCNTSHFGVLVVGGEAVVDGVDNGSDVCGDGGGEATREDV

SEQ ID NO: 107869 - protein, 499 aa, Glycine max
  Coding DNA Sequence Number=SeqID_16184
  Gene Ontology: Mol. function=amino acid transmembrane transporter activity; Cellular component=integral to membrane; Biological process=amino acid transport
  Homolog annotation: Hit_ID=A7P3E9; Match level="QueryCoverage=88%, HitCoverage=84%, E-value=0.0, Identity=77%"; Hit description =Chromosome chr1 scaffold_5, whole genome shotgun sequence
  Pfam annotation: Domain name=AA_permease; Domain location=34-494; Score=-44.8; E_value=0.00016; Accession=PF00324.12; Description =Amino acid permease
  Pfam annotation: Domain name=Branch_AA_trans; Domain location=98-415; Score=-343.0; E_value=0.078; Accession=PF05525.4; Description =Branched-chain amino acid transport protein
  Pfam module annotation: Pfam domain module=AA_permease::Branch_AA _trans; Domain location=34-494::98-415
MTAVHIIQNATSMSKFLQTLINHIGFCVKGRECNIGGMSVGIVKRLGGIVISSKDMKGESSAFTMIVALSMAEICSSYPTSGGLYYWSAKLAGPRWAPFASWITGWFNIVGQWAVTTSVDYSLAQLIQVIILLSTGGKNGGGYEASKYVVIAFHGGILFLHGVINSLPISLLSFLGQLAAIWNVLGVFVLMIVIPSVATERASAKFVFTHFNAENGEGINSKPYIFLLGLLMSQYTLTGFDASAHMTEETKDADRNGPKGIISAVGISIVVGWGYILGITFAVTDILYLLSEDNDAGGYAIAQVFYQAFKKRYGHGTGGIICLVIVAVAIFFCGMSSVTSNSRMAYAFSRDGAMPLSSLWHKVNKQEVPIYAVWLSVFISFCMALTSLGSIVAFEAMVSIATIGLYIAYAFPIFLRVTLARKHFVSGPFNLGRYGVVVGWVAVLWVLTISVLFSLPVSYPITIKTLNYTPVAVGCLLILVVSYWLISGRRWFKGPITNI

SEQ ID NO: 107870 - protein, 210 aa, Glycine max
  Coding DNA Sequence Number=SeqID_16185
  Gene Ontology: Mol. function=nucleic acid binding
  Homolog annotation: Hit_ID=A7P3F0; Match level="QueryCoverage=79%, HitCoverage=40%, E-value=4e-15, Identity=35%"; Hit description =Chromosome chr1 scaffold_5, whole genome shotgun sequence
  Subcellular localization annotation: CTP_CleavageSite=86; ConfidenceScore=5.46e-01
MHNKDACSPSSNGGFGGGASAGQIPSTGGLYSSLYSALSNENLPSLSASCSNGSGGGVSMYPYSESIQKHQDMVNRQSMCLNRLVETSKEVEALREENGLLRAANKELQKQLHLVIQASLENHYGGGDGGSSGQTQPTLFNVLHGFRGLHIGEGNKENYADWNNNNLNIMNNNNSNNKELQEISEESPTSVIENNNVVEVERFSLPKSIS

SEQ ID NO: 107871 - protein, 391 aa, Glycine max
  Coding DNA Sequence Number=SeqID_16186
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=rough endoplasmic reticulum membrane; Biological process=protein metabolic process
  Homolog annotation: Hit_ID=A7P3F6; Match level="QueryCoverage=90%, HitCoverage=91%, E-value=1e-127, Identity=60%"; Hit description =Chromosome chr1 scaffold_5, whole genome shotgun sequence
  Pfam annotation: Domain name=2OG-FeII_Oxy; Domain location=231-330; Score=5.5; E_value=0.041; Accession=PF03171.11; Description=2OG -Fe(II) oxygenase superfamily
MMSSQNENRSLEEAGPSGSSDGGVGVNWLCMSPKRDHNPENYDDLQFEFNPNLFASLEHYLPPHMLNLSRDVKLHYIRNILLRYLPENDRNWIQKLREYRLKIILNYPSLHKEIFTMDAENFFVPSFLRAIKENTEANFRSIMAEPCKGVYTFEMLQPQFCKKLMSEVDHFERWVHGTKLKIMRPNAMNKNKHGVILDDFAFEAMLDRFMCDFIRPISQVFYPELGGSSLDSHHGFVVEYGINKDVELGLHEDEAEVTLNVCLGKEFSGGELFFQGVRCDAHVTSNAQPEEAFNYSHVPGHAILHPGRNRHGARPTTSGNRMNLILWCRRHSSGQLLSASAFMLSHSSVFRELKRYQRDFYSWCGECKQKKAERVCLSVMATKQELLKSEI

SEQ ID NO: 107872 - protein, 703 aa, Glycine max
  Coding DNA Sequence Number=SeqID_16187
  Gene Ontology: Mol. function=protein binding; Cellular component =melanosome; Biological process=positive regulation of JNK cascade
  Homolog annotation: Hit_ID=A7P3H4; Match level="QueryCoverage=88%, HitCoverage=71%, E-value=0.0, Identity=79%"; Hit description =Chromosome chr1 scaffold_5, whole genome shotgun sequence
  Pfam annotation: Domain name=BRO1; Domain location=3-227; Score=3.2; E_value=1.5e-10; Accession=PF03097.9; Description=BRO1-like domain
MKSFCHGYGVIASYKFKLAHSEDNTSSNMSLQLDNFSNILEMNIDVSDVVGLQIGWVGIYYEEALAALNVAPLSQHFDKSWIVHVQLKAALFYAEACYRYGLELHDKEEIAEEIARLRSAVNVLTEAKKSSKGAAAQILDAIGKLEANINRNLERAVKENDRVYLMRVPSPSSLPPLPAFSMVKSMVMNEMLDASKEKMFASLVPDNSAKALSRYTEMVDDVIRTQAEKLQQASELTRVRLKEMELPESILALEGNFTLPTSLKEDVEAVQISGGPAGLEAELQQLKDLRRVNQELLVQTEELLQKEAREDSQFRSQFGTKWTRPQSSTLTKNLQDRLNRFAGNLKQAAESDGRIERSVREHSSLMSILDARPIESALPSLARPIMSFDQNEDAIVGSLKQSLRQLETLGAQRAGLEDMLKEMKRKDDILPKLMTSTGSYDDLFKKEIAKYDHICEEIAQNIEAQEQLLLQIQAQNDEFSVIFNLEDYKASREKAYKQIEAAIAKFREIKDNINEGLKFYVTLQDAITNVKQQSNDFVMTRNIQCREMIEDVQRQVAGLSFQDNKNTGVFNSNYPSVGSQNQRSNTQTDPPRPQTPYYQQQPVEQPPIPTYGHHPPPPYGSPAQHHQPPPPYHIPPSSTAPYPPAQVHHQPPPNHEYGQPAYPGWRGPYYNAQAQQPGSVPRPPYTIPSPYPPPHQSGYYKQQ

SEQ ID NO: 107873 - protein, 404 aa, Glycine max
  Coding DNA Sequence Number=SeqID_16188
  Homolog annotation: Hit_ID=A7NZF0; Match level="QueryCoverage=23%, HitCoverage=23%, E-value=9e-15, Identity=44%"; Hit description =Chromosome chr6 scaffold_3, whole genome shotgun sequence
MVKPQTTIHVTLAVTSLHQGHVSDLVRGHVLRRHFEERGERVPGSPHSAVALDESVVADDVGLVDGFEDALGGVNEGGVDQGVEEGVEDRERGVEIVVLHFAEEPEEFVDEGGGGEGGGEGVGGGEGEGEVGAAEGGEGAAEGGRVVEEEREEGDVAVEGVGVVRLRGGPGEEACGDEGVIVSVRVRVGEGAEGVGDEGGGEDDEELAAEGVEVGLHGGGPIEEGEDPWDPRGGVSGRRSGDGDVGEVAEGMHHFAGREEGCAERASSCIVRETSYVAQDEQWKCGYCDFVSECPAYNGGRKKKPKARKNTLLHRFRNKRGLFVTDVTKTEWCERQMEFFLFSEEWKNIEAKKMDFGGGRRNNEAIKAGEDDMAMKLVNFINGVNQFLFDRLTHELPILSFALH

SEQ ID NO: 107874 - protein, 121 aa, Glycine max
  Coding DNA Sequence Number=SeqID_16189
MVYMLFEDDKVFVEEVRVETRNNGKLEICRLETSLGWEHVDFAQVQSFYTALKKLRTPLPRDSSLCEGGMGEGCCTQPYPCICKEAVSGFEPMTNRSPRHNFTAAPRLALSFYTALFSKNA

SEQ ID NO: 107875 - protein, 845 aa, Glycine max
  Coding DNA Sequence Number=SeqID_16190
  Gene Ontology: Mol. function=drug transporter activity; Cellular component=membrane; Biological process=multidrug transport
  Homolog annotation: Hit_ID=A7P3G6; Match level="QueryCoverage=55%, HitCoverage=64%, E-value=1e-116, Identity=63%"; Hit description =Chromosome chr1 scaffold_5, whole genome shotgun sequence
  Pfam annotation: Domain name=MatE; Domain location=156-323; Score =70.6; E_value=5.2e-18; Accession=PF01554.9; Description=MatE
  Pfam annotation: Domain name=MatE; Domain location=342-496; Score =46.9; E_value=7.3e-11; Accession=PF01554.9; Description=MatE
  Pfam module annotation: Pfam domain module=MatE::MatE; Domain location=156-323::342-496
MASGLETICGQAYGGQQYQRIGIQTYTAIFSLILVSIPVSLLWINMETILVFIGQDPLISHEAGKFTIWLVPALFAYAILQPLVRYFQIQSLLLPMFASSCVTLIIHVPLCWALVFKTSLSNVGGALAVSISIWSNVIFLVLYMRYSSACAKTRAPISMELFKGMWEFFRFAIPSAVMDSYQIHNLKLQFCPFGILNTIATLYTIPFGIGAAASTRVSNELGAGNSHAARVAVLAAMSLAVIETSIVSATLFACRNVFGYIFSNEKEVVDYVTAMAPLVCISVILDSIQGVLTGIARGCGWQHLGVYVNLGAFYLCGIPMAALLAFLVRLGGKGLWIGIQSALNGGHLSYYSCFLVFYQIQNLKLQSYPYVTTTIYTIPEAIGSAASTRVSNALGGGSPQLAQVSVSAAMTLAASAAILVSSIIFACRQVVGYAFSNELDVVDYFTEMVPLLSISVILDTLHDTLSGIARGCGWQHRGAYVNLDAYYVVGIPIAAILGFCLQLRGKGLWIGILTDMGVRLKKEKEQLNLLLGSHLTTIHETLSSSESLSYPPKVTWDDVIKITVGAGPTLSSSVHSSLKQVVDEGNGLFIRLTRSSCFNPLLDTFSPDWSHSKDLKISVPHLVGAVWEACSALKKTPSTNITAIGRGMTQVAVSVKDVLREMKELKPVSCDDQVDEAAGEGCAEAASEPHDDNSSEGDLGNDLSPEEMKVAERAIEVVSNTLSVRKVLIHSIIGLLKLEKPNDNSGFINSLEKLLQLCQELGRQIDEIGACLYPPQEIPAINAALEEIHSIIDAVQVEVGELLGASDVFLEACNDLRSSLRQLASELRNSSTADIEARVENITLT

SEQ ID NO: 107876 - protein, 75 aa, Glycine max
  Coding DNA Sequence Number=SeqID_16191
  Homolog annotation: Hit_ID=A7PXD8; Match level="QueryCoverage=97%, HitCoverage=10%, E-value=1e-18, Identity=58%"; Hit description =Chromosome chr12 scaffold_36, whole genome shotgun sequence
  Pfam annotation: Domain name=PPR; Domain location=14-48; Score=31.2; E_value=3.8e-06; Accession=PF01535.11; Description=PPR repeat
MEEDEGLQMKIPPHAYSLVICGLCKQGKVLEGCAVFESMVRRGCKAHKAVYTAIIDGYAKSGDLDSAMKFFERMK

SEQ ID NO: 107877 - protein, 107 aa, Glycine max
  Coding DNA Sequence Number=SeqID_16192
  Gene Ontology: Mol. function=nucleoside-triphosphatase activity; Cellular component=nuclear origin of replication recognition complex; Biological process=DNA replication initiation
  Homolog annotation: Hit_ID=A7P3G2; Match level="QueryCoverage=90%, HitCoverage=24%, E-value=4e-38, Identity=76%"; Hit description =Chromosome chr1 scaffold_5, whole genome shotgun sequence
MEDNLPEIARQLCMEHQLLFSKAASFDDNSQFMVAILKECGLAHKTVIFVLDEFHLFAQGKQRLLYSLLDAMQSITSQAVVLGISCRLDADQLLEKRITDAHPDITN

SEQ ID NO: 107878 - protein, 183 aa, Glycine max
  Coding DNA Sequence Number=SeqID_16193
  Homolog annotation: Hit_ID=A9PG79; Match level="QueryCoverage=96%, HitCoverage=55%, E-value=5e-65, Identity=68%"; Hit description =Putative uncharacterized protein
MANKSQEEPKTAPEPDRWYNLTLGPSFKDESSNKYCTLRYEFKPASVDKTKPGLLRKTKENRVSVEFQNNQIGKPKVTFEGNSEEYKENDAVLFFDGETLRLERLHRAVKQLRHLRMPGESAGAASTVVAAPSGPALDPRSSPVGKSVKPAPLGRSSFLAVPMEMFHHEYHNAYPLGIIMIQS

SEQ ID NO: 107879 - protein, 396 aa, Glycine max
  Coding DNA Sequence Number=SeqID_16194
  Gene Ontology: Mol. function=nucleoside-triphosphatase activity; Cellular component=integral to membrane; Biological process=transport
  Homolog annotation: Hit_ID=A7P3I5; Match level="QueryCoverage=66%, HitCoverage=37%, E-value=1e-114, Identity=78%"; Hit description =Chromosome chr1 scaffold_5, whole genome shotgun sequence
  Pfam annotation: Domain name=ABC2_membrane; Domain location=1-148; Score=42.6; E_value=1.4e-09; Accession=PF01061.15; Description=ABC-2 type transporter
MAALTKTVGVFPKERAIVDRERAKGSYSLGPYLFSKLLAEIPIGAAFPLMFGAVLYPMARLHPTMQRFGKFCGIVTMESFAASAMGLTVGAMVPTTEAAMAVGPSLMTVFIVFGGYYVNPENTPIIFRWIPNVSLIRWAFQGLSINEFSGLQFDHQHSFDIQTGEQALERISFGKSRIRDTVIAQNRILLFWYCTTYLLLEKNKPKYQQLESPIDHSKPHLKLEELNSEQVDQTIEAPPVSQLDSKQPLESPEVDLVGSFVLEVKLLQRSSPHKLFSDGTTTRRSLIYASKRDPFGHHYDGNLVDENMILLRMRIREIEMVEMKGKATSDWSVWEKKYFAENYGSDVCEAVGLLQRVLMNTRPSFALGMLALVMLSMSMSTLQVGFHLIEFAKGII

SEQ ID NO: 107880 - protein, 24 aa, Glycine max
  Coding DNA Sequence Number=SeqID_16195
MKTQGEEGLCLHSTKAVDKDHGTI

SEQ ID NO: 107881 - protein, 708 aa, Glycine max
  Coding DNA Sequence Number=SeqID_16196
  Gene Ontology: Mol. function=protein tyrosine/serine/threonine phosphatase activity; Cellular component=cytoplasm; Biological process=protein amino acid dephosphorylation
  Homolog annotation: Hit_ID=A7P9N3; Match level="QueryCoverage=97%, HitCoverage=98%, E-value=1e-151, Identity=68%"; Hit description =Chromosome chr3 scaffold_8, whole genome shotgun sequence
  Subcellular localization annotation: CTP_CleavageSite=76; ConfidenceScore=5.06e-01
MDSVPADVSNSHTINDPSKSPPAKETDRQASASVASGQDNSPHEASPRLSPTGISSWAKNLKISQPFSGSQDDSSSGNVGKSTFARITSNFGLRLSPKSPVEDDSSSETAGQSNLFGTITKGLVDSSKNAVKAVQVKARHVVSQNKRRYQEGGFDLDMTYITENIIAMGFPAGDMSSGFFGYVEGFYRNHMEEVIKFFETHHKDKYKVYNLCSERLYDASLFEGKVASFPFDDHNCPPIQLIISFCQSAYSWLKEDIENVVVVHCKAGMARTGLMISSLLVFLKFFPTAEESMDYYNQKRCVDGKGLVLPSQIRYVKYFERVLTYFNGENPPARRGFRLHRCPYWIRPSITVSDHSDRRKAVRRRSSCLAGARREVSLRLRVRGVAGGGGWVCGLRVSPVAAAGCGGVREDAEVREGRRGYSESRALALSAPLDFFVGLFCAKREWAANMKDFCDLSFHNLQPEDFWFGAPKKGVMVFALPGEPGLTELAGDFKIHFHDRQGDFYCWLNTTMTENRKVLNTGDLDGFDKRKLPSPGFMVEVVLVDYNGNVVTSKIETTTKKSDESSSNNPASPTPVERSTPAQNADKESDSHDKDDVFSDGEAEQSASSRSKQTKAPSQAVEKVKNDTRVSESSRVSNEIANLSHATEQVSLGNKSSTPIRHASEPRTNVEGKTVSSLEVPSTESEFKAMAADASVFTFGDDEDYESD

SEQ ID NO: 107882 - protein, 249 aa, Glycine max
  Coding DNA Sequence Number=SeqID_16197
  Gene Ontology: Mol. function=hydrolase activity
  Homolog annotation: Hit_ID=A7P9P0; Match level="QueryCoverage=89%, HitCoverage=86%, E-value=1e-100, Identity=77%"; Hit description =Chromosome chr3 scaffold_8, whole genome shotgun sequence
  Pfam annotation: Domain name=Cyclase; Domain location=40-234; Score =136.3; E_value=8.8e-38; Accession=PF04199.4; Description=Putative cyclase
MKRGALLSVLAFAFAAAIWAANGNDNLVPPRREVYGNGRIFDISHRYQPEMPEWESNNGIGQFLWLPKSMKNGSLANNSEMKLPTHTGTHVDAPGHVFDHYFDAGFDVDTLDLDILNGPALLVDVPRDSNITAQVMKSLNIPRGVVRVLFRTLNTDRRLMFQKEWDTSYVGFTVDGAKWLVDNTDIKLVGIDYLSVASYDYLIPSHLVFLKDRALKLDDVPAGLYSVHCLPLRLAGAEGSPIRCILIKN

SEQ ID NO: 107883 - protein, 732 aa, Glycine max
  Coding DNA Sequence Number=SeqID_16198
  Gene Ontology: Mol. function=citrate transmembrane transporter activity; Cellular component=integral to membrane; Biological process=citrate transport
  Homolog annotation: Hit_ID=A7P9P4; Match level="QueryCoverage=64%, HitCoverage=89%, E-value=1e-179, Identity=71%"; Hit description =Chromosome chr3 scaffold_8, whole genome shotgun sequence
  Pfam annotation: Domain name=Abhydro_lipase; Domain location=596-643; Score=-1.1; E_value=0.005; Accession=PF04083.7; Description=ab -hydrolase associated lipase region
  Pfam annotation: Domain name=CitMHS; Domain location=68-447; Score= -83.9; E_value=0.0018; Accession=PF03600.7; Description=Citrate transporter
  Pfam module annotation: Pfam domain module=Abhydro_lipase::CitMHS; Domain location=596-643::68-447
MEKCTLVCYKVIEAASDMLMLTLLFTSKMPKTDFLKAVAILATAATGAVAINHSWVATNQDLAMALLFVIGYAGIIFEESLAFNKSGVGLLMAVSLWVIRSIGAPSTDIAVSELTHASAEVSEIVFFLLGAMTIVEIVDAHQGFKLVTDNITTRNPRLLLWVFSSRQPDIHHSYGFSVAEIGASIRVPKYSPTILRFGYTLSNPQVVDLDSVDRILGAVVVIAANAGGAWTPIGDVTTTMLWIHGQISTVQTVKDLFVPSAVSLAVPLALMSLTSEVNGKGQNSPNVLASEQIAPRGQLVFSVGLGALIFVPVFKALTGLPPYMGMLLGLGVLWILTDAIHYGESERQKLKVPQALSRIDTQGVLFFLGILLSVSSLEAAGILREIANYLDAHVPSSELIASTIGLISAVIDNVPLVAATMGMYDVTSFPQDSEFWQLIAFCAGTGGSMLIIGSAAGVAFMGMEKVDFFWYLRKISGFAFAGYAAGIVAYLALHKLNISLPTLAEIGTTIIITIVIVAIITVIITTNMIYTVVVNNDDHDDDDGGGGGVGSESNGDNIYGDNNHDDGNVATTVEMGMMMMMMIAITVSILLGNVQSFDGGSLCEELIIPSGYPCSEYTIQTKDGFLLGLQRVSSSSSLRLRNHGDGGPPELALYDVAEMINYINSVTNSKIFVVGHSQGTIISLAAFTQPEIVEKVEAAALLSPISYLDHVSAPLVLRMVKMHIDEVFLSLF

SEQ ID NO: 107884 - protein, 125 aa, Glycine max
  Coding DNA Sequence Number=SeqID_16199
MAGLGPELFNVLKTPFTSLIILIPFLLGEELNSGRASDTGREEANKEARRKRVSKETDLSLVSMLNEADQARPLEIRKLESTSQRMWAMLHSGPSSGGKGHKSETGEAPIPGQLKQSVPSPGVGH

SEQ ID NO: 107885 - protein, 49 aa, Glycine max
  Coding DNA Sequence Number=SeqID_16200
GYARAWAIAQGSRALKPPMSGAIMVEAQVYVISGTIANWYFSKEHQTLR

SEQ ID NO: 107886 - protein, 1019 aa, Glycine max
  Coding DNA Sequence Number=SeqID_16201
  Gene Ontology: Mol. function=hydrolase activity, acting on glycosyl bonds; Cellular component=extracellular region; Biological process =metabolic process
  Homolog annotation: Hit_ID=A7QW60; Match level="QueryCoverage=96%, HitCoverage=92%, E-value=0.0, Identity=64%"; Hit description =Chromosome chr3 scaffold_199, whole genome shotgun sequence
MATANRHSYELLLLHRLLLYFVVSCSLSLSWAVQDGERVMVRNTPQKNWWKPSLTNAEDDDPPPRPLKVTFAEPATHWTDAIPIGNGRLGAMVWGAVPSEALQLNGSNMVWDLSPNLKYGILVEVYEALDSASRMASFCEDTLWTGIPGDYTNKSAPQALAEVRKLVNDRKFAEATAAAVKLSGEPSDVFQLLGDIKLEFHDSHLNYSKESYYRELDLDTATAKIKYSVGDVEFTREHFASNPDQVIVTRLSASKPGSLSFTVYFDSKMHHDSRVSGQNQIKIEGRCPGSRIRPRVNSIDNPQGIQFSAVLDMQISKDKGVIHVLDDKKLRVEGSDSAILLLTASSSFDGPFTKPEDSKKDPASESLSRMVSVKKFSYDDLYARHLADYQNLFHRVSLQLSKSSKTGSGKSVLEGRKLVSSQTNISQKRGDDTIPTSARVKSFQTDEDPSFVELLFQYGRYLLISCSRPGTQVANLQGIWNKDVEPAWDGAPHLNINLQMNYWPSLACNLHECQEPLFDFISSLSVIGKKTAKVNYEANGWVAHQVSDIWGKTSPDRGEAVWALWPMGGAWLCTHLWEHYIYTMDKDFLKNKAYPLLEGCTTFLLDWLIEGRGGLLETNPSTSPEHMFTAPDGKTASVSYSSTMDISIIKEVFSMIISAAEVLGRHNDTIIKRVTKYQSKLPPTKVARDGSIMEWAEDFVDPDVHHRHVSHLFGLFPGHTISVEKTPDLCKAVEEMMVQGGQQLGKLHCGHIFTIPDHERDFEGGLYSNLFTAHPPFQIDANFGTFILISEEGGCSFAVAKTVKLKYHETPAIAEMLVQSTTKDLYLLPALPRDKWANGCVKGLKARVQDCERVMVRHTPQKNWWKPSLTNAEDDDPPPRPLKVTFAEPATHWTDAIPIGNGRLGAMVWGAVPSEALQLNEDTLWTGIPGDYSNKSAPQALAEVRKLVDDGKFSEATAAAAKLSVDPSDVYQLLGDIKLEFPDSPILIIQESYYRELDLDTATAKIKYSVGDVEFTRAF

SEQ ID NO: 107887 - protein, 246 aa, Glycine max
  Coding DNA Sequence Number=SeqID_16202
  Gene Ontology: Mol. function=citrate transmembrane transporter activity; Cellular component=integral to membrane; Biological process=citrate transport
  Homolog annotation: Hit_ID=A7P9P4; Match level="QueryCoverage=70%, HitCoverage=34%, E-value=2e-66, Identity=74%"; Hit description =Chromosome chr3 scaffold_8, whole genome shotgun sequence
MKEEELSSECFALFRTLANQLLPKSTGSGLTGLPPYIGMLLGLGMLWILTDAIHYDESERQKLKVPHALSRIDTQGALFFLGIVLSVSSPEAAGILREIANYFDAHVPSSELIASAIGLISALIDNIPLVAATIGMYDVSSFPQDSEFWQLIALCASTGGSILVIGSAAGVAFMGMEKVDFIWYLRKVSGFALAGYTAGIASYLVLHNLNILQPSLAEAPFLSCFINQEFGLHSNPLSWYQKQHSL

SEQ ID NO: 107888 - protein, 905 aa, Glycine max
  Coding DNA Sequence Number=SeqID_16203
  Gene Ontology: Mol. function=binding; Cellular component=nucleus; Biological process=mRNA modification
  Homolog annotation: Hit_ID=A7QW71; Match level="QueryCoverage=64%, HitCoverage=99%, E-value=0.0, Identity=64%"; Hit description =Chromosome chr3 scaffold_199, whole genome shotgun sequence
  Pfam annotation: Domain name=PPR; Domain location=367-401; Score =26.2; E_value=0.00012; Accession=PF01535.11; Description=PPR repeat
  Pfam annotation: Domain name=PPR; Domain location=470-504; Score =29.7; E_value=1e-05; Accession=PF01535.11; Description=PPR repeat
  Pfam annotation: Domain name=PPR; Domain location=580-614; Score =31.6; E_value=2.9e-06; Accession=PF01535.11; Description=PPR repeat
  Pfam annotation: Domain name=PPR; Domain location=616-650; Score=1.9; E_value=4.7; Accession=PF01535.11; Description=PPR repeat
  Pfam annotation: Domain name=PPR; Domain location=686-720; Score =34.6; E_value=3.5e-07; Accession=PF01535.11; Description=PPR repeat
  Pfam annotation: Domain name=PPR; Domain location=821-855; Score=7.7; E_value=0.95; Accession=PF01535.11; Description=PPR repeat
  Pfam module annotation: Pfam domain module=PPR::PPR::PPR::PPR::PPR::PP R; Domain location=367-401::470-504::580-614::616-650::686-720::821 -855
MAWTYFVPFHPKDKSVLTELIQEIEPLDVSHIQKDVPPTTADAMKRTISGMLGLLPSDQFHVVIEALWEPLSKLLISSMMTGYTLRNVEYRLCLEKNLDMFEGDIEKPKAESMKVDLQGLMHDSVNAIEFGKNKNLSSKVEKLHEEADIQELGEISAEAQQYIFNLQSRLSSMKKELHEVKRKSAALQMQQFVGEEKNDLLDYLRSLQPEQVAQLSEFTSPELKDTILSVVHGLLATLSPKMHSKPSTMSENTTVGATNAGSEDCAEVLENSALQFQPIVFPTTQRLKFKPIVALLHSPSSCSIADPTNLATLLQGNIPRSHLLQIHARIFYLGAHQDNLIATRLIGHYPSRAALRVFHHLQNPNIFPFNAIIRVLAQDGHFFHALSVFNYLKRRSLSPNDLTFSFLFKPCFRTKDVRYVEQIHAHIQKIGFLSDPFVCNGLVSVYAKGFNSLVSARKVFDEIPDKMLVSCWTNLITGFAQSGHSEEVLQLFQVMVRQNLLPQSDTMVSVLSACSSLEMPKIEKWVNVFLELVGDGVSTRETCHDSVNTVLVYLFGKWGRIEKSRENFDRISTSGKSSVVPWNAMINAYVQNGCPVEGLNLFRMMVEEETTRPNHITMVSVLSACAQIGDLSFGSWVHGYLISLGHRHTIGSNQILATSLIDMYSKCGNLDKAKKVFEHTVSKDVVLFNAMIMGLAVYGKGEDALRLFYKIPEFGLQPNAGTFLGALSACSHSGLLVRGRQIFRELTLSTTLTLEHCACYIDLLARVGCIEEAIEVVTSMPFKPNNFVWGALLGGCLLHSRVELAQEVSRRLVEVDPDNSAGYVMLANALASDNQWSDVSGLRLEMKEKGVKKQPGSSWIIVDGAVHEFLVGCLSHPEIEGIYHTLAGLVKNMKVASHFNLVCCC

SEQ ID NO: 107889 - protein, 613 aa, Glycine max
  Coding DNA Sequence Number=SeqID_16204
  Homolog annotation: Hit_ID=Q9C700; Match level="QueryCoverage=94%, HitCoverage=85%, E-value=1e-133, Identity=48%"; Hit description =Putative uncharacterized protein T18C15_4
  Pfam annotation: Domain name=DUF566; Domain location=224-609; Score =494.3; E_value=1.5e-145; Accession=PF04484.3; Description=Family of unknown function (DUF566)
  Subcellular localization annotation: CTP_CleavageSite=2; ConfidenceScore=5.69e-01
MVAAISEDPLTSSNGTIPRRPKGRQVSSRYMSHSPSPSSTTTTTTTTSTSTSTSTTSSSSRRFPSPLLSHSTNSSTPLLPKRSQSVDRRRPRPATPLPEAAKLLVTSTRSLSVSFQGEAFSLPVSKTKAASATPTPRKAATPERRRATPVKGENSRPADQHRWPARTRHVDHLSKSVDIIDNKKKVVGNGNGNGFGKVVRALQQSMVVEGEKRRASFDGLGGLSLDLGKAELLKGNINANNHNKSSLASDLTASDTDSVSSGSTSGAHDSSGAAKGTKEPRGIVVSARFWQETNSRLRRLQDPGSPLSTSPASRIGVPNRNAQLKRYNSDGPMLSPRTMASPVRGNVNARPASPSKLWAGSSPSRGVSPARVRSTVASSINSGSGNTPSILSFSADVRRGKIGEDRIFDAHTLRLLYNRYVQWRFVNARADATFMVQKLNAERHLWNAWVTISELRHSVILKRIKLVLMRQKLKLTSILKGQISYLEEWALLDRDHSTSLLGATEALKASTLRLPVVEKAIADVPNLKDALGSAVDVMQAMASSIYSLSSKVEETNCLVAEILKVTSKERFLLEHCKEFLSSLAAMQVKDCSLRTHMLQLSRVPTSSCLTTRV

SEQ ID NO: 107890 - protein, 193 aa, Glycine max
  Coding DNA Sequence Number=SeqID_16205
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=Golgi apparatus; Biological process=protein metabolic process
  Homolog annotation: Hit_ID=A7QL42; Match level="QueryCoverage=98%, HitCoverage=64%, E-value=3e-77, Identity=74%"; Hit description =Chromosome chr3 scaffold_117, whole genome shotgun sequence
  Pfam annotation: Domain name=2OG-FeII_Oxy; Domain location=69-188; Score=63.1; E_value=9.3e-16; Accession=PF03171.11; Description=2OG -Fe(II) oxygenase superfamily
MAKPKLEPSKLALRKGETAESTKDTRTRYFNEQADNSSGTFISASEDKSGILDLVERKIAKVTMIPRTHGEIFNILKYEVGQKYDSHYDAFNPDEYGSVESQRIASFLLYLSNVEAGGETMFPYEGGLNIDRGYDYQKCIGLKVKPRQGDGLLFYSLLPNGKIDKTSLHGSCPVIKGEKWVATKWIDDREQHY

SEQ ID NO: 107891 - protein, 113 aa, Glycine max
  Coding DNA Sequence Number=SeqID_16206
  Subcellular localization annotation: CTP_CleavageSite=64; ConfidenceScore=5.22e-01
MLLQKNPLCYLNLNLPNTPHLWREPQAEPSSPSPSLPPLPSRASLSSPNPPPLPPPPPLWSVAVATLETTAAKHSIFLERLRSRHLREAAKAGPELRKKAKVTATTAEARRHC

SEQ ID NO: 107892 - protein, 582 aa, Glycine max
  Coding DNA Sequence Number=SeqID_16207
  Gene Ontology: Mol. function=hydrolase activity, hydrolyzing O -glycosyl compounds; Cellular component=extracellular region; Biological process=carbohydrate metabolic process
  Homolog annotation: Hit_ID=A7QL74; Match level="QueryCoverage=88%, HitCoverage=91%, E-value=1e-150, Identity=49%"; Hit description =Chromosome chr3 scaffold_117, whole genome shotgun sequence
  Pfam annotation: Domain name=CBM_4_9; Domain location=52-188; Score =34.3; E_value=4.3e-07; Accession=PF02018.8; Description=Carbohydrate binding domain
  Pfam annotation: Domain name=Glyco_hydro_10; Domain location=226-521; Score=73.1; E_value=9e-19; Accession=PF00331.11; Description=Glycosyl hydrolase family 10
  Pfam module annotation: Pfam domain module=CBM_4_9::Glyco_hydro_10; Domain location=52-188::226-521
MKVAAEGCNLLLLFITSYLSLISAVNTQTYWCCHCFENNQCLAEPRRAQYGGGIIVNPGFDHNIEGWTVFGKGAIKERISNGGNRFIVAHNRTHPLDSFSQKVQLKKGMLYTFSAWLQVSEGSDTVSVMFKTKGSKMVRGGQVIAKHGCWTLLKGGIAANFSSPVEILFESKNSNAEIWADNISLQPFNKKQWRSLQDASIERVRKRKVRFQISHVNETALIGAKVITRPIKLNFPFGCGMNHHILTNKDYQSWFVSRFKFTTFTNEMKWYSTEKKQGEENYTIADAMLKFTKENGISVRGHNIFWDNPKLQPEWVKNLSPEKLGEAAAERMKSVVSRYKGELIAWDVMNENLHFHFYEDKFGENASAAAYATAYELDQEPKLFLNEFNTIEYSGDEASSPAKYIKKLQEILSFPGVSGMSAAIGLQGHFASGQPNLAYMRSGLDLLATTGLPIWLTEASVDPQPSQAEYLEEILREAYSHPAVEGIIMFSGPAQAGFNATTLADETFKNTPAGDVVDKLIQEWGTGPNIATADNRGIVDISLHHGDYDVTVTHPLIHSPITLNLCVKKDFSLETIHVKMRA

SEQ ID NO: 107893 - protein, 82 aa, Glycine max
  Coding DNA Sequence Number=SeqID_16208
MKQQTVGEFEGSKHRIDLHRWTTSHRIRELDTTLQPKTLRLSLPLERKSSTSIAHHRHLTRLSRSPSRTIGSDTSCWGIRGE

SEQ ID NO: 107894 - protein, 369 aa, Glycine max
  Coding DNA Sequence Number=SeqID_16209
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9LJN4; Match level="QueryCoverage=100%, HitCoverage=45%, E-value=1e-147, Identity=66%"; Hit description=Beta- 1,4-xylosidase
  Pfam annotation: Domain name=Glyco_hydro_3; Domain location=1-183; Score=26.7; E_value=1.4e-10; Accession=PF00933.12; Description =Glycosyl hydrolase family 3 N terminal domain
  Pfam annotation: Domain name=Glyco_hydro_3_C; Domain location=238 -369; Score=-7.7; E_value=0.00012; Accession=PF01915.13; Description =Glycosyl hydrolase family 3 C terminal domain
  Pfam module annotation: Pfam domain module=Glyco_hydro_3::Glyco_hydro_ 3_C; Domain location=1-183::238-369
MGQVVSTEAKAMYNVDLAGLTFCSPNVNVFRDPRWGRGQETPGEDPLVVSRYAVKYVRGLQEVKDEASAKAYRLKVSSCCKHYTAYDLDNWKGIHRFHFDAKVTKQDLEDTDQPPFKSCVSEGIPTCADPDLLKGVIRGQWGLDGCIVSDCDSVEVYYNAIHYTATPEDAVALALKAVNLEKVDVATVDQALVYNYIVIMRLGFFDDPKSLPFANLGPSDVCTKDNQQLALDAAKQGIVLLENNNNGTFALSQTNIKKMAVIGPNANATTVMISNYAGIPCRYTSPLQGLQKYTSSVNYAPGCSNVKCGNQSLIASAVKAAASADAVVLVVGLDQSIEAEGLDRENLSLPGFQQKLVKDVASATKGKVI

SEQ ID NO: 107895 - protein, 277 aa, Glycine max
  Coding DNA Sequence Number=SeqID_16210
  Homolog annotation: Hit_ID=A7QL69; Match level="QueryCoverage=97%, HitCoverage=93%, E-value=1e-27, Identity=34%"; Hit description =Chromosome chr3 scaffold_117, whole genome shotgun sequence
MVSLWVDCSPKRYRRDSNRVTSDGGDRRNPPHHSRREPFDAAPKKSNSNDHHENPPQHLSQPPRSRSYHQHDERGSTGQVGRSSGQREAGGKVFTQSKENNESQSTEQKDEKSQVKLDDNLQKRDGFAERKDAPPTMRKMRAFREKIPADSADANPASMVEVKSSHTAHPPERNERKEERSSNPHHLDRPEKQIAEDRTPNKTEARRDGFSSRARYGGSGGNSNYRGRDKINGRQGYRPIKMRMEKWKHDLYQEVNKDPIPKNEDDQIAKLEALLAS

SEQ ID NO: 107896 - protein, 159 aa, Glycine max
  Coding DNA Sequence Number=SeqID_16211
SSGILPDEPLLPESSRKRFSGSLPEEVFFRKTFGYFRKNTSSGNFPEKVLPELPEEPLTGLPEDAVVSLLRHFFRRPLVFSPLVFYPKVTILRVGRETNLFAEKKKTLPWARLAEKKEVHEEDKKNQVHGRGREDEAVRTNSVFREGPNNNLNMHAGRC

SEQ ID NO: 107897 - protein, 139 aa, Glycine max
  Coding DNA Sequence Number=SeqID_16212
MTPTHDALLYNNGRWNMSRQNEFVGYSFTGKYPKNFDIPTGCTMDELKDLIKQIALRGIPPYGIDETQMVRRLFFWKLSHHEYSEKFIKFKIIELKTNDVVMNVLIESNYWKKIGPIEILAVFSKPVSEMEDELSLSQN

SEQ ID NO: 107898 - protein, 203 aa, Glycine max
  Coding DNA Sequence Number=SeqID_16213
MCVHFFNFDQLRIKLQSSDFFRGTKFHALLFLSLHSSSPTFKLLSMVSYGEAKDSIDEEDPWPTSSTWSYIISTPVCGANGSPLMKMPLINFWGIRWSWKRGNIASLVRGKARPRDFEEAIGQLLCVLGQDFAQSVTGRRVQIMRTSMTTLTQIWMTLLLNNILHSDHNSDLPLPKCQLVYAILTQGSHLSGTQWTRRSPTRH

SEQ ID NO: 107899 - protein, 77 aa, Glycine max
  Coding DNA Sequence Number=SeqID_16214
MTIICLCVRLSTRLLLLNGKVCHGPPPPEDDKRAQNDHNLSLCAIGLRLCLNGEKGQYDRDCGVADKSEALAPTYPQ

SEQ ID NO: 107900 - protein, 104 aa, Glycine max
  Coding DNA Sequence Number=SeqID_16215
  Homolog annotation: Hit_ID=Q1J7G7; Match level="QueryCoverage=30%, HitCoverage=58%, E-value=6e-07, Identity=68%"; Hit description =Transposase
LPGINRDTRIIFLRSDLRHRYFSAQSASAVPPVQLLTGWCVTAKAPPDISAGKCSGRVPFAIQAAQLLGRAIGAGLFAITPAGERGMCCKAIKLGNARVFPVTT

SEQ ID NO: 107901 - protein, 153 aa, Glycine max
  Coding DNA Sequence Number=SeqID_16216
WNLLRADQRLISPKVGPGLPGINRDTRIYLFCEVISVTAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIPNAEIIPIAC

SEQ ID NO: 107902 - protein, 234 aa, Glycine max
  Coding DNA Sequence Number=SeqID_16217
  Homolog annotation: Hit_ID=Q6WAY6; Match level="QueryCoverage=43%, HitCoverage=17%, E-value=4e-14, Identity=39%"; Hit description =Putative uncharacterized protein
MSSRGKKTISFIRVSPLFEQNCNCGQGFSKRFGPHKTDSERHSGPTTGVPRRQGKGYGQSRRLGPIYGCVSFANFWGRPLSKRGWFGGPSSNRRFPCLHHSKESPVEVEQSVGSPDGKKERGVLFSCGGYPNIPLIGTRGCINYNPALAIRQLGYPMRGAPMEESVSPFLVRDFGAQNFKAIQRIHKAWETPLRKDQELRGIRNGIIGGYHEWLIKLIDTVDLEGGPGTSFCSL

SEQ ID NO: 107903 - protein, 219 aa, Glycine max
  Coding DNA Sequence Number=SeqID_16218
DGPNVKTNLFANHEGSAMNAIEACSLQRPKYLKDITTSRRFIFEALQDVGMIPLGGHKGDPCLMHPVDKKSPKKPKPLVIHFTRDAAPQNHRGPSTLSGSKPVPFPYKNSKVVPWRYAPQKPSEKKEEATDIDSFSAKVTNITRLSGMTCSGCIFAVPNLPVRPANVKGKAKMVVEEANEANSTLDEDVPTGRFAKRGEGLDRKEVSLEEANEFLYLIQ

SEQ ID NO: 107904 - protein, 119 aa, Glycine max
  Coding DNA Sequence Number=SeqID_16219
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=71%, E-value=1e-24, Identity=69%"; Hit description=LacZ protein
  Subcellular localization annotation: CTP_CleavageSite=25; ConfidenceScore=5.38e-01
MTMITPSSKLTLTKGNKSWYRAPPRAYTSNSCSPGDPLVLERPPPRWSSNSPYSESYYNSLAVVLQRRDWENPGVTQLNRLAAHPPFASWRNSEEARTDRPSQQLRSLNGEWDAPCSGA

SEQ ID NO: 107905 - protein, 130 aa, Glycine max
  Coding DNA Sequence Number=SeqID_16220
MHQDKKIVLKPLSPQEVCEDQKKMREKLLQGKREKEKVSKTLESEKKRETLERKKSEQKKSETLEVRESYLATKRFSRHVSIKCAKWTTTDAILPRKGPITRTMSKRLQEDWARVAEEGPRVLMNLRVDF

SEQ ID NO: 107906 - protein, 283 aa, Glycine max
  Coding DNA Sequence Number=SeqID_16221
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVISVTAVPPVQLLTGWCVTAKAPPDISAGKCSGRVPFAIQAAQLLGRAIGAGLFAITPAGERGMCCKAIKLGNARVFPVTTLNSMRKLAGAREKAVVQMRDHGCLGQGGVVEDLLMDGVEEVKGKKRIRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107907 - protein, 91 aa, Glycine max
  Coding DNA Sequence Number=SeqID_16222
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTSYVPINVSFFAKSWPRASRYQQGHQDLFILRSDLPSQVLQWLLFLSAVPPVQLLTGWCVTAKAPPDISAGKCSGHAARNHHTRRA

SEQ ID NO: 107908 - protein, 170 aa, Glycine max
  Coding DNA Sequence Number=SeqID_16223
  Homolog annotation: Hit_ID=A5C596; Match level="QueryCoverage=71%, HitCoverage=16%, E-value=1e-10, Identity=33%"; Hit description =Putative uncharacterized protein
MTRGNLSDLQPFDPEIDMTFHRLVRHHLVPFEHPEHSVIGDFEHYSFEHSDFEYSKNMAHPPPRERTLRELAAPDFTYESLCIQYLDEDVPYVLKTGLIHLLSKFHGLAGEDPHKHLKEFHIVFSTMKPPDVQEDHIFLKAFPHSLEGVAKDWLYYLAPRSITSSDDLKR

SEQ ID NO: 107909 - protein, 103 aa, Glycine max
  Coding DNA Sequence Number=SeqID_16224
  Homolog annotation: Hit_ID=O52175; Match level="QueryCoverage=79%, HitCoverage=94%, E-value=6e-32, Identity=84%"; Hit description =Salmonella berta plasmid pBERT, complete plasmid sequence
MAYERGGDFLEDARKILNREVRGPRQSRFSIGSAPLTSITKSDAQISGGETRQDYKDTMRFPLAAPSCALLFLPFGLPVSFRCYGRVCLIPRLTLSSGYAVRF

SEQ ID NO: 107910 - protein, 121 aa, Glycine max
  Coding DNA Sequence Number=SeqID_16225
MISRLSQEQFKNQEKDSRESFNKKIQDSRFKNNQDQDSRFKDSRIKRILNQDKIKSTSTWVVVTENKRGYISCGSVLVEGTSTRLFKENKGGYIPCGSLLVKEFTRLKRNLKDRMSLGDWM

SEQ ID NO: 107911 - protein, 277 aa, Glycine max
  Coding DNA Sequence Number=SeqID_16226
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLETTKSTDATVLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWA

SEQ ID NO: 107912 - protein, 254 aa, Glycine max
  Coding DNA Sequence Number=SeqID_16227
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=42; ConfidenceScore=5.17e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIHTGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107913 - protein, 54 aa, Glycine max
  Coding DNA Sequence Number=SeqID_16228
MTTLTQTWMTLMLSNVLPSDDNSDLPLPKCQLVYAILTRMSVHVAQVCHPPGTL

SEQ ID NO: 107914 - protein, 79 aa, Glycine max
  Coding DNA Sequence Number=SeqID_16229
GLHVLPFRGLHALPFRGLHVLLFRGLRALTLRGLHFLVFRGLHALAFRGLHVLTFVVLHALAFIGLYICAFRELKVLRP

SEQ ID NO: 107915 - protein, 159 aa, Glycine max
  Coding DNA Sequence Number=SeqID_16230
  Homolog annotation: Hit_ID=A2Q533; Match level="QueryCoverage=62%, HitCoverage=49%, E-value=2e-09, Identity=25%"; Hit description =Putative uncharacterized protein
MMREAVSNQCFTSFLVGTNKVPVDVLQYADDTIFWWRDLRKIYQRPEFSIIQQQMSAYRLLRTSNPIPEANILKTIWKLNVPPRAAIFSWRLILDRLPTRGNLLRRNVQMQDNSCPLYNRWKTWWIALTWSIWKHRNEVIFHNAQFNGIKMLEDVVFLH

SEQ ID NO: 107916 - protein, 84 aa, Glycine max
  Coding DNA Sequence Number=SeqID_16231
MLNGMSQNSPMISTCHAGVVSSGKWRLRNLCWAYDCHCIIEQIGENDNHNMGFSLFFFPPFAPGLLSPEFIEAALSNINTTLDF

SEQ ID NO: 107917 - protein, 50 aa, Glycine max
  Coding DNA Sequence Number=SeqID_16232
MEKLERIQTDVEHGAKSLLALDLLHHWSPLLLEDQQQWNGEGGKMIGDAT

SEQ ID NO: 107918 - protein, 276 aa, Glycine max
  Coding DNA Sequence Number=SeqID_16233
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSINGCQRMKKRDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107919 - protein, 219 aa, Glycine max
  Coding DNA Sequence Number=SeqID_16234
ESPVVAILAMYDTFDRGCEKSGEGCPMRGVPSDESITPFIARGFSDHNARDRELRGSSNEIIGGYHKWLRVRTQGLDWLPNLKTVRDDEVKASEESDEVQALKAELERAWVVEEKFKAAIVSSSSEEVKGIITGQRHDLEGRAKGNMWAIIDKCKEKLNLAATHEQRLEDEYAKISAEREARERVIDSLHQEATMWTDRFALTLNRSQELPRLLAKAKA

SEQ ID NO: 107920 - protein, 124 aa, Glycine max
  Coding DNA Sequence Number=SeqID_16235
  Subcellular localization annotation: CTP_CleavageSite=54; ConfidenceScore=5.11e-01
RVEESSNLRWSSPTQQQQQQQPYFQNAASSSRPYVPLPIQQQQPQKQQTAEVPLQSSLEELLNQQQSQNFDRLPSQYVQNPKNVSAITLRSGKQCQEPQLQHLPHPQMNLPNFTLLQKKMMTKI

SEQ ID NO: 107921 - protein, 217 aa, Glycine max
  Coding DNA Sequence Number=SeqID_16236
  Homolog annotation: Hit_ID=Q6UUU1; Match level="QueryCoverage=27%, HitCoverage=40%, E-value=2e-18, Identity=78%"; Hit description =Putative uncharacterized protein
VPPVQLLTGWCVTAKAPPDISAGKCSGHAARRVPFAIQAAQLLGRAIGAGLFAITPAGERGMCCKAIKLGNARVFPVTTFCIGAQLNIRGVQGVEFWKRWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107922 - protein, 204 aa, Glycine max
  Coding DNA Sequence Number=SeqID_16237
EAKKWLHSFKGNSLKTWAAEGKASISSFQQFPDKSLSEALERFWGLLRKTPTHGLPQTKQLLDASARGKIKLKTPKEATKLIENMFVSDHAILRDRVHQPTKKSLLELSSQDIVVPFMVVLMNPAIVFLLKNERRKSVTWEINKGKDKIKEDSQVSNKVPTINKDNRDHTLRTTKLEETLAQFMQVTMSNHKSTESALKNLEIK

SEQ ID NO: 107923 - protein, 144 aa, Glycine max
  Coding DNA Sequence Number=SeqID_16238
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=71%, E-value=1e-24, Identity=69%"; Hit description=LacZ protein
  Subcellular localization annotation: CTP_CleavageSite=38; ConfidenceScore=5.27e-01
MKHFTDTLISANIKATKNKTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 107924 - protein, 110 aa, Glycine max
  Coding DNA Sequence Number=SeqID_16239
MVAWPGTQPSLHREDEGPTAQVPQHVEDESSEATIPEPFVIREEAEEKQVRQVAAATPERSLKATSEPSAQREDIPSPHHAVDPSTPLLEMPEGPTTSVLAMDTSPPATL

SEQ ID NO: 107925 - protein, 48 aa, Glycine max
  Coding DNA Sequence Number=SeqID_16240
FSSSSLLSVEASFMMMNQVNSSSFEDDKDDDKKPKRMISRLSQQVQDQ

SEQ ID NO: 107926 - protein, 68 aa, Glycine max
  Coding DNA Sequence Number=SeqID_16241
MDEYYKEMEISLIRVRIEESQEGDPRHCRVAPLCLFGQSHSSICQGVAAIKKEANIQEVPLWLFNLKR

SEQ ID NO: 107927 - protein, 39 aa, Glycine max
  Coding DNA Sequence Number=SeqID_16242
MAPNLGGGHMKKTHIQGLAKRLRMENCTKQSLRMAPNSK

SEQ ID NO: 107928 - protein, 136 aa, Glycine max
  Coding DNA Sequence Number=SeqID_16243
MDNKEGVQEQMKADLSTLKDQMASITEAMLKLQKTIEDNAMATASNTAREAEPVLQPAINLGRDRNTTGFNRRYSPQAYPYGLPSDFTPRTASDDLSQAPTFEGQLPPHANYPLQEDDEGDAHLGPLLPLKEPAPP

SEQ ID NO: 107929 - protein, 42 aa, Glycine max
  Coding DNA Sequence Number=SeqID_16244
MEEIHAEEDEEQGIKSSLLLEDQHQRNGEEGKVIGDSTSRRK

SEQ ID NO: 107930 - protein, 254 aa, Glycine max
  Coding DNA Sequence Number=SeqID_16245
  Homolog annotation: Hit_ID=UPI00006A2D9E; Match level="QueryCoverage =67%, HitCoverage=96%, E-value=1e-11, Identity=18%"; Hit description =UPI00006A2D9E related cluster
MEAMKEEMATMMKAMMSMKKIIEVLSVSGLHALTFRGLHALAFRGLHVLAFMGLHVLVFRGLYILAFRGLHVLAFRGLHVLAFRGLYILPFRELHVIAFRGLHALSFKGLHALAFRGLHVLTFRGVHVLPFRGLQVLAFKGLQRTTRPHLQRTTCPRLQRTTHPHLQRTTRPPLQRATRPHLQRTTPLRLQRAKRPRLQRTTRPRLHRATRPRLQGATHPHLQRTTCPRLHRATRPRLQGATRPHLQRTTHHRL

SEQ ID NO: 107931 - protein, 207 aa, Glycine max
  Coding DNA Sequence Number=SeqID_16246
  Subcellular localization annotation: CTP_CleavageSite=26; ConfidenceScore=5.38e-01
YPGLQSTTLLALTEGYTVLTLKRTTVSSLVRGLACPHLQRASTPSPSRGLRASPSRGLHALAIQRTACYPHLQRGYMPSPLEDYTILTNRGLHALTLRGLHDYTSSPSEDSIPHLERTTPSPSRGLHVLTFRGLHALTFRGPHVLTFKGLHVLANRGLHALTFRGLHVLANRGLHALTLRGLHALTSRGLYILALRGLHALTFRGLR

SEQ ID NO: 107932 - protein, 87 aa, Glycine max
  Coding DNA Sequence Number=SeqID_16247
MTRPPGNANFGAGSNATRNFPSRPIPEFTLIPMTYKDFLPSLIANQMAVISPGKIYQAPFPKWYDPDATCAYHGQNSGPLYQKMPGP

SEQ ID NO: 107933 - protein, 106 aa, Glycine max
  Coding DNA Sequence Number=SeqID_16248
  Gene Ontology: Mol. function=RNA-directed DNA polymerase activity; Biological process=RNA-dependent DNA replication
  Homolog annotation: Hit_ID=A5CAV0; Match level="QueryCoverage=52%, HitCoverage=6%, E-value=1e-09, Identity=46%"; Hit description =Putative uncharacterized protein
CTNYVAGSTYTFDLLYEVQAEEPSSSPTLKHKKAIGWTLADIPGISPSTCMHRILLEDRATPSKWDQLIPKRVQNNWQVCIDYKRLNQEDVIWPMQRPRYLPAVYA

SEQ ID NO: 107934 - protein, 95 aa, Glycine max
  Coding DNA Sequence Number=SeqID_16249
  Homolog annotation: Hit_ID=A0PAV3; Match level="QueryCoverage=40%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVAAQLLGRAIGAGLFAITPAGERGMCCKAIKLGNASVFPVTTL

SEQ ID NO: 107935 - protein, 57 aa, Glycine max
  Coding DNA Sequence Number=SeqID_16250
MDEWSDSLGHGSVYGFLESQSIHNAKDKRGQCEEYIGKWLKESQRQVYLGAYLNQAH

SEQ ID NO: 107936 - protein, 215 aa, Glycine max
  Coding DNA Sequence Number=SeqID_16251
MSSGSDASAYEEPIPKIDTTSVHTEGVLQRYSNYPPRADQNLLVKGSIQNVLAGEDDAVSQFGIANKIMFKQANRKQTKRQERKSKEEAEILRKEQWTKKKHEPAPVSNVSSRRLRATTSKRSPKKQAVDGCVRTIGGVDHTFKSVPGLENLIIATFTTKASVITTVATYPSAGGRRETRGKRVPRKEYARSRHQRLFEENVGKTGKDVIYELFK

SEQ ID NO: 107937 - protein, 367 aa, Glycine max
  Coding DNA Sequence Number=SeqID_16252
  Pfam annotation: Domain name=zf-GRF; Domain location=257-298; Score =21.5; E_value=7.7e-05; Accession=PF06839.3; Description=GRF zinc finger
  Subcellular localization annotation: CTP_CleavageSite=58; ConfidenceScore=5.11e-01
MLAAQLAQASSARPGEQGCFLQKQPPSGGTFWRAQMGLGAICTPIFTKFTPSAGNGCNEEERSTFPFRENYNLAYPSRGPDLQLTFRLSSYDVKNLEKVCSVLVGVANGKCLRVKAAVRSHVKSGHHFQEVPIWKRKIKLVVSCLYEYGMIWIINLVELTCSGNKLKKCKKWNNDRDLKSIVHGAEIVGATMSFGLQLPNDRVIVCQIGSRHGSLDLGSNDYMNNYFRPQVYPTSRIYSLKQYAQYAEAVIEELSLNLVAPLVTSWTEENPGRHFYGCGLYKDIGRKGCNIFQWHDPVGNNRQKKIIVALMKEVDELKLREKDLQSRIKIDAILLRKGPVTRAMSKRLQEDWARAVEEGPRILMNLR

SEQ ID NO: 107938 - protein, 144 aa, Glycine max
  Coding DNA Sequence Number=SeqID_16253
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-23, Identity=98%"; Hit description=LacZ protein
MGSVPKCNNFKKLAHLLNRSYASHGPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPRQ

SEQ ID NO: 107939 - protein, 111 aa, Glycine max
  Coding DNA Sequence Number=SeqID_16254
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=35%, E-value=2e-10, Identity=83%"; Hit description=LacZ protein
MNCVFVHVSSTHEFRAMRSDCLVQFSILPLFSEPHELGFRSAHPPFASWRNSEEARTDRPSQQLRSRNGEWDAPCSGALSAAGVVVTRSVTATLASADVRRCFCRYAPPRQ

SEQ ID NO: 107940 - protein, 154 aa, Glycine max
  Coding DNA Sequence Number=SeqID_16255
MIKKIKVKVRGVNSLPRELRIIVNFDDQGQAIGEAQALLAGFLGTLAADCKLFPMDYDRWSGPSGVPKAYFDDCFETILKPRFYFKINEAGAKRYCKLSMGRKWAANRQSLWNEFNDPTKTRDEIIKNVPIGIDKDQWARFVHYRHKPSTLLII

SEQ ID NO: 107941 - protein, 312 aa, Glycine max
  Coding DNA Sequence Number=SeqID_16256
  Gene Ontology: Mol. function=nucleotidyltransferase activity; Biological process=DNA modification
  Homolog annotation: Hit_ID=Q0QCD2; Match level="QueryCoverage=88%, HitCoverage=88%, E-value=1e-106, Identity=69%"; Hit description =Similar to traC
  Pfam annotation: Domain name=DUF1738; Domain location=37-153; Score =235.5; E_value=1.2e-67; Accession=PF08401.2; Description=Domain of unknown function (DUF1738)
  Subcellular localization annotation: CTP_CleavageSite=103; ConfidenceScore=5.39e-01
MTISLHTQTGAPNTSAATSVSPLEQSGSSKTKFSKNSTDIYQSVTDSIIAALEAGVKPWSCPWQRVPGMSGLPSNYATGAAYSGMNIMLLWSSASEQGFNDSRWMTYKQAKAEGGQVRKGEHGTTAIFYTTLEKETDDGETDYIPILKTFTVFNVEQINGLPMSDEAVFPAGTFEPLPPAEALFLNSGATIIEKGQNAFFAPSTDEIHLPERRLFSDAANFYATGLHELIHWCGAKSRLNREMKGKFGSESYAFEELIAELGSAFLMADLGIVGESRGGVKGITSLRIFRGTVCQEKFAGCGGGRQRARSSL

SEQ ID NO: 107942 - protein, 67 aa, Glycine max
  Coding DNA Sequence Number=SeqID_16257
MAESGLEESEWAQARYDQLNLIEARSRIVSGHGQKSRQINGRNQPRYTGTDASGARVTTDQSLPFPG

SEQ ID NO: 107943 - protein, 166 aa, Glycine max
  Coding DNA Sequence Number=SeqID_16258
  Homolog annotation: Hit_ID=UPI00006A2D9E; Match level="QueryCoverage =74%, HitCoverage=90%, E-value=4e-09, Identity=18%"; Hit description =UPI00006A2D9E related cluster
MAEVNEVQELMKADMEAMKEQMVTMMEAMMSMKKIMEVNAAARLHALDFRGLHVLTFRGLHALAFRGLHALAFRGLHVLAFRGLHVLAFRGLHVLTYRGLHALAFRRLRALDFKGLHVLAFRGLHALSFKGIHVLTFRGLPALAFGGLHTLAFRGLRLQRTTRPRL

SEQ ID NO: 107944 - protein, 142 aa, Glycine max
  Coding DNA Sequence Number=SeqID_16259
  Homolog annotation: Hit_ID=Q7XG75; Match level="QueryCoverage=86%, HitCoverage=21%, E-value=2e-08, Identity=34%"; Hit description=Zinc knuckle family protein
MAHPPPRERTLRELAAGEDPHKHLKEFHIVCSTTKPPDVQEDHIFLKAFPHSLEGVEKDWLYYLAPSNMERSMIDVASGGALGEMTPAEAKNLIEKMTSNSQQFSARNDAIVIRGVHEVATNSSSSGETKKLEGKLDALVNL

SEQ ID NO: 107945 - protein, 90 aa, Glycine max
  Coding DNA Sequence Number=SeqID_16260
  Subcellular localization annotation: CTP_CleavageSite=69; ConfidenceScore=5.73e-01
MVKVGTSYVPINVSFRQKLAQGFPVSTGTPGFMRNSHPAALNAPLQGASAFASRKPAALLNDGTGDRVRASSRITPALGRMCDTGDYYVG

SEQ ID NO: 107946 - protein, 137 aa, Glycine max
  Coding DNA Sequence Number=SeqID_16261
  Subcellular localization annotation: CTP_CleavageSite=41; ConfidenceScore=5.02e-01
MPISPCRCVSWNRTHKDTQWTRRSPTGPWGFQLWLWASVVLQGARSPGKVTSSWHRDRARKTPSGPKEVQQGLEFYGVPVAPRKIIRPPTNRAFIKKYCVPRQAQGETPQQPGDGRQRAIDAPPSPLEFISAHPQKG

SEQ ID NO: 107947 - protein, 38 aa, Glycine max
  Coding DNA Sequence Number=SeqID_16262
MGTTKGEELATQLAQASQVASSRSNRLLEEHPGRPKWA

SEQ ID NO: 107948 - protein, 291 aa, Glycine max
  Coding DNA Sequence Number=SeqID_16263
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIILIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107949 - protein, 105 aa, Glycine max
  Coding DNA Sequence Number=SeqID_16264
FVWEPYTATVISLLSPICVFGSVAWRKTKMFVDPQNANTATLAEVAETLQYMVSPQGRNTWTVDDLVPYVEKITILSEEQERITEPVSYGPASERQFPAQEFHIL

SEQ ID NO: 107950 - protein, 67 aa, Glycine max
  Coding DNA Sequence Number=SeqID_16265
  Gene Ontology: Biological process=transposition, DNA-mediated
  Homolog annotation: Hit_ID=Q1J7G7; Match level="QueryCoverage=44%, HitCoverage=42%, E-value=2e-10, Identity=100%"; Hit description =Transposase
GLPGINRDTRIYFILRSDLPSQWLLFLSAVPPVQLLTGWCVTAKAPPDISAGKCSGHAARNHHTRRA

SEQ ID NO: 107951 - protein, 153 aa, Glycine max
  Coding DNA Sequence Number=SeqID_16266
MSPHSILCGPSISLKLQDYLRVKLSHGSSQRRPMSSSYLLLKIGVLIVPELDASLSVEQPSFDGLEALLVHGAPETETIKLGGGTGPFSHSVPPRSLRRNLFRSHFLLEMNNRAKWNQNVKNGDLRAAKLVNPKPSPSPFLTPFMQRLLAQAS

SEQ ID NO: 107952 - protein, 157 aa, Glycine max
  Coding DNA Sequence Number=SeqID_16267
MNLITVIKRKDHTLRCPYQTCARAGVMGEVEEVQEQIKADMEAMKEKMATIMEANMSTKKIMEANAVAVAATSTAAKVNLTPPSNLNQMNHPTSYMVGKDLGSTGGPHDVQIQNEHAFSPYGLPPNYTPPNVAYTPDEDVNNSAPILIESRQPHHAN

SEQ ID NO: 107953 - protein, 41 aa, Glycine max
  Coding DNA Sequence Number=SeqID_16268
MVKVGTSYVPINVSFSPKVGPGLPGINRIKLIDTVDLEGGP

SEQ ID NO: 107954 - protein, 115 aa, Glycine max
  Coding DNA Sequence Number=SeqID_16269
  Homolog annotation: Hit_ID=Q6UUU1; Match level="QueryCoverage=52%, HitCoverage=40%, E-value=9e-19, Identity=78%"; Hit description =Putative uncharacterized protein
MEDRRRALGNQFAGLQTLGKPVVPAALMNRPTRGERRFAYWALAECILAYYVGTDEGVSEVLHVAGEKRLHRCVSRICDTGYIPLPRSLTRYARSFDCGERKWLTNGAEISWKMP

SEQ ID NO: 107955 - protein, 61 aa, Glycine max
  Coding DNA Sequence Number=SeqID_16270
MNSKKVAYCLKPIKLIDTVDLEGGPGGLRIGALAECILAYYVGTDEGVSEVLHVAGEKRLH

SEQ ID NO: 107956 - protein, 80 aa, Glycine max
  Coding DNA Sequence Number=SeqID_16271
  Pfam annotation: Domain name=Ins_element1; Domain location=5-73; Score=-14.2; E_value=0.0029; Accession=PF03811.4; Description =Insertion element protein
  Subcellular localization annotation: CTP_CleavageSite=34; ConfidenceScore=5.47e-01
ISVTVASVSISCPSCSATDGVVRNGKKHRRTSALASVAAAQLLGRAIGAGLFAITPAGERGMCCKAIKLGNARVFPVTTL

SEQ ID NO: 107957 - protein, 129 aa, Glycine max
  Coding DNA Sequence Number=SeqID_16272
  Homolog annotation: Hit_ID=A0ST23; Match level="QueryCoverage=19%, HitCoverage=51%, E-value=3e-07, Identity=100%"; Hit description =Putative reverse transcriptase
  Subcellular localization annotation: CTP_CleavageSite=48; ConfidenceScore=5.08e-01
MNKARVKGELAYQHFKASRFLDQPSRARRRISFAALNSHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 107958 - protein, 202 aa, Glycine max
  Coding DNA Sequence Number=SeqID_16273
  Homolog annotation: Hit_ID=Q6UUU1; Match level="QueryCoverage=29%, HitCoverage=40%, E-value=2e-18, Identity=78%"; Hit description =Putative uncharacterized protein
MECMDNIACVPSCNDITWNVLCSGIIVRQYTLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 107959 - protein, 79 aa, Glycine max
  Coding DNA Sequence Number=SeqID_16274
MGLRIRLENGELANSARMENWRTALGNQFAGLQTRWWRTHELALGNQVMGLRIRLENGELANSARQSIRGAPDSMVEDA

SEQ ID NO: 107960 - protein, 78 aa, Glycine max
  Coding DNA Sequence Number=SeqID_16275
MTSARQSIHGSVNKFENGELGNRARQSIRGAPDSMVEDASIAPSNQCMGLRIRLEIGDLANSVRQSIRGAPDSMLEDA

SEQ ID NO: 107961 - protein, 40 aa, Glycine max
  Coding DNA Sequence Number=SeqID_16276
MHMTENGPNGEEGEATKTQQQIVESMDQEYIKGGRNFFYT

SEQ ID NO: 107962 - protein, 93 aa, Glycine max
  Coding DNA Sequence Number=SeqID_16277
  Subcellular localization annotation: CTP_CleavageSite=56; ConfidenceScore=5.13e-01
HGQQYNQQQGQWRNHPGNQFNRDQGGPSTRPQQQGPSLYDRTTKLEETLAEFMQVSMSNQKSTESTIKNLEVQVGQLAKQLADRPSSSFSANT

SEQ ID NO: 107963 - protein, 61 aa, Glycine max
  Coding DNA Sequence Number=SeqID_16278
MMEAMMSMRKMIEDNTAIVVDASQGGETVKNAYGPHHVQIQSKHSFPPYELPPNYTLPTVV

SEQ ID NO: 107964 - protein, 47 aa, Glycine max
  Coding DNA Sequence Number=SeqID_16279
MTPLPEREDKSGALIKAYHKDRVYTSLGSRKPKDKVHTNVYPRCRGD

SEQ ID NO: 107965 - protein, 297 aa, Glycine max
  Coding DNA Sequence Number=SeqID_16280
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIQKWKINMFSDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107966 - protein, 146 aa, Glycine max
  Coding DNA Sequence Number=SeqID_16281
  Homolog annotation: Hit_ID=Q6WAY4; Match level="QueryCoverage=89%, HitCoverage=23%, E-value=2e-15, Identity=33%"; Hit description =Putative uncharacterized protein
MAEVSTEAIASLAQYYDQSFRCFTFGDFQLSPMVEEFEEILGCPLGGRKPYLFSGFYPSLARISKIVQISAQELDHRKQVENGVVGVPRRCLEAKARILAGRGEWALFIDILTLLIFGGVLFPNLDGLVDLAAIDAFLAYHDRKEA

SEQ ID NO: 107967 - protein, 255 aa, Glycine max
  Coding DNA Sequence Number=SeqID_16282
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107968 - protein, 43 aa, Glycine max
  Coding DNA Sequence Number=SeqID_16283
MVKCRVGSKGRDQSRYLGIEFLQPGGSTSSRAAATAVELQFAL

SEQ ID NO: 107969 - protein, 176 aa, Glycine max
  Coding DNA Sequence Number=SeqID_16284
MAPRKFSAKRSRKDAVVEGTSATPEFNSHRFRSAGHQQRFEAIKEWSFHRERRVQLRDDDYTDFQEEIARRRWTSLVTPMAKFDPDVVLEFYANAWPTEEGVRDMRSWVRGQWIPFDADALSQFLGDPLVSEEGQECEYSQRRNRADGFDEEVIAQLLCIPDVDDVATQQHPAQRS

SEQ ID NO: 107970 - protein, 207 aa, Glycine max
  Coding DNA Sequence Number=SeqID_16285
HTREPRLACPQEGMLRQEVFQKKDKELRGSNNGPIGGYRKWLRAHVQGLDWLLSWRTTKREEGEAPKEDEEVNSELKLWREEKDQSRVDSLILKDELKVCSRSKRNLSQRLCGTETNMLAIISNYQEELNLATAHEHRVADEYAQVYAEKEARGRVIDTLHQEATMWMDRFALTLNGSQELPRLLAKAKAMATPTPPPRRSTDFSVI

SEQ ID NO: 107971 - protein, 165 aa, Glycine max
  Coding DNA Sequence Number=SeqID_16286
  Subcellular localization annotation: CTP_CleavageSite=83; ConfidenceScore=5.29e-01
MVKVGTSYVPINVSFSPKVGPGLPAVLLFVLKGCVIRNSAQSYQPDIRGKWRSLSPVRETCRANCIMNRPTRGDRGGPLRIARAKGGVSYWRYYVGTVRVFPVKCFMWQKKRRTVPAEYVNTIYSASSLTDSGRIGAAATAEMAAALELVEISPEDCRNSIHFKE

SEQ ID NO: 107972 - protein, 60 aa, Glycine max
  Coding DNA Sequence Number=SeqID_16287
MEAKAQKWWPRGENPQIPWVFAFLNEGGEFWVEKNSPSLIFMFPGCPPAALSACLVLGMR

SEQ ID NO: 107973 - protein, 157 aa, Glycine max
  Coding DNA Sequence Number=SeqID_16288
MGPFLSNPKRSLVGGCVEKSTSHPKAKHRPHVLSRGGYDYLEQKFMDEKTKKKLEEATHSGSTDGVINPSSPIRRHVKWKMARTKKTGLMASEAAKEIAEKIDSLEEQASQEHPGRVRIARAGVTIKQYFGSAPRSSRSSSSIPPEELEQLTQQITD

SEQ ID NO: 107974 - protein, 192 aa, Glycine max
  Coding DNA Sequence Number=SeqID_16289
  Homolog annotation: Hit_ID=A5AKA7; Match level="QueryCoverage=75%, HitCoverage=27%, E-value=7e-07, Identity=29%"; Hit description =Putative uncharacterized protein
MVIDQSLFYDLTQLSSDGVPFEGALHDDWKFDFFVHNVRRLVCTNQADMIGRLLVGSLALESRILHYLIVCILLSRSSNLAQVSEEDLIVMWAFHTGRQIDWAHLVRYCMHKALQLNAPLPYPHLVTWFLQHFNIPLDFEPYVPIKRSFLIGATVVASFGYRKERDGSWVKKGAQPNDAEGHLPVEEDSSLL

SEQ ID NO: 107975 - protein, 61 aa, Glycine max
  Coding DNA Sequence Number=SeqID_16290
MEVEEPWLGLWLPLNYRVDMGSSLAYDNGIWGEPYKLFAAKFLFVGGLRHWKCGRQALWLI

SEQ ID NO: 107976 - protein, 89 aa, Glycine max
  Coding DNA Sequence Number=SeqID_16291
MEVDEPWLGLWLPLNYQVDMGARMAFVDNWAVGKEKTHFDHFAGEDPNPQSLKVPLELPGSPSLGVFFERSVPPFCTCSVVASYPKPLY

SEQ ID NO: 107977 - protein, 195 aa, Glycine max
  Coding DNA Sequence Number=SeqID_16292
  Gene Ontology: Mol. function=nucleoside-triphosphatase activity; Cellular component=intrinsic to membrane; Biological process=innate immune response
  Homolog annotation: Hit_ID=Q5JBT4; Match level="QueryCoverage=100%, HitCoverage=17%, E-value=5e-67, Identity=70%"; Hit description =Candidate disease-resistance protein SR1
MAKHQKSFKAKKLQKWRMALQQVADLSGYHFKDGDSYEYKFIGSIVEEVSRKINRAYLHAVDYPFGQWSQVMEVRKLLDVGSHDVVHIIGIHGMGGLGKTTLALAVYNLIAHHFDKSCFLENVREESNKHGLKHLQSILLSKLLGEKDINLTSWQEGASMIRHRLRRKKILLILDDVDKREQLKAIVGRSDWFGP

SEQ ID NO: 107978 - protein, 58 aa, Glycine max
  Coding DNA Sequence Number=SeqID_16293
MWYHGDQSGSQCFARMLQPYGINIGLKEHSNRVTPKAYTPKSPSGPLPHDSGSTQKTF

SEQ ID NO: 107979 - protein, 398 aa, Glycine max
  Coding DNA Sequence Number=SeqID_16294
  Homolog annotation: Hit_ID=Q2HW90; Match level="QueryCoverage=54%, HitCoverage=41%, E-value=3e-20, Identity=33%"; Hit description =Putative uncharacterized protein
MANQEEWVPFMDVLALLIFGVVLFPNMDGLVDLAAIDAFVAYHHSKESLVVAILADLFDTFDRRCEKSRARIIYCLPALYVWVGFTPIPTRHKASMSAPKPSFMCREEESRLGPTLGLGIGGRTINWFPRWKEGNEGVLFSCGDYPNIPLIGTRGCINYNPVLAIRQIGYPMRGAPTEESLSPFLVRDFGVQCFKIIQRVHKAWESPLRKDKELRGIRNGIIGGYHEWLKVHTRGLDWLSKLKIINEENFEAPEEDEKVQALKTELGKARLAKEKFKLVATDVRKECAGLREENAVTARTLEQETKRARKEEHGRDKFRGALWGSNNELKLRREERDQSRAHSMVLKEELAACSRSKRNLSQRLCETETNMLAIVSKYQEELNLATTHEHKVADEYAQ

SEQ ID NO: 107980 - protein, 264 aa, Glycine max
  Coding DNA Sequence Number=SeqID_16295
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPAPVEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 107981 - protein, 85 aa, Glycine max
  Coding DNA Sequence Number=SeqID_16296
  Subcellular localization annotation: CTP_CleavageSite=48; ConfidenceScore=5.69e-01
MLSNHVNFSATPLCAISGRTSPGNSSHNSSQCKKLGLTTTRPLTLMLRCSASSSSVMVHSPYGSILYYLIRAICWNPVDDNNGSD

SEQ ID NO: 107982 - protein, 104 aa, Glycine max
  Coding DNA Sequence Number=SeqID_16297
MVILRPLSFRSSKSSDKCAETNYGHSAPCHSGAVSRVVGGDKLWSFRTPFRHPEAIVSDGTQRQIMVILHLSIEARSCPMAHRDKLWSFCALCQPRGMNSAVSG

SEQ ID NO: 107983 - protein, 82 aa, Glycine max
  Coding DNA Sequence Number=SeqID_16298
MPKIITHKWKFGNLLEAPNTLQMKGIFVTKFESNEVLLSPINLKVVGPLLLDSNSSRDDTNPPFHVELVGLGSSSSMESFVS

SEQ ID NO: 107984 - protein, 199 aa, Glycine max
  Coding DNA Sequence Number=SeqID_16299
MSHHSSSVNGEGRHRSHLRPDSHRIEKERKPQEANINLPYFHGKDNVEAYLDWKIRVKHQLKRKSTLKSYGPHSYPKKDQGQGILGATPSKSKDDKGKTIEKNLPQEEGQPLMVKEECKEVNVSSKSDQGVPMDPKRIKVILEWLTPPTPLIELVRNHVPSWEDGVEERSPEFQEPLDLRSNPFQGGRDDAILPRKGIG

SEQ ID NO: 107985 - protein, 70 aa, Glycine max
  Coding DNA Sequence Number=SeqID_16300
MEFPEESLVRAEEGNSELNHQVNLPIVYASNKGRAVELFFLVLCELRGKVSVSNVGYSFFPWTGREVIEV

SEQ ID NO: 107986 - protein, 258 aa, Glycine max
  Coding DNA Sequence Number=SeqID_16301
  Subcellular localization annotation: CTP_CleavageSite=62; ConfidenceScore=5.17e-01
MSSPLEDYTSSPLEGNTPSHSKGYTPLTFRGLYVLNLKRTTRPHLQRTTRPRHQRMHTPSPSEGYTSSPSEDKSPSPSEGYTSSPLQGYTSSHSEDYTSSPSEDYTPSPSEDYMCSPLEDYTSFGFRGLHTLAFRGLHVLTFRGLHVLAFRGLHVLTFRGQHALAFKRLHALTFRGLYVLAFRGLHVLAFRGLHALTFKDYTSSPSEGCTPSPSEGYTPLPLEDYTSSPSEDYTSSPSEDYMSSALVDYTSSASEGLN

SEQ ID NO: 107987 - protein, 96 aa, Glycine max
  Coding DNA Sequence Number=SeqID_16302
MERTTLGRGFLSFLVFLVTILYCLDIVWFKDLSTYFFCFLPIFDWEFVVVATYPSAGGRRVTRGMRVPRKEYARSRHQRLFEENVGKTGKDVIYEL

SEQ ID NO: 107988 - protein, 233 aa, Glycine max
  Coding DNA Sequence Number=SeqID_16303
  Gene Ontology: Mol. function=helicase activity; Biological process =viral genome replication
  Homolog annotation: Hit_ID=Q2A9E0; Match level="QueryCoverage=57%, HitCoverage=9%, E-value=7e-19, Identity=34%"; Hit description =Putative uncharacterized protein
  Subcellular localization annotation: CTP_CleavageSite=57; ConfidenceScore=5.24e-01
MQNYQHAKISNSAKARINRKRIMQQKRHPHAQSSSQPTTNCTSEYDIITSDSSESVNSESTQGSSSNFLTVYEDCQSPTNQPVINTEGYSDLGDQLMQCRYCNAQMWYDERISKDKNCQSPRFNLCYGDGKVELPLLQNPPQYLQRLLFDDNTIDSKNYQHNLRAYNMMFAFTSAGIKLDKTVNNSRRPPTIRIQGQPCHRIGSLLPMPGKNPNLHSYISLTQKMKCKIELMP

SEQ ID NO: 107989 - protein, 87 aa, Glycine max
  Coding DNA Sequence Number=SeqID_16304
  Homolog annotation: Hit_ID=A8ARU6; Match level="QueryCoverage=48%, HitCoverage=53%, E-value=2e-15, Identity=83%"; Hit description =Putative uncharacterized protein
  Subcellular localization annotation: CTP_CleavageSite=32; ConfidenceScore=5.37e-01
MLFAPGWNVCTNPPFSPTAAPYPVTIVLSPTRKDMQKHHWQQPLPVTSVQRVGSSENLRKTALQGGFFVFRARDYAQTKTISRRSSY

SEQ ID NO: 107990 - protein, 125 aa, Glycine max
  Coding DNA Sequence Number=SeqID_16305
  Gene Ontology: Mol. function=structural molecule activity; Biological process=iron-sulfur cluster assembly
  Homolog annotation: Hit_ID=A8G9U9; Match level="QueryCoverage=27%, HitCoverage=29%, E-value=3e-11, Identity=97%"; Hit description=Iron -sulfur cluster assembly accessory protein
MNDGDMTIEKQGVALVVDPMSLQYLVGGSVDYTEARTHHSIVTRRAVSRRDASRFITLCVTRGCALKCRPQSTDGSVCSLGREISQREKIVSETAIEPVVVAAPIGAATISPMASSSALVMVKSW

SEQ ID NO: 107991 - protein, 72 aa, Glycine max
  Coding DNA Sequence Number=SeqID_16306
  Homolog annotation: Hit_ID=Q10M26; Match level="QueryCoverage=72%, HitCoverage=4%, E-value=2e-08, Identity=57%"; Hit description =Retrotransposon protein, putative, Ty1-copia subclass, expressed
MVRSMVSHSSLPESLWGEALKTTAYILNSVPSAKSKKWEITKKKRRNQKRPSPELALSAQHALSGLGSTSAK

SEQ ID NO: 107992 - protein, 217 aa, Glycine max
  Coding DNA Sequence Number=SeqID_16307
  Homolog annotation: Hit_ID=Q6UUU1; Match level="QueryCoverage=27%, HitCoverage=40%, E-value=5e-18, Identity=76%"; Hit description =Putative uncharacterized protein
  Subcellular localization annotation: CTP_CleavageSite=42; ConfidenceScore=5.17e-01
GTSYVPINVSFSPKVGPGLPAVPPVQLLTGWCVTAKAPPDISAGKCSGRVPFAIQAAQLLGRAIGAGLFAITPAGERGMCCKAIKLGGARYQLLVPLVRVNFELGVIMVIAVSFGKPVVPAALMNRPTRGERRFAYWALAECILAYYVGTDEGVSEVLHVAGEKKLHRCVSRICDTGYIPLPRSLTRYARSFDCGERKWLTNGAEISWKMPGRYLTG

SEQ ID NO: 107993 - protein, 152 aa, Glycine max
  Coding DNA Sequence Number=SeqID_16308
  Homolog annotation: Hit_ID=Q5XM22; Match level="QueryCoverage=65%, HitCoverage=55%, E-value=4e-22, Identity=55%"; Hit description =Resistance-like protein HAAS-2
  Pfam annotation: Domain name=DUF1723; Domain location=24-68; Score =6.3; E_value=0.095; Accession=PF08330.1; Description=Protein of unknown function (DUF1723)
ACPAIEGLVAGTGLSPLIACSIDTGEWGLLSSFVERWHRETSSFHLPMGEVCDIYERRCQAGHWTVAARAFLLHLLGCTLFANKSATNVHVVFLEALRDLSQTRSYAWGVTTLVHMYDHLNDASISTSRQLGGYITLLQDIRALSLSHGVHY

SEQ ID NO: 107994 - protein, 331 aa, Glycine max
  Coding DNA Sequence Number=SeqID_16309
  Gene Ontology: Mol. function=oxidoreductase activity; Cellular component=mitochondrion; Biological process=metabolic process
  Homolog annotation: Hit_ID=A6THT4; Match level="QueryCoverage=100%, HitCoverage=72%, E-value=1e-171, Identity=90%"; Hit description =Putative aldehyde dehydrogenase
  Pfam annotation: Domain name=Aldedh; Domain location=1-327; Score =231.7; E_value=1.7e-66; Accession=PF00171.13; Description=Aldehyde dehydrogenase family
MAVEPWNFPYYQLMRVLAPNLAAGNPVIAKHASIVPHCAETFAHLVREAGAPERAWTNLFISSDQVANIIADDRVQGAALTGSEKAGSVVAAQAAKHIKKSTLELGGNDVFVVLDDADLEKAVKTGVSARLNNAGQVCTAAKRFILHEKIADAFLTKFTEAFKQVKIGDPLDESTTLGPLSSKDALETLTKQVNEAVKNGATLHYGGKPVQRDGSFFEPTILTNISRDNPAYFEEFFGPVAQMYVVKSDDEAVALANDSHYGLGGAVFSQDIERAKKMASRIETGMVYINWLTDTAPELPFGGVKRSGYGRELSDLGLKEFVNQKLVVVRK

SEQ ID NO: 107995 - protein, 72 aa, Glycine max
  Coding DNA Sequence Number=SeqID_16310
MCLPGKGKETLGSTKIEGNHSKCINLTQGKVYGELGLWLKACRTDDMIYVRVLVWFRDKRKCPTLFPYHGIL

SEQ ID NO: 107996 - protein, 51 aa, Glycine max
  Coding DNA Sequence Number=SeqID_16311
FVRRLTKSAHFIPINIIFSLEKLTSLYISEIVRRIISNWASIRNWAEPSWT

SEQ ID NO: 107997 - protein, 301 aa, Glycine max
  Coding DNA Sequence Number=SeqID_16312
  Gene Ontology: Mol. function=catalytic activity; Biological process =cellular metabolic process
  Homolog annotation: Hit_ID=UPI00005FA7B4; Match level="QueryCoverage =53%, HitCoverage=45%, E-value=1e-56, Identity=62%"; Hit description =COG0451: Nucleoside-diphosphate-sugar epimerases
VHRPHTISVNALGNAMNMGQTLAVYATLCREKGWPFIFPGSPQQWNGLADVTEAGLLAEQLLWATSAEGAANQDFNAVNGDVFRWNWLWPRLADYFGIEAADYPAQMMPLEGRMQEAAAAWREIAARYQLREADIDKLASWWHTDADLGRPMEAFTDMSKSRDLHPAPAKQYGQHDDAHDGRQVLQQIQRMQMHRMTERQQAYRHAGDAQARHGQTAGRIECSRPAQTEDGQQQHRQTHHQQENKARQCVVLLQRRGRLQQTAGAQSQPQQARRQQQLCADAAPPCNAEFKRRCASPAARG

SEQ ID NO: 107998 - protein, 140 aa, Glycine max
  Coding DNA Sequence Number=SeqID_16313
  Gene Ontology: Mol. function=DNA binding; Cellular component =cytoplasm; Biological process=regulation of transcription, DNA -dependent
  Homolog annotation: Hit_ID=P06615; Match level="QueryCoverage=82%, HitCoverage=42%, E-value=3e-55, Identity=93%"; Hit description =Resolvase
  Pfam annotation: Domain name=Phage_integrase; Domain location=1-119; Score=30.6; E_value=5.6e-06; Accession=PF00589.13; Description=Phage integrase family
MVKVGTSYVPINVSFSPKVFIRDKLMERRNRRTGRTEKARIWEVTDRTVRTWIGEAVAAAAADGVTFSVPVTPHTFRHSYAMHMLYAGIPLKVLQSLMGHKSISSTEVYTKVFALDVAARHRVQFAMPESDAVAMLKQLS

SEQ ID NO: 107999 - protein, 689 aa, Glycine max
  Coding DNA Sequence Number=SeqID_16314
  Gene Ontology: Mol. function=cobyrinic acid a,c-diamide synthase activity; Cellular component=nucleus; Biological process=cobalamin biosynthetic process
  Homolog annotation: Hit_ID=P62557; Match level="QueryCoverage=53%, HitCoverage=94%, E-value=0.0, Identity=100%"; Hit description =Protein sopA
  Pfam annotation: Domain name=CbiA; Domain location=106-337; Score =134.7; E_value=2.6e-37; Accession=PF01656.14; Description=Cobyrinic acid a,c-diamide synthase
  Pfam annotation: Domain name=MerR; Domain location=38-73; Score=20.6; E_value=0.0059; Accession=PF00376.14; Description=MerR family regulatory protein
  Pfam annotation: Domain name=ParBc; Domain location=433-520; Score =47.8; E_value=3.7e-11; Accession=PF02195.9; Description=ParB-like nuclease domain
  Pfam module annotation: Pfam domain module=CbiA::MerR::ParBc; Domain location=106-337::38-73::433-520
METLNQCINAGHEMTKAIAIAQFNDDSPEARKITRRWRIGEAADLVGVSSQAIRDAEKAGRLPHPDMEIRGRVEQRVGYTIEQINHMRDVFGTRLRRAEDVFPPVIGVAAHKGGVYKTSVSVHLAQDLALKGLRVLLVEGNDPQGTASMYHGWVPDLHIHAEDTLLPFYLGEKDDVTYAIKPTCWPGLDIIPSCLALHRIETELMGKFDEGKLPTDPHLMLRLAIETVAHDYDVIVIDSAPNLGIGTINVVCAADVLIVPTPAELFDYTSALQFFDMLRDLLKNVDLKGFEPDVRILLTKYSNSNGSQSPWMEEQIRDAWGSMVLKNVVRETDEVGKGQIRMRTVFEQAIDQRSSTGAWRNALSIWEPRAPVIPKHTLNTQPVEDTSLSTPAAPMVDSLIARVGVMARGNAITLPVCGRDVKFTLEVLRGDSVEKTSRVWSGNERDQELLTEDALDDLIPSFLLTGQQTPAFGRRVSGVIEIADGSRRRKAAALTESDYRVLVGELDDEQMAALSRLGNDYRPTSAYERGQRYASRLQNEFAGNISALADAENISRKIITRCINTAKLPKSVVALFSHPGELSARSGDALQKAFTDKEELLKQQASNLHEQKKAGVIFEAEEVITLLTSVLKTSSASRTSLSSRHQFAPGATVLYKGDKMVLNLDRSRVPTECIEKIEAILKELEKPAP

SEQ ID NO: 108000 - protein, 274 aa, Glycine max
  Coding DNA Sequence Number=SeqID_16315
  Gene Ontology: Mol. function=transcription factor activity; Biological process=regulation of transcription, DNA-dependent
  Homolog annotation: Hit_ID=Q8GGH4; Match level="QueryCoverage=59%, HitCoverage=89%, E-value=6e-85, Identity=93%"; Hit description =Putative DEOR type regulator
  Pfam annotation: Domain name=TetR_N; Domain location=125-171; Score =44.7; E_value=3.4e-10; Accession=PF00440.14; Description=Bacterial regulatory proteins, tetR f
MFVRFTARCTEALHQPRGAEDAAHRTYRQAEQHDAHLSGRDGQNIANGGRTRGPGGHQQARNKEEHKQRPQAELQGFTGRGLRHRGCTRSTSIATTLASLCTFVHKPREEFMSRPPNDPHRREKILQATLDTIAEHGIHAVTHRKIATCAGVPLGSMTYYFDGMEPLLEEAFTWFTRQMSQQYRDFFAGVTGPEMACESITTLIHSSQVTTPHNMALMYQLYAFMHRSAALKTVMQDWMKMSQTTLEQWFDPVTTRALDAFIEGMTLHYVTDRA

SEQ ID NO: 108001 - protein, 65 aa, Glycine max
  Coding DNA Sequence Number=SeqID_16316
MLQVDSRGSPQTLESGRYQNETFHSLGRKTLKSPGKSQSEDTDISREGADDDVSHCMISGFESYG

SEQ ID NO: 108002 - protein, 219 aa, Glycine max
  Coding DNA Sequence Number=SeqID_16317
  Gene Ontology: Mol. function=transporter activity; Cellular component= integral to membrane; Biological process=transport
  Homolog annotation: Hit_ID=A4W8I5; Match level="QueryCoverage=100%, HitCoverage=53%, E-value=1e-89, Identity=79%"; Hit description=Major facilitator superfamily MFS_1
MPETATRIGEKLSLKELGRDYKAVLKNGRFVAGALATGFVSLPLLAWIAQSPVIIISGEKLSSYEYGLLQVPIFGALIIGNLVLARLTSRRTVRSLIIMGGWPVAAGLILAAVATAASSHAYLWMTAGLSLYAFGIGVANAGLVRLTLFASEMSKGTVSAAMGMLQMLIFTVGIEVSKHAYALGGNGLFSLFNLANGVLWVGLMMVFLKDKRVGNALQP

SEQ ID NO: 108003 - protein, 172 aa, Glycine max
  Coding DNA Sequence Number=SeqID_16318
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTGAPYPVTIVLSPN

SEQ ID NO: 108004 - protein, 167 aa, Glycine max
  Coding DNA Sequence Number=SeqID_16319
  Homolog annotation: Hit_ID=Q8LI60; Match level="QueryCoverage=60%, HitCoverage=16%, E-value=8e-07, Identity=28%"; Hit description =Putative uncharacterized protein OJ1634_H04.130
  Subcellular localization annotation: CTP_CleavageSite=52; ConfidenceScore=5.64e-01
MATPPASPPPPPLPPPPVDASASPSTLKWTHKATRLRSLATRPPGAERPVVNVDPATGKADSPHKKKLRTYLGIVARDKVDMTYDTWKEVPASQKDLIWEDFQAEFEIPEASDTLAANKDGVDDIVCEKYGISKEKWAQFCQTRRDTSWEDVRKKAQAIQKQNIAPH

SEQ ID NO: 108005 - protein, 120 aa, Glycine max
  Coding DNA Sequence Number=SeqID_16320
MTRGNPFDLQPFDPEIDRTFHRLVRHHFVPFEHPEHSVIGDFEHYSFQHSDFEHSENMAQPPPREDPHKHLKEFHIVCSTMKPPDVQEDHIFLKAFPHSLEGVAKDLLILPCSKVHHELG

SEQ ID NO: 108006 - protein, 275 aa, Glycine max
  Coding DNA Sequence Number=SeqID_16321
  Gene Ontology: Mol. function=propionate-CoA ligase activity; Cellular component=endoplasmic reticulum; Biological process=propionate catabolic process, 2-methylcitrate cycle
  Homolog annotation: Hit_ID=A1G2H0; Match level="QueryCoverage=100%, HitCoverage=43%, E-value=1e-154, Identity=95%"; Hit description =Propionate--CoA ligase
  Pfam annotation: Domain name=AMP-binding; Domain location=1-265; Score=54.1; E_value=5e-13; Accession=PF00501.19; Description=AMP -binding enzyme
MAQSMETVFDCKPGQVMFSTSDVGWAVGHSYNVYGPLIGGCTSLLYEGLPTNPDPGIWWALCEQYNVRTMFSSPTAIRVLKKHDADFIHRHDLRALKYLFLAGEPLDEPTAHWISEALGKPIIDNYWQTETGWPALTLLPGLEMKPVRFGSPGFPNLGYRMKVIDENTGEEVAPGQKGVLVVSPPLPPGCMSTVWNDDSRFLQSYFSHFKELLYSSLDWAIRDDDGYTFILGRTDDVINVAGHRLGTREIEEAISSHPRVAEAAVIGVKDELKGQ

SEQ ID NO: 108007 - protein, 23 aa, Glycine max
  Coding DNA Sequence Number=SeqID_16322
GIGKEDRCHTFKNLSQQAKGQPP

SEQ ID NO: 108008 - protein, 167 aa, Glycine max
  Coding DNA Sequence Number=SeqID_16323
MRRQNLVIPHPFAIQTQSCPMRQNLVILHPLSSRGGGPDDMRRQNLVIPQPFAIQTQSCPMARRDKNLVILHPLSSRGGGPDDMRRQNLVIPQPFAIQTQSCPMARRDKIWSFCTLCHPEAAGPMTCGDKIWSFRTPLPFRHSRVRWRAETKFGHSAPFVIQRRRAR

SEQ ID NO: 108009 - protein, 144 aa, Glycine max
  Coding DNA Sequence Number=SeqID_16324
MRDLATWERSMIDAASGGALGDMTPVEARNLIEKMASNSRQFSARNDAIVIRGVHDVATDSSSSAENKKLEGKLDALVNLVTQLAINQKSASSPITVARVCGLCSSADHHTDLCPSLQQSGVNEQPEAYVANIYNRPPQQQNQQ

SEQ ID NO: 108010 - protein, 80 aa, Glycine max
  Coding DNA Sequence Number=SeqID_16325
  Homolog annotation: Hit_ID=A7PJ67; Match level="QueryCoverage=45%, HitCoverage=9%, E-value=3e-09, Identity=80%"; Hit description =Chromosome chr12 scaffold_18, whole genome shotgun sequence
MCEVGKRVTYNQAVGIFGFVGEDHIGKVSFPPVQLVGFLSHYLFFAGTELEFVIMVIAVSCVKLLSAHNSTQHTSRKHKV

SEQ ID NO: 108011 - protein, 42 aa, Glycine max
  Coding DNA Sequence Number=SeqID_16326
MQNSKRDVYLGAYLNSALKGLDDTPQPKSKAGARWIVVKTNL

SEQ ID NO: 108012 - protein, 54 aa, Glycine max
  Coding DNA Sequence Number=SeqID_16327
  Gene Ontology: Mol. function=binding
  Homolog annotation: Hit_ID=Q1SMZ4; Match level="QueryCoverage=100%, HitCoverage=7%, E-value=5e-09, Identity=57%"; Hit description =Tetratricopeptide-like helical
GLLEEALTMRSKMEDNGCIPSAVTFEMIINALFEKDENDKAEKLLHEMIARGLL

SEQ ID NO: 108013 - protein, 106 aa, Glycine max
  Coding DNA Sequence Number=SeqID_16328
MVLGSSFYVGVGNSFAFWMPIRIAMEFKTCLHDMIIPIAVGTLADSFLRILLNSKANPYSRLTIKHSLLARLPDENPETGQIHAKGPSGEGQSPRVEKDEGQSGEG

SEQ ID NO: 108014 - protein, 42 aa, Glycine max
  Coding DNA Sequence Number=SeqID_16329
MVGIGRQRRRGEGRHHPQGNKPRKKELHHQELTWIKSLKRML

SEQ ID NO: 108015 - protein, 99 aa, Glycine max
  Coding DNA Sequence Number=SeqID_16330
MGAKYLEVVKRGSHPNNGWSPDKIRGSKDKTLISFGRNTIQLVNLPANGTCKNFENDQYRHIIPILSNSFLLVDTRRKMTIICLCVSSGTIELGWQGAE

SEQ ID NO: 108016 - protein, 132 aa, Glycine max
  Coding DNA Sequence Number=SeqID_16331
  Homolog annotation: Hit_ID=A0ST23; Match level="QueryCoverage=34%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLAQTGQSGTELEFVIMVIAVSFGKPVVPAALMNRPTRGERRFAYWALFRFLAH

SEQ ID NO: 108017 - protein, 76 aa, Glycine max
  Coding DNA Sequence Number=SeqID_16332
MPITDSIYQFATITPPRHLVDPEKSNRTLGFPALTTGLYQFYGVAANPTKLIWPPISRAYIYKYYMLRKMQGRAPQ

SEQ ID NO: 108018 - protein, 58 aa, Glycine max
  Coding DNA Sequence Number=SeqID_16333
MTWVATSVVMVMATTLRVVRCVEHCGGDGLLVSHTTSAKGCDADHGYRKYLIFISCMM

SEQ ID NO: 108019 - protein, 84 aa, Glycine max
  Coding DNA Sequence Number=SeqID_16334
MILRGSSIYTTAADYDCCKLLKLVADRRCRSELLHSSRSMETGEQKADVTILLSPLQIPLCLITLIMKVADPTCITARTCSGSV

SEQ ID NO: 108020 - protein, 117 aa, Glycine max
  Coding DNA Sequence Number=SeqID_16335
MDTSKPYTAAMRGIVHEPQANLGADQKFLTSNEFGMTGPLNESISCFLIRVDPWVLEPVAFRGLHVLTFRGLHALAIRGLHALTLRGLHVLAFRGLHALAFSRLHIRTLREFKVLCP

SEQ ID NO: 108021 - protein, 166 aa, Glycine max
  Coding DNA Sequence Number=SeqID_16336
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPGKHFFQFSQINLFFKSQTHFFKP

SEQ ID NO: 108022 - protein, 51 aa, Glycine max
  Coding DNA Sequence Number=SeqID_16337
MPSGPEEVQQGPGVSSSGYGPLSVLQGVRPPTRSFHRDIGIAPTKTPSGPG

SEQ ID NO: 108023 - protein, 225 aa, Glycine max
  Coding DNA Sequence Number=SeqID_16338
  Subcellular localization annotation: CTP_CleavageSite=46; ConfidenceScore=5.33e-01
MALTAPPPLHDWKTGLFLCWACPLEKSTTRPLSSFGPCFSRPSTVRSSGPGSPHEDLSRDNHDQLVGDERWQEFPICHWDRGEDLCLPWRKVPCRVCAKVSVVGRVRPSRSWSPESSPVWGCGHPWLSDVAHIGGYRGGFAKTKSAKLEGMQGIHHHSNHLPLNHGRGYLRCQVPPTLSVFFKGLAFPFNHVLQLSQVGSHVRVVLIMPKEGGNQILPGADAGSF

SEQ ID NO: 108024 - protein, 51 aa, Glycine max
  Coding DNA Sequence Number=SeqID_16339
MAYVRCFDDNKDDNLKPMRMISRLSQEQFKNQEKDSRQVSSFKFSIIKNQE

SEQ ID NO: 108025 - protein, 23 aa, Glycine max
  Coding DNA Sequence Number=SeqID_16340
MAGPQHSKQTPCGEYKAWLQSPG

SEQ ID NO: 108026 - protein, 113 aa, Glycine max
  Coding DNA Sequence Number=SeqID_16341
MSQNFTDYATIPSLTSGMLWNFTDCTIMLPFDYRHVAELRGLPNDGCQVPQSGHAKVASHQTDGPRMKLGNRLGKQQKLYFPLTVGSVLDNGGCTDNARQSICGAPDLMVEDA

SEQ ID NO: 108027 - protein, 56 aa, Glycine max
  Coding DNA Sequence Number=SeqID_16342
MAPIVLNFPDASSIGACRPRIFFINGFLCFLEDEWQRNGEGRERGDATSRASSSRC

SEQ ID NO: 108028 - protein, 174 aa, Glycine max
  Coding DNA Sequence Number=SeqID_16343
  Gene Ontology: Mol. function=binding; Cellular component=integral to membrane
  Homolog annotation: Hit_ID=Q1H0V3; Match level="QueryCoverage=99%, HitCoverage=80%, E-value=2e-23, Identity=34%"; Hit description =Conserved hypothetical transmembrane protein
MAYDLEEQEQLDEFKAWWNKNGKLVTRLVIAAVVVYGGWQGYQSWMNSKATAASTAYQTLVSTSLLDVDSKKAEQISKDAEAIEKDYSMTPYAGRAALFAAHALHEAKQSEAAEKQLRWAMAEAKEPAIKHMAAIEIAGLQIERNALDDAKKILAAIDDKGFDGIKNALLGDIY

SEQ ID NO: 108029 - protein, 78 aa, Glycine max
  Coding DNA Sequence Number=SeqID_16344
MGEGVAVRELDEDGGGGENIDSLVGHFVEGVGDDDGVDVVREEDEALLEEGNRNDNDDSGAVARDRVLGLGELEEHLG

SEQ ID NO: 108030 - protein, 113 aa, Glycine max
  Coding DNA Sequence Number=SeqID_16345
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=92%, HitCoverage=15%, E-value=4e-54, Identity=100%"; Hit description=DNA -directed RNA polymerase subunit beta'
  Pfam annotation: Domain name=RNA_pol_Rpb1_2; Domain location=1-71; Score=46.1; E_value=2.1e-11; Accession=PF00623.11; Description=RNA polymerase Rpb1, domain 2
MQGHPVLLNRAPTLHRLGIQAFQPILVEGRAICLHPLVCKGFNADFDGDQMAVHVPLSLEAQAEARLLMFSHTNLLSPAIGDPISVPTQDMLIGLYILTSGNRRDHIDGWYLR

SEQ ID NO: 108031 - protein, 52 aa, Glycine max
  Coding DNA Sequence Number=SeqID_16346
MPKDRGSKGCVSMLSSCIYLVLILGLHESYASQRFTQDKAIRDIQDDNQDSL

SEQ ID NO: 108032 - protein, 60 aa, Glycine max
  Coding DNA Sequence Number=SeqID_16347
GSLSEKDWPSKAYPLSKEVSSLSEYKTLENVEPESKALSAQLVRPARTLSLLALNASKPA

SEQ ID NO: 108033 - protein, 121 aa, Glycine max
  Coding DNA Sequence Number=SeqID_16348
MGKLDHLEERLRAIDGGEDYAFANLEELFIVPNIITPPKFKVLDFDKYKGDYLLQEPSKDCQYNSDMAPDRMQLQKVCKKGARIFQRIHPKMERLGNSSSTPKNKERDYHNDSRHLTGVLL

SEQ ID NO: 108034 - protein, 49 aa, Glycine max
  Coding DNA Sequence Number=SeqID_16349
MDKRMKVEEDEQREKERRSTKFYALNECTNLKIKSQDSPLSVLRCHETL

SEQ ID NO: 108035 - protein, 305 aa, Glycine max
  Coding DNA Sequence Number=SeqID_16350
  Gene Ontology: Mol. function=protein serine/threonine kinase activity; Biological process=protein amino acid phosphorylation
  Homolog annotation: Hit_ID=A7QAC3; Match level="QueryCoverage=55%, HitCoverage=18%, E-value=2e-57, Identity=62%"; Hit description =Chromosome undetermined scaffold_70, whole genome shotgun sequence
MGAMKSFKSWMEPSHPKTIDDEAWEWGQKVWFISEHVDVHRTAPFLTPFVMAVTQMTNTLLLNSNFGGPLFPPIFADDSILRAKFVYKNYDGLGKSPKFFVCIGIAIAASINLVESDPWSEEFLWTFHKDTLSFCLNAIPKGGSLVISSPEIRPLPQGAYTNGMEDFPIKLIRKSYRINCGHSNDSIRYPLDPFDRIWDADRSFTLFHVATGFKIQLSFKQSSLVKKPPPVVLQTGRVLARRNTLTYSDAILPRRGSITRAMARRLQEYWARDAGEGHRILISFREGAWSRHQRLFEENVGKIEK

SEQ ID NO: 108036 - protein, 111 aa, Glycine max
  Coding DNA Sequence Number=SeqID_16351
MRHHPLGNKPWKEELHHQESALDKKLREEALTEEMNEREWHLQSPFLLLHSTAIDFQEAKDFIDEEDPRPTSSTWSYIKTQEKIQVEQKEEQTYQVEQTQKMDVGFGKWMV

SEQ ID NO: 108037 - protein, 73 aa, Glycine max
  Coding DNA Sequence Number=SeqID_16352
MTSIKEGQPSLILTATVSHICTSVSVINTQNESEGLSLACNEARLKTIHGFSRMQNLGSRRAFIHRSPFSGIL

SEQ ID NO: 108038 - protein, 206 aa, Glycine max
  Coding DNA Sequence Number=SeqID_16353
  Gene Ontology: Mol. function=transporter activity; Cellular component= integral to membrane; Biological process=transport
  Homolog annotation: Hit_ID=A1FSU0; Match level="QueryCoverage=100%, HitCoverage=54%, E-value=1e-110, Identity=97%"; Hit description =Putative uncharacterized protein precursor
MDPDVTRVEPYEWVDGEWRSSAQGTGNVSVYLSGISTRDDAMMFARILPADLRAQLREPGAVIVDSADLDTLGVDLQNNRAWINGKAVRVVAAQPGLRGLGGVNVLASLDTARAIAGTDPHEGSTYFVAGLRSPDLADRVRDRLSASMGRATPVEFWTAPEFASRSQQYWLFDTGAGIAVLFMAVIVCFVGAVITNQSFASVVAGS

SEQ ID NO: 108039 - protein, 149 aa, Glycine max
  Coding DNA Sequence Number=SeqID_16354
MVRRQPFGGDDNAVVQNAGVAVEMALAPHAGVLNGDIVTYSRPVADLRAVQPAAAADMRIVANDARQGKSRIAGHDGTGEHHAVFVVDPTVAVLREGALIVNPAAFRTDRHVVKIHYRDNLPQRDGAGSVAVFPLPEAGFVAKAIFVHL

SEQ ID NO: 108040 - protein, 160 aa, Glycine max
  Coding DNA Sequence Number=SeqID_16355
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=100%, HitCoverage=32%, E-value=7e-76, Identity=71%"; Hit description=DNA -directed RNA polymerase subunit beta'
  Pfam annotation: Domain name=RNA_pol_Rpb1_2; Domain location=49-127; Score=49.5; E_value=1.1e-11; Accession=PF00623.11; Description=RNA polymerase Rpb1, domain 2
EKLVQEAVDTLLDNGIRGQPMRDGHNKVYKSFSDIIEGKEGRFRETLLGKRVDYSGRSVIVVGIAKSKIREKEPIVWEILQEVMQGHPVLLNRAPTLHRLDFDGDQMAVHVPLSLEAQAEARLLMFSHTNLLSPAIGDPISVPTQDMLIGLYILTSGNRR

SEQ ID NO: 108041 - protein, 61 aa, Glycine max
  Coding DNA Sequence Number=SeqID_16356
  Homolog annotation: Hit_ID=A5AWN8; Match level="QueryCoverage=100%, HitCoverage=6%, E-value=6e-21, Identity=73%"; Hit description =Putative uncharacterized protein
MEMTRCMLHEKELPKKLWVEATNTVVKRDKLDKKVEPGVFIGYSNTSKAYKIFQPQNGKFL

SEQ ID NO: 108042 - protein, 17 aa, Glycine max
  Coding DNA Sequence Number=SeqID_16357
MNSRNQPKVHRDGCKWG

SEQ ID NO: 108043 - protein, 88 aa, Glycine max
  Coding DNA Sequence Number=SeqID_16358
VFDLGASWDAAAKCRGWMRLSVCKGKVGDCREAIQAEDLATEVHMLKMELSLLNQEYQAALITIQKLEQQLAARSKSSLLFMGLKKIR

SEQ ID NO: 108044 - protein, 70 aa, Glycine max
  Coding DNA Sequence Number=SeqID_16359
MPPAAGPTHAPSNVERPRHAVEACQAIAERLERLLNLRIVTVGTEIHEVMEDYIRIAKGVTPDGNVYVRS

SEQ ID NO: 108045 - protein, 173 aa, Glycine max
  Coding DNA Sequence Number=SeqID_16360
  Gene Ontology: Mol. function=nucleotide binding; Cellular component =intrinsic to membrane; Biological process=defense response
  Homolog annotation: Hit_ID=Q2YE87; Match level="QueryCoverage=100%, HitCoverage=17%, E-value=4e-78, Identity=71%"; Hit description=NBS -LRR type disease resistance protein Rps1-k-2
  Pfam annotation: Domain name=LRR_1; Domain location=116-143; Score =9.6; E_value=5.1; Accession=PF00560.24; Description=Leucine Rich Repeat
  Pfam annotation: Domain name=LRR_1; Domain location=14-41; Score=5.4; E_value=31; Accession=PF00560.24; Description=Leucine Rich Repeat
  Pfam annotation: Domain name=LRR_1; Domain location=44-67; Score =10.3; E_value=3.8; Accession=PF00560.24; Description=Leucine Rich Repeat
  Pfam annotation: Domain name=LRR_1; Domain location=90-114; Score =1.1; E_value=1.9e+02; Accession=PF00560.24; Description=Leucine Rich Repeat
  Pfam module annotation: Pfam domain module=LRR_1::LRR_1::LRR_1::LRR _1; Domain location=116-143::14-41::44-67::90-114
MEYLLVSGAESFKSLCSLSIYQCPNFVSFGREGLPEEMSTLLPKLEDLYISNCPEIESFPKRGMPPNLRTVWIVNCEKLLSGLAWPSMGMLTHLNVGGRCDGIKSFPKEGLLHLTSLQELTMRGCPLLENMAGERLPDSLIKLTIWECPLLEKRCRMKHPQIWPKISHIPGIK

SEQ ID NO: 108046 - protein, 67 aa, Glycine max
  Coding DNA Sequence Number=SeqID_16361
  Subcellular localization annotation: CTP_CleavageSite=61; ConfidenceScore=5.25e-01
MGVQIATRPTWALQRIPLEGGCFWRKSPCSPGRARKSEPRRFRNVSVGIFAKIFNRSSFVRSSAFNG

SEQ ID NO: 108047 - protein, 282 aa, Glycine max
  Coding DNA Sequence Number=SeqID_16362
  Homolog annotation: Hit_ID=Q6WAY6; Match level="QueryCoverage=83%, HitCoverage=40%, E-value=4e-07, Identity=24%"; Hit description =Putative uncharacterized protein
MGTRGCISYNLVLAIRQLGYPMGGAPIKEELAPVISRGFNKTNVETLQKVRKAWEVLQKKDKELRGSNNGLIGGYRKWLKAHVQGLDCLPSLRTTKREEVEALKEDEEVQALRAELEQAQTVKERLRDVNVATTKALERETKRARREEHGRNKFRGALWGSNNELKLQREERDQSRVDNLILKDELKACSRSKKSLSQRLCKIETNMLAIISKYQEELNLATAHEHRVADEYAQVYTEKEARGRVIDSLHQEATMWMDRFALTLNGSQELPRLLAKAKAMAN

SEQ ID NO: 108048 - protein, 45 aa, Glycine max
  Coding DNA Sequence Number=SeqID_16363
MEHGIVTTPGSLLMQSYLPRALDRRVQEDWARDAREGPKVLMSLR

SEQ ID NO: 108049 - protein, 67 aa, Glycine max
  Coding DNA Sequence Number=SeqID_16364
MGKGWPSGPLFDGMQPLLDCFEKSKESIVARSVKFRNMPEIKRKHCYTIREVPPTWAFQDVPPEGGA

SEQ ID NO: 108050 - protein, 41 aa, Glycine max
  Coding DNA Sequence Number=SeqID_16365
MAILIANTSTTFNRDERLGNTNGFMIPTWLAHEENARIMHE

SEQ ID NO: 108051 - protein, 205 aa, Glycine max
  Coding DNA Sequence Number=SeqID_16366
MSCLANSDLPLPKCQLVYAILTRMSVHVAQVIVDAIYLFAGMPPTRHPLDPDKSNRTLGFPALITGLCQSFGVPVTPSKVIRLPITRAFIEKYCMPRQAQGDAPQAADAPPPPHQADPVGSLGMERYLQHLVRQQAANHRGQGQGFAPFACPTPEQFGAEVAWPGDWPEAQAGEEPAGSPGEAEEARMDEEMTDLLGFLGGSIAT

SEQ ID NO: 108052 - protein, 158 aa, Glycine max
  Coding DNA Sequence Number=SeqID_16367
  Homolog annotation: Hit_ID=A2Q1A3; Match level="QueryCoverage=51%, HitCoverage=28%, E-value=6e-13, Identity=30%"; Hit description=RNA -directed DNA polymerase
DAGSRQARQGASAGVGGCRGWLNYAASEQIVLRVHHMRAIGAGLFAITPAGERGMCCKAIKLGNARVFPVTTFFGQSDLWKQQAANYLNCRLLALPFTYLGIPLGANPRRCHLWDPIIHKCERKLARVPKSVVDKLVRIQRSFLWGGGPDQTKIAWIR

SEQ ID NO: 108053 - protein, 94 aa, Glycine max
  Coding DNA Sequence Number=SeqID_16368
DQRVPMNPKRIKVIPEWPTPPTPFIELVRNHVPSWEDAQEMGVEGRSPEYEEPRDLRSNPFQASHLKEVSLAIREVCVLSSSFFRNLFKEASQG

SEQ ID NO: 108054 - protein, 56 aa, Glycine max
  Coding DNA Sequence Number=SeqID_16369
EFFRKFRKNLFRKVSRSFSLSYTRLITLPDEPLLPEDFRKTSSGNFPEEAVHPEEL

SEQ ID NO: 108055 - protein, 141 aa, Glycine max
  Coding DNA Sequence Number=SeqID_16370
MVAMALKKILSKRARKDAAGEGSSVAPQANIEFDGHHFQSEEHECCFEAIKGWSFLKERLVQLREEEYTEFQEEVVRRQWTQLTGTMAKYDLEIVMEFYANAWPIEEEVMDKRSWVWGQWVPYDEDAINQILGHPLVLEEG

SEQ ID NO: 108056 - protein, 158 aa, Glycine max
  Coding DNA Sequence Number=SeqID_16371
VICLTALCAKPECHSDETELSTPYCAKLRLSSMASKKRKAPSTPSQVRFNRSRFTSQEAWERYTDIGVPRKLLPDRNVIVYYTEFDEFKEELERRHWDEELTDFTDSSIDVAIVKEFDANLYDLEDKSPKQKNLEEDDLYRCTERVSNSLSAPLAPPG

SEQ ID NO: 108057 - protein, 105 aa, Glycine max
  Coding DNA Sequence Number=SeqID_16372
KRSFAIGAGAVTSFGYCKDIDGQWIRKQDLPPPIPDEHTPSPLPQRDASSTLMHHVLSKLRGLRAFIGDRLDTLDSHFEGMDTRITQLEDDMGFIRRCFDPPAAP

SEQ ID NO: 108058 - protein, 62 aa, Glycine max
  Coding DNA Sequence Number=SeqID_16373
  Subcellular localization annotation: CTP_CleavageSite=42; ConfidenceScore=5.02e-01
MGASSMGGKCAESKPTFIQGKRQKNRKRCGLRTLIVKGSGVVFMHGEGCFPYSYVSSIAMSE

SEQ ID NO: 108059 - protein, 73 aa, Glycine max
  Coding DNA Sequence Number=SeqID_16374
MLGSVLSVLVALSLNYSLLGFLALGFVILGLRLSYDRAKPDHVALSAFILLVSFNDEPAKRVCALSETSVSDI

SEQ ID NO: 108060 - protein, 60 aa, Glycine max
  Coding DNA Sequence Number=SeqID_16375
MKDKWNVHELHSMLVQEETRLKNQGSHSVHYVSHQGNQGAGKKFMKKHDKGRGDFLQSKP

SEQ ID NO: 108061 - protein, 179 aa, Glycine max
  Coding DNA Sequence Number=SeqID_16376
MSMLPPICLVSSVVWRKTMMFVDPNNANTTTLGEVAETLQYMVSPQGRKTWTVDDLVPYVEKLMILSEEQERITEPVAHGLASERRFPPQQFHMLQSSVETRGFDRRREIVQAEDFSQQMQQRGHGIYYMPPTFSQYPLQMYQYPFEGHDTDMSASEHSFGGVVETHPHFSWSTMTSSQ

SEQ ID NO: 108062 - protein, 63 aa, Glycine max
  Coding DNA Sequence Number=SeqID_16377
MACHNVQPHFTNYRDALCPDVIQHKVPLSTSPSHLLPRTQGSRSSQDPNTNNKPGVSYHIPNY

SEQ ID NO: 108063 - protein, 126 aa, Glycine max
  Coding DNA Sequence Number=SeqID_16378
  Subcellular localization annotation: CTP_CleavageSite=44; ConfidenceScore=5.42e-01
MATQLNQAQSQNSDKLPSQTVQNTKNVSAITLRSGNKIQVPPPVASPAPEPVKLHSKPEKEVEIVAQKRKLPDQGVNKNFHAGGPSSSNSDLQQSPIPLPFPHRAIPNKKMEKVEKEILETFRNVE

SEQ ID NO: 108064 - protein, 119 aa, Glycine max
  Coding DNA Sequence Number=SeqID_16379
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLQGTIPFRFLITPSQLALTVFSDSASPHH

SEQ ID NO: 108065 - protein, 73 aa, Glycine max
  Coding DNA Sequence Number=SeqID_16380
  Homolog annotation: Hit_ID=Q2HTR5; Match level="QueryCoverage=91%, HitCoverage=25%, E-value=6e-08, Identity=38%"; Hit description =Reverse transcriptase-beet retrotransposon, putative
MEERRGSLNMKIGGVEMIEINSFIQNMELEDIPLVGRRYTLYKPNSCCKSKLDRFLVSKEWIENWPGSIIPPM

SEQ ID NO: 108066 - protein, 165 aa, Glycine max
  Coding DNA Sequence Number=SeqID_16381
  Gene Ontology: Mol. function=hydrolase activity
  Homolog annotation: Hit_ID=A4WAI9; Match level="QueryCoverage=95%, HitCoverage=55%, E-value=3e-73, Identity=84%"; Hit description=Beta -lactamase domain protein precursor
MKDGAPTELVVPQVLASTTFMVDGEKIDIEQPDSYAAYVWIPSAKTILGGTGVAWGIHVWTADTQTAESRKQWQDTLQAMAAHKPERVIPGHYLGNPPAGSGAIDFTRNYLQRFEKALAAHKDSAGVIRTLKKQYPNLAEESSLELSAKVNTGEMKWSISLIFPP

SEQ ID NO: 108067 - protein, 155 aa, Glycine max
  Coding DNA Sequence Number=SeqID_16382
  Homolog annotation: Hit_ID=A6FJQ2; Match level="QueryCoverage=24%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLSTLEDPRAYGKTPATRPFYGSWPFAGLLLTCSFLRYPLILWITVLPPLSELIPLAATDRPSAARNSYDHDYEFELGTAAASGISSLKGGNTVIHRIRG

SEQ ID NO: 108068 - protein, 50 aa, Glycine max
  Coding DNA Sequence Number=SeqID_16383
SKRFMEVEDEDSVVYKKKTADKKSTDGKKNEETGNNHALRRSFAADATLL

SEQ ID NO: 108069 - protein, 78 aa, Glycine max
  Coding DNA Sequence Number=SeqID_16384
  Homolog annotation: Hit_ID=A6FJQ2; Match level="QueryCoverage=48%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARGLDEISFECIKVPSKAISFDALHAFNAR

SEQ ID NO: 108070 - protein, 325 aa, Glycine max
  Coding DNA Sequence Number=SeqID_16385
MDSEIYPEVYENPRAFFSSSSPILLEPLAHGSRDGPEKGPRKEVQERHHWRGFQCGPAGRYGLRQTSVPEHGTPAAGEISRRHWAPLVSRMAKFDLEIVMEFYANAWPTGEGCEYSQRRSQASGFDEEAIAQLLCVSGQDFARTTTGRRVRIMHTNMTTLTQIWMTLQLSNILPNDHNSDLPLPKCQLVYAILTQVSVHVAQLISDAIYQFVGIAPTRYPVDPEKSNRALGFPALITGLCTGLGTTIAGGRPTAGSGGYTIATSRVHLCSPTEGQDSNPDTWPTPEQSEAVVAWPRDWPDFSAGASEEGDGAHEDDDMADVLDFF

SEQ ID NO: 108071 - protein, 87 aa, Glycine max
  Coding DNA Sequence Number=SeqID_16386
  Homolog annotation: Hit_ID=A7P3Y4; Match level="QueryCoverage=37%, HitCoverage=4%, E-value=1e-09, Identity=84%"; Hit description =Chromosome chr1 scaffold_5, whole genome shotgun sequence
WDKEGTKENTHLLEEIEKILCYVCDEVCICLLHSYGLLHSYGLLHSYHHRVVVVKCLKNVTSGDAEFWAEVTIIARMHHLNMELNLS

SEQ ID NO: 108072 - protein, 155 aa, Glycine max
  Coding DNA Sequence Number=SeqID_16387
MAEPSKKRKGTSSRSQRHFGSQETPIPSSIPSGSLFSYEEHRIRYKNLFSSHSIIDPKFIVKAFYSNLEIQEGTLMSEVYGIKMVIDQSIFYDLTQFPSEGALIDDWKFDFYVHDACRLVCTNQADMTGRLLAGSLAFESRILHYLIVRILLPRS

SEQ ID NO: 108073 - protein, 167 aa, Glycine max
  Coding DNA Sequence Number=SeqID_16388
  Homolog annotation: Hit_ID=A0ST23; Match level="QueryCoverage=26%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPHIPYLLFWLKVRLLSRVKNMFEIKGTELEFVIMVIAVSFGKPVVPAALMNRPTRGERRFAYWALFRFLAH

SEQ ID NO: 108074 - protein, 339 aa, Glycine max
  Coding DNA Sequence Number=SeqID_16389
  Pfam annotation: Domain name=zf-CCHC; Domain location=132-149; Score =23.2; E_value=0.00046; Accession=PF00098.14; Description=Zinc knuckle
MKREKHVSYSSHNSCKSLSEELHDYYEGRHRSHLRPHSHRREKERKPQEANINLSYFRGKDNVEANLDWEIKVEQQLKNKSTSKSYSSHSYPKKDQGQGILGVTPSKPKDDKGKAIEKQAPKASMQEKTSSIKCFKCLRRGHITSQCPTTKIIIMRGQDIYSSQDEVTTSPSSSERGKCLLQETLASIATPLGLEFIPQVNKLFDEGLVCKSLNPCALLVPKIGIIRNQVPKIGGMMNVLSGATLFCKITRTPNIFMVCVHRDPLGVPMNPKRIKVILEWPTPPTPLIELVRNHVPSWEDAQKMGVEGRSPKYEEPRDLRSNPFQGGGNDAILPLKGIG

SEQ ID NO: 108075 - protein, 176 aa, Glycine max
  Coding DNA Sequence Number=SeqID_16390
  Gene Ontology: Mol. function=small conjugating protein ligase activity; Cellular component=cytosol; Biological process=regulation of protein metabolic process
  Homolog annotation: Hit_ID=Q45W76; Match level="QueryCoverage=48%, HitCoverage=45%, E-value=4e-28, Identity=75%"; Hit description =Ubiquitin-conjugating enzyme 2
MSTQNLIALTSPKLKEISRTKKAFPWELNFQLPRVSMDSCGAWDYPDNPPSVRFQTRINMTCVNQETGVVRGNSCRGFIAVVEPHLFPMLANWKRERTMEDILIQLKREMMSPQNRKLTQPPEGIIDSINFVELVMMLWKLVIVKFEDAAIQNLKLLEWLQLMRFTAGLFFLQVVL

SEQ ID NO: 108076 - protein, 163 aa, Glycine max
  Coding DNA Sequence Number=SeqID_16391
MLYLECDPIPKVVEDEDDLDDVPVVGHEEDVGVLVSMLVLESREMLVSGGMLMLQRDGSEQRDADAGEQRDGGEHRDTDAGEQRDGSEQRDADAGEQRDAGGEERDVADSEEEKEVDSDEWFINFSCMMNGVEAEVETDGYHSEELNIPISSDDEDEDVEVYP

SEQ ID NO: 108077 - protein, 282 aa, Glycine max
  Coding DNA Sequence Number=SeqID_16392
MVVQAVELLIGFQHLGLDLFQQVARGSGGALLFADQDAPFEIGEADFIEFVEVVGVNAQKTHTFNQGIALICGFLQHAAILPVGSENDLVEIGETHDTDDGQSTSPRSHARAHRPRRAGGSDRQRADGADDVDADLRLSAVCGAAAVQTGLAWAGAAVADRGVGPGAGAGHGRRGAILSPDADPERPAPGAAGAADAVGQAGAARAGRRRARSVCAGAGRRPLGGGARGFRDGGDRPAAVAVPARAAAVGAGSTAQAAETAVAGGCASRAVSAGRGDRRSAP

SEQ ID NO: 108078 - protein, 70 aa, Glycine max
  Coding DNA Sequence Number=SeqID_16393
MARSVFTSCPYSRDLYGRELTRLLVIIPKVVISLLMVSRGIILFKGHIAAIGTTSNNMLSKRKTLDEGSL

SEQ ID NO: 108079 - protein, 92 aa, Glycine max
  Coding DNA Sequence Number=SeqID_16394
  Gene Ontology: Biological process=transposition, DNA-mediated
  Homolog annotation: Hit_ID=Q1J7G7; Match level="QueryCoverage=35%, HitCoverage=47%, E-value=1e-11, Identity=96%"; Hit description =Transposase
MVKSWNLLRADQRLIFRQKLAQGFPVSTGTPGFIYFCEVILPSQVLQWLLFLSAVPPVQLLTGWCVTAKAPPDISAGKCSGHAARNHHTRRA

SEQ ID NO: 108080 - protein, 160 aa, Glycine max
  Coding DNA Sequence Number=SeqID_16395
  Homolog annotation: Hit_ID=Q51617; Match level="QueryCoverage=25%, HitCoverage=59%, E-value=1e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPQSPNASPVATPVLHLLEEEEVQTQDTQDQSQDF

SEQ ID NO: 108081 - protein, 69 aa, Glycine max
  Coding DNA Sequence Number=SeqID_16396
MEEGIIPILDLTPKEEKRIEGLKRLNNSLLAIILVKREKFHWLPLASKGVPYNGGLALLGKEGFIGILQ

SEQ ID NO: 108082 - protein, 176 aa, Glycine max
  Coding DNA Sequence Number=SeqID_16397
MSIHSSSSVNGEGSPPKDPLYKILDELRSLKLWTKKQERKEKGKKRVEEISQDERKKIREEERRKIMKEMKRKKHASYSSHNSCKSLSEELRDYYNGRHKSHLRGKCIHAKRRVIPLSAPFATYPLAGERGEAHRCVFHERKMRGVATNVYLWETSEKPKETSHEEYSRFGSCIYV

SEQ ID NO: 108083 - protein, 138 aa, Glycine max
  Coding DNA Sequence Number=SeqID_16398
MQRYLMVIYTFCQLKASKPVDTQRLSSSCTPLSSRDDEFDDIRTHLMLEASEPIDTERLTSSSAPLSSRDDESDDMRRYLMVIHTFCQLEASEPIDTQRLTSSSAPLSSRDSESDDMRRYLMVICTFCQLEASEPVDT

SEQ ID NO: 108084 - protein, 104 aa, Glycine max
  Coding DNA Sequence Number=SeqID_16399
MAESSKKREGSSSIAVAAAHRRHGPSEAPTTPIHPSLSSPRSSTLFSSDDKRLCQGAPFEGTIVDDWKFDYSSHDARRMVCIDQAEMTVRLLAGSLTFDNRIMH

SEQ ID NO: 108085 - protein, 102 aa, Glycine max
  Coding DNA Sequence Number=SeqID_16400
  Subcellular localization annotation: CTP_CleavageSite=17; ConfidenceScore=5.68e-01
MLCKKAVSSFGPPIVVRSKLAAVLSLMVMAALHNSLTVMPSVRCFSVTGVSRGPFVSRVSVMTVKPLTHAAPGDGHSLSVSDAGSRQARQGASAVLAGVGLA

SEQ ID NO: 108086 - protein, 97 aa, Glycine max
  Coding DNA Sequence Number=SeqID_16401
  Subcellular localization annotation: CTP_CleavageSite=62; ConfidenceScore=5.07e-01
MIKWLNSLTKSPQWSRQLSQPTIQWEEGSEVASRDRSGVAATTCLTCVSSASSLITNGSGMVASDDSSSTPVEVPRLWDLHLPCEEKVGSRARLPSQ

SEQ ID NO: 108087 - protein, 63 aa, Glycine max
  Coding DNA Sequence Number=SeqID_16402
MDVSQPTLWREGDARLTGTSSKEGKSAESPPTFIQGKCRKNWKRGDLRTLSVKGSGVVFTHGE

SEQ ID NO: 108088 - protein, 386 aa, Glycine max
  Coding DNA Sequence Number=SeqID_16403
  Gene Ontology: Mol. function=structural constituent of cell wall; Cellular component=extracellular region; Biological process =cellulose and pectin-containing cell wall organization and biogenesis
  Homolog annotation: Hit_ID=Q9STM7; Match level="QueryCoverage=64%, HitCoverage=87%, E-value=2e-19, Identity=32%"; Hit description =Extensin-like protein
  Pfam annotation: Domain name=Extensin_2; Domain location=117-386; Score=-139.5; E_value=0.079; Accession=PF04554.4; Description =Extensin-like region
RGQHVLAFKGLQVLTFRRLHVLTLRGLHALAIRGLHVLGFRVLHALTFRGLHVIPFRGLHVLVFTGLHALILRGLHVLVFRGLHDLTFRGVHVLAFRGLHAFTFRGQHVLPLRGLHAVAFKGLHVLIFRGLHVLALEDYTSPPSEGYTLSPSLGYMFSPSEGCTTSPLEDNTSSPSEGYMPSPSEDYKSLPSEDYTSSPQEGYTPSPLEGYMPSPSEDYTSSPSVGYTPSPSKDYTGLHALTFRGQHVLPLKGLHAVTFKGLHVLIFRGLHVLALEDYTSPPSERYTPSPSLGYMSSPSKGCTTSPLEDNTSSPSEGYTPSPSEDYKSLPSEDYTSSPPKGYMPSPLEGYMPSPLEDYASSPSKDYMSSPSVGYRPSPSKDYTSSP

SEQ ID NO: 108089 - protein, 138 aa, Glycine max
  Coding DNA Sequence Number=SeqID_16404
MPGADKPVRARQRVLSGVGGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPKWIFGEIFGSKGWTTRCE

SEQ ID NO: 108090 - protein, 66 aa, Glycine max
  Coding DNA Sequence Number=SeqID_16405
MFMTPRLCISAILGEKTCFREEKLSRSAFVTLPRHFREQICEDFSPFFTVLRSSTALTDRLSRYLT

SEQ ID NO: 108091 - protein, 446 aa, Glycine max
  Coding DNA Sequence Number=SeqID_16406
  Gene Ontology: Mol. function=nucleoside-triphosphatase activity; Cellular component=intrinsic to membrane; Biological process=innate immune response
  Homolog annotation: Hit_ID=Q5JBT4; Match level="QueryCoverage=95%, HitCoverage=49%, E-value=4e-79, Identity=62%"; Hit description =Candidate disease-resistance protein SR1
  Pfam annotation: Domain name=LRR_1; Domain location=189-210; Score =10.2; E_value=4; Accession=PF00560.24; Description=Leucine Rich Repeat
  Pfam annotation: Domain name=LRR_1; Domain location=212-234; Score =3.0; E_value=87; Accession=PF00560.24; Description=Leucine Rich Repeat
  Pfam annotation: Domain name=LRR_1; Domain location=258-280; Score =10.1; E_value=4.2; Accession=PF00560.24; Description=Leucine Rich Repeat
  Pfam annotation: Domain name=LRR_1; Domain location=282-303; Score =8.3; E_value=8.8; Accession=PF00560.24; Description=Leucine Rich Repeat
  Pfam annotation: Domain name=LRR_1; Domain location=305-326; Score =1.4; E_value=1.7e+02; Accession=PF00560.24; Description=Leucine Rich Repeat
  Pfam annotation: Domain name=LRR_1; Domain location=346-367; Score =0.6; E_value=2.3e+02; Accession=PF00560.24; Description=Leucine Rich Repeat
  Pfam annotation: Domain name=LRR_1; Domain location=369-394; Score =11.7; E_value=2.1; Accession=PF00560.24; Description=Leucine Rich Repeat
  Pfam module annotation: Pfam domain module=LRR_1::LRR_1::LRR_1::LRR _1::LRR_1::LRR_1::LRR_1; Domain location=189-210::212-234::258 -280::282-303::305-326::346-367::369-394
MEVLNHNAALQLLTRNAFKREKIDPSYEDVLNRVVTYASGIPLALEVIGSNLLVKTVAEWEYAMEHYKRIPSDEILEILKVSFDALEEEEKNVFLDIAFSFKGYKWTVVDDILRALYGNCKKHHIGVLVEKSLIKLNNCYGTVEMHDLIQDTGREIERQRSPEEPGKCKRLWLPKDIIQVLKHNTKFWHLRVLNFDQCEFLTQIPDVSDLPNLKELSYDWCESLVAVDDSIGLLNKLKKWSAYGCRKLTSFPPLNLISLEILEISECSNLEYFPEILGEMENIKHLLLYGLPIKELSFSFQNLIGLQELSMLGCGIVQLRCSLAMMPELSGIDIYNCNRGQWVESEEVDLDLSGNNFTILPEFFKELQFLKYLDVSDCENLQEIRGLPPNLKHFKAINCASLTSSSTSMLLNQVLHEAGGTNLCFQEQVYRSGSINKAVLDIQVLS

SEQ ID NO: 108092 - protein, 329 aa, Glycine max
  Coding DNA Sequence Number=SeqID_16407
  Gene Ontology: Mol. function=ARF GTPase activator activity; Cellular component=plasma membrane; Biological process=regulation of ARF GTPase activity
  Homolog annotation: Hit_ID=Q69QY4; Match level="QueryCoverage=65%, HitCoverage=42%, E-value=2e-47, Identity=47%"; Hit description=ARF GAP-like zinc finger-containing protein-like
  Pfam annotation: Domain name=ArfGap; Domain location=2-116; Score =161.9; E_value=1.7e-45; Accession=PF01412.9; Description=Putative GTPase activating protein for Arf
MILEGLVKLPDNRECADCRTKAPRWASVNLGIFICMQCSGIHRSLGVHISKVRSTTLDTWLPDQVSFMQLIGNAKSNKHWEAELPPNFDRNGYGVEKFIRSKYVEKRWASKGGLQPASKSAEIIFNSNESPAARAKSATQRNRRLSLEESILVKHVAQIRPPVTRYHEIFGRRNVPDVQLISQVLLCFCNKYNTKGSSDFQKNSPPPPLRKPSASFDFDYTRGKNNGIVDHFDLFSIHDDKQDFSTTPPSWTTFDYDPYSFVRFPKPRDLSWFAALQLPEIVQLSSKFFKQLVEAGARFRDKDFNQHTLLQDINLEHICTALALMYHTA

SEQ ID NO: 108093 - protein, 393 aa, Glycine max
  Coding DNA Sequence Number=SeqID_16408
  Gene Ontology: Mol. function=nucleoside-triphosphatase activity; Cellular component=intrinsic to membrane; Biological process=innate immune response
  Homolog annotation: Hit_ID=Q5JBT4; Match level="QueryCoverage=87%, HitCoverage=29%, E-value=1e-144, Identity=78%"; Hit description =Candidate disease-resistance protein SR1
  Pfam annotation: Domain name=NACHT; Domain location=209-372; Score= -19.2; E_value=0.0019; Accession=PF05729.3; Description=NACHT domain
  Pfam annotation: Domain name=NB-ARC; Domain location=170-393; Score= -44.5; E_value=2e-07; Accession=PF00931.13; Description=NB-ARC domain
  Pfam annotation: Domain name=TIR; Domain location=14-144; Score =172.2; E_value=1.4e-48; Accession=PF01582.11; Description=TIR domain
  Pfam module annotation: Pfam domain module=NACHT::NB-ARC::TIR; Domain location=209-372::170-393::14-144
MAAKTRSLASIYDVFLSFRGEDTRHGFTGNLYKALDDRGIYTFIDDQELPRGDQITSALSKAIQESRIAITVLSQNYASSSFCLDELVTILHCKRKGLLVIPVFYKIDPSDVRHQKGSYGEAMAKHQKSFKAKKLQKWRMALQQVADLSGYHFKDGDSYEYKFIGSIVEEVSRKINRAYLHAVDYPFGQWSQVMEVRKLLDVGSHDVVHIIGIHGMGGLGKTTLALAVYNLIAHHFDKSCFLENVREESNKHGLKHLQSILLSKLLGEKDINLTSWQEGASMIRHRLRRKKILLILDDVDKREQLKAIVGRSDWFGPGSRVIITTRDKHLLKYHQVERTYEVTKSLVNTSILVISLIKSLVRLIGRITGIGNNKAPVTGSTKKKNRGCKEDFA

SEQ ID NO: 108094 - protein, 823 aa, Glycine max
  Coding DNA Sequence Number=SeqID_16409
  Gene Ontology: Mol. function=nucleoside-triphosphatase activity; Cellular component=intrinsic to membrane; Biological process=innate immune response
  Homolog annotation: Hit_ID=Q5JBT4; Match level="QueryCoverage=96%, HitCoverage=92%, E-value=0.0, Identity=71%"; Hit description =Candidate disease-resistance protein SR1
  Pfam annotation: Domain name=LRR_1; Domain location=556-581; Score =5.0; E_value=36; Accession=PF00560.24; Description=Leucine Rich Repeat
  Pfam annotation: Domain name=LRR_1; Domain location=583-604; Score =7.0; E_value=16; Accession=PF00560.24; Description=Leucine Rich Repeat
  Pfam annotation: Domain name=LRR_1; Domain location=606-628; Score =9.1; E_value=6.2; Accession=PF00560.24; Description=Leucine Rich Repeat
  Pfam annotation: Domain name=LRR_1; Domain location=630-650; Score =9.5; E_value=5.2; Accession=PF00560.24; Description=Leucine Rich Repeat
  Pfam annotation: Domain name=LRR_1; Domain location=652-674; Score =12.7; E_value=1.3; Accession=PF00560.24; Description=Leucine Rich Repeat
  Pfam annotation: Domain name=LRR_1; Domain location=676-697; Score =8.8; E_value=7.2; Accession=PF00560.24; Description=Leucine Rich Repeat
  Pfam annotation: Domain name=LRR_1; Domain location=699-720; Score =5.0; E_value=36; Accession=PF00560.24; Description=Leucine Rich Repeat
  Pfam annotation: Domain name=NACHT; Domain location=206-360; Score= -8.1; E_value=0.00025; Accession=PF05729.3; Description=NACHT domain
  Pfam annotation: Domain name=NB-ARC; Domain location=167-459; Score =164.1; E_value=3.7e-46; Accession=PF00931.13; Description=NB-ARC domain
  Pfam annotation: Domain name=TIR; Domain location=14-141; Score =120.1; E_value=6.6e-33; Accession=PF01582.11; Description=TIR domain
  Pfam module annotation: Pfam domain module=LRR_1::LRR_1::LRR_1::LRR _1::LRR_1::LRR_1::LRR_1::NACHT::NB-ARC::TIR; Domain location=556 -581::583-604::606-628::630-650::652-674::676-697::699-720::206 -360::167-459::14-141
MDATTRYRPFIYDVFLSFIREDTHRGFTFYLYKALNDRGIYTFFYDQELPRETEVTPGLYKAILASRVAIIVLSENYAFSSFCLDELVTILHCEREVIPVFHNVDPSDVRHQKGSYGEAMAKHQKRFKAKKLQKWRMALKQVANLCGYHFKDGGSYEYMLIGRIVKQVSRMFGLASLHVADYPVGLESQVTEVMKLLDVGSDDVVHIIGIHGMGGLGKTTLAMAVYNFIAPHFDESCFLQNVREESNKHGLKHLQSVLLSKLLGEKDITLTSWQEGASMIQHRLRLKKILLILDDVDKREQLKAIVGKPDWFGPGSRVIITTRDKHLLKYHEVERTYEVNVLNHDDAFQLLTWNAFKREKIDPSYKDVLNRVVTYASGLPLALEVIGSNLYGKTVAEWESALETYKRIPSNEILKILEVSFDALEEEQKNVFLDIACCFKGYKWTEVYDIFRALYSNCKMHHIGVLVEKSLLLKVSWRDNVEMHDLIQDMGRDIERQRSPEEPGKCKRLWSPKDIIQVLKHNTGTSKLEIICLDSSISDKEETVEWNENAFMKMENLKILIIRNGKFSKGPNYFPEGLRKLGHLTVLKFDKCKFLTQIPDVSDLPNLRELSFVGCESLVAIDDSIGFLNKLEILNAAGCRKLTSFPPLNLTSLETLELSHCSSLEYFPEILGEMENITALHLERLPIKELPFSFQNLIGLREITLRRCRIVRLRCSLAMMPNLFRFQIRNCNSWQWVESEAGEEKVEVRYPNVLEYEKEKKEEGVLELESSLIKGSGIHIFREEGSMEEDIRFDDPYLSSSASESPSLLQTIALGTRNLQKTT

SEQ ID NO: 108095 - protein, 929 aa, Glycine max
  Coding DNA Sequence Number=SeqID_16410
  Gene Ontology: Mol. function=transmembrane receptor activity; Cellular component=intrinsic to membrane; Biological process=innate immune response
  Homolog annotation: Hit_ID=Q5JBT4; Match level="QueryCoverage=97%, HitCoverage=91%, E-value=0.0, Identity=63%"; Hit description =Candidate disease-resistance protein SR1
  Pfam annotation: Domain name=LRR_1; Domain location=530-551; Score =8.3; E_value=9; Accession=PF00560.24; Description=Leucine Rich Repeat
  Pfam annotation: Domain name=LRR_1; Domain location=553-575; Score =8.6; E_value=7.9; Accession=PF00560.24; Description=Leucine Rich Repeat
  Pfam annotation: Domain name=LRR_1; Domain location=577-597; Score =8.6; E_value=7.7; Accession=PF00560.24; Description=Leucine Rich Repeat
  Pfam annotation: Domain name=LRR_1; Domain location=599-621; Score =10.0; E_value=4.3; Accession=PF00560.24; Description=Leucine Rich Repeat
  Pfam annotation: Domain name=LRR_1; Domain location=623-644; Score =12.1; E_value=1.7; Accession=PF00560.24; Description=Leucine Rich Repeat
  Pfam annotation: Domain name=LRR_1; Domain location=646-667; Score =6.7; E_value=17; Accession=PF00560.24; Description=Leucine Rich Repeat
  Pfam annotation: Domain name=LRR_1; Domain location=695-716; Score =10.6; E_value=3.4; Accession=PF00560.24; Description=Leucine Rich Repeat
  Pfam annotation: Domain name=LRR_1; Domain location=718-743; Score =8.8; E_value=7.1; Accession=PF00560.24; Description=Leucine Rich Repeat
  Pfam annotation: Domain name=NACHT; Domain location=211-365; Score= -10.9; E_value=0.00042; Accession=PF05729.3; Description=NACHT domain
  Pfam annotation: Domain name=NB-ARC; Domain location=172-468; Score =149.0; E_value=1.3e-41; Accession=PF00931.13; Description=NB-ARC domain
  Pfam annotation: Domain name=TIR; Domain location=14-146; Score =167.9; E_value=2.6e-47; Accession=PF01582.11; Description=TIR domain
  Pfam module annotation: Pfam domain module=LRR_1::LRR_1::LRR_1::LRR _1::LRR_1::LRR_1::LRR_1::LRR_1::NACHT::NB-ARC::TIR; Domain location =530-551::553-575::577-597::599-621::623-644::646-667::695-716::718 -743::211-365::172-468::14-146
MAAKTRSLASIYDVFLSFRGLDTRHGFTGNLYKALDDRGIYTSIDDQELPRGDEITPALSKAIQESRIAITVLSQNYASSSFCLDELVTILHCKSEGLLVIPVFYKVDPSDVRHQKGSYGEAMAKHQKRFKAKKEKLQKWRMALKQVADLSGYHFEDGDAYEYKFIGSIVEEVSRKISRASLHVADYPVGLESQVTEVMKLLDVGSDDLVHIIGIHGMGGLGKTTLALEVYNLIALHFDESCFLQNVREESNKHGLKHLQSILLSKLLGEKDITLTSWQEGASTIQHRLQRKKVLLILDDVNKREQLKAIVGRPDWFGPGSRVIITTRDKHLLKCHEVERTYEVKVLNHNAALQLLTWNAFKREKIDPSYEDVLNRVVTYASGLPLALEIIGSNMFGKSVAGWESAVEHYKRIPNDEILEILKVSFDALGEEQKNVFLDIAFCLKGCKLTEVEHMLCSLYDNCMKHHIDVLVDKSLIKVKHGIVEMHDLIQVVGREIERQRSPEEPGKRKRLWLPKDIIHVLKDNTKLGHLTVLKFDRCKFLTQIPDVSDLPNLRELSFEDCESLVAVDDSIGFLKKLKKLSAYGCRKLTSFPPLNLTSLETLQLSSCSSLEYFPEILGEMENIRELRLTGLYIKELPFSFQNLTGLRLLALSGCGIVQLPCSLAMMPELSSFYTDYCNRWQWIELEEGFKRFAHVGYLNLSGNNFTILPEFFKELQFLRTLDVSDCEHLQEIRGLPPILEYFDARNCVSFTSSSTSMLLNQELHEAGGTQFVFPGTRIPEWFDQQSSGPSSSFWFRNKFPAKLVFLLIAPVSGASYPFLEPKLFINGKVLPFKNEVIDMLKLDHTYIFDLQELPFKNDNLFEEVAWEKEWNHVEVRYQSVLEYENEKRKGVLDLESSLIKATGIHIFKEVVKSSLNPTVVHPIFNMYF

SEQ ID NO: 108096 - protein, 641 aa, Glycine max
  Coding DNA Sequence Number=SeqID_16411
  Gene Ontology: Mol. function=nucleoside-triphosphatase activity; Cellular component=intrinsic to membrane; Biological process=innate immune response
  Homolog annotation: Hit_ID=Q5JBT4; Match level="QueryCoverage=67%, HitCoverage=37%, E-value=0.0, Identity=77%"; Hit description =Candidate disease-resistance protein SR1
  Pfam annotation: Domain name=BSP; Domain location=433-633; Score =380.2; E_value=3.3e-111; Accession=PF04450.3; Description=Plant Basic Secretory Protein
  Pfam annotation: Domain name=NACHT; Domain location=211-364; Score= -12.6; E_value=0.00057; Accession=PF05729.3; Description=NACHT domain
  Pfam annotation: Domain name=NB-ARC; Domain location=172-471; Score =120.7; E_value=4.2e-33; Accession=PF00931.13; Description=NB-ARC domain
  Pfam annotation: Domain name=TIR; Domain location=14-146; Score =170.6; E_value=4.1e-48; Accession=PF01582.11; Description=TIR domain
  Pfam module annotation: Pfam domain module=BSP::NACHT::NB-ARC::TIR; Domain location=433-633::211-364::172-471::14-146
MAATTRSLPFIYDVFLSFRGEDTRYGFTGNLYRALCEKGIHTFFDEEKLHGGDEITPALSKAIQESRIAITVLSQNYAFSSFCLDELVTILHCKSEGLLVIPVFYNVDPSDLRHQKGSYGEAMIKHQKRFESKMEKLQKWRMALKQVADLSGHHFKDGDAYEYKFIGSIVEEVSRKINRASLHVLDYPVGLESQVTDLMKLLDVGSDDVVHIIGIHGMRGLGKTTLSLAVYNLIALHFDESCFLQNVREESNKHGLKHLQSILLLKLLGEKDINLTSWQEGASMIQHRLRRKKVLLILDDADRHEQLKAIVGRPDWFGPGSRVIITTRDKHLLKYHGIERTYEVKVLNDNAALQLLTWNAFRREKIDPSYEHVLNRVVAYASGLPLALEVIGSHLFEKTVAEWEYAVEHYSRIPIDEIVDILKVSFDATKQETQGYKFTVINNALTTPGGVRFRDKIGAEYANRTLELATQFVWRIFQQKNPSDRKNVQKVSLVVDDMEGIAYTMNNEIHVSARYVNGYSGGDVKREITGVLFHQVCYVWQWYGNGEAPGGLIGGIADFVRLKANYAASHWRKPGQGQRWDEGYDITAHFLDYCDSLKSGFVAQLNQLMRTGYSDQFFVQLLGKPVDQLWRDYKAQYGNLA

SEQ ID NO: 108097 - protein, 169 aa, Glycine max
  Coding DNA Sequence Number=SeqID_16412
  Gene Ontology: Mol. function=nucleoside-triphosphatase activity; Cellular component=intrinsic to membrane; Biological process=innate immune response
  Homolog annotation: Hit_ID=Q9FVK2; Match level="QueryCoverage=100%, HitCoverage=49%, E-value=1e-70, Identity=78%"; Hit description =Resistance protein MG13
  Pfam annotation: Domain name=TIR; Domain location=14-146; Score =170.8; E_value=3.5e-48; Accession=PF01582.11; Description=TIR domain
MAATTCSRASIYDVFLNFRGEDTRHGFTGNLYRALCDKGIHTFFDEKKLHSGEEITPALLKAIQESRIAITVLSENYASSSFCLDELVTILHCKRKGLLVIPVFYNVDPSDVRHQKGSYEEEMAKHQKRFKARKEKLQKWRIALKQVADLCGYHFKDGFNLSIDLTSKI

SEQ ID NO: 108098 - protein, 1032 aa, Glycine max
  Coding DNA Sequence Number=SeqID_16413
  Gene Ontology: Mol. function=transmembrane receptor activity; Cellular component=intrinsic to membrane; Biological process=innate immune response
  Homolog annotation: Hit_ID=Q5JBT4; Match level="QueryCoverage=93%, HitCoverage=93%, E-value=0.0, Identity=65%"; Hit description =Candidate disease-resistance protein SR1
  Pfam annotation: Domain name=LRR_1; Domain location=558-583; Score =4.2; E_value=51; Accession=PF00560.24; Description=Leucine Rich Repeat
  Pfam annotation: Domain name=LRR_1; Domain location=585-606; Score =9.6; E_value=5.1; Accession=PF00560.24; Description=Leucine Rich Repeat
  Pfam annotation: Domain name=LRR_1; Domain location=628-650; Score =11.2; E_value=2.5; Accession=PF00560.24; Description=Leucine Rich Repeat
  Pfam annotation: Domain name=LRR_1; Domain location=652-673; Score =10.1; E_value=4.2; Accession=PF00560.24; Description=Leucine Rich Repeat
  Pfam annotation: Domain name=LRR_1; Domain location=675-696; Score =5.2; E_value=34; Accession=PF00560.24; Description=Leucine Rich Repeat
  Pfam annotation: Domain name=LRR_1; Domain location=724-745; Score =17.0; E_value=0.069; Accession=PF00560.24; Description=Leucine Rich Repeat
  Pfam annotation: Domain name=LRR_1; Domain location=747-772; Score =11.5; E_value=2.3; Accession=PF00560.24; Description=Leucine Rich Repeat
  Pfam annotation: Domain name=NACHT; Domain location=209-364; Score= -7.2; E_value=0.00022; Accession=PF05729.3; Description=NACHT domain
  Pfam annotation: Domain name=NB-ARC; Domain location=171-469; Score =179.4; E_value=9e-51; Accession=PF00931.13; Description=NB-ARC domain
  Pfam annotation: Domain name=TIR; Domain location=14-144; Score =144.5; E_value=2.9e-40; Accession=PF01582.11; Description=TIR domain
  Pfam module annotation: Pfam domain module=LRR_1::LRR_1::LRR_1::LRR _1::LRR_1::LRR_1::LRR_1::NACHT::NB-ARC::TIR; Domain location=558 -583::585-606::628-650::652-673::675-696::724-745::747-772::209 -364::171-469::14-144
MAAATRSRASIYDVFLSFRGEDTRYGFTGNLYKALCDKGIHTFFDEDKLHSGEEITPALLKAIQDSRIAITVLSEDFASSSFCLDELATILFCAQYNGMMVIPVFYKVYPCDVRHQKGTYGEALAKHKKRFPDKLQKWERALRQVANLSGLHFKDRDEYEYKFIGRIVASVSEKINPASLHVADLPVGLESKVQEVRKLLDVGNHDGVCMIGIHGMGGIGKSTLARAVYNDLIITENFDGLCFLENVRESSNNHGLQHLQSILLSEILGEDIKVRSKQQGISKIQSMLKGKKVLLILDDVDKPQQLQTIAGRRDWFGPGSIIIITTRDKQLLAPHGVKKRYEVEVLNQNAALQLLTWNAFKREKIDPSYEDVLNRVVTYASGLPLALEVIGSNMFGKRVAEWKSAVEHYKRIPNDEILEILKVSFDALGEEQKNVFLDIACCFKGCKLTEVEHMLRGLYNNCMKHHIDVLVDKSLIKVRHGTVNMHDLIQVVGREIERQISPEEPGKCKRLWLPKDIIQVLKHNTGTSKIEIICLDFSISDKEQTVEWNQNAFMKMENLKILIIRNGKFSKGPNYFPEGLRKFGHLTVLKFDNCKFLTQIPDVSDLPNLRELSFKGKLTSFPPLNLTSLETLQLSGCSSLEYFPEILGEMENIKQLVLRDLPIKELPFSFQNLIGLQVLYLWSCLIVELPCRLVMMPELFQLHIEYCNRWQWVESEEGSKRFTHVEYLDLSGNNFTILPEFFKELKFLRTLDVSDCEHLQKIRGLPPNLKDFRAINCASLTSSSKSMLLNQELYEAGGTKFMFPGTRIPEWFNQQSSGHSSSFWFRNKFPAKLLCLLIAPVSGAGYPFLKLEVFINSKFQEFWHYYLWDDIQSMLKLDIDHTYIFDLHAFAIKNDNRFEEMAWEKEWNHVEVRYPGVLAYEKRKRERGLLDLDGSLIKVTGFHIFKEGSMEEDIRFDDPYLGSSASENPSLLQTIVILDMGHKINIVLVMVDVETYIQEYAPELHWVRHMIDIGDDQDNTVIQIYIVRNNNE

SEQ ID NO: 108099 - protein, 905 aa, Glycine max
  Coding DNA Sequence Number=SeqID_16414
  Gene Ontology: Mol. function=nucleoside-triphosphatase activity; Cellular component=intrinsic to membrane; Biological process=innate immune response
  Homolog annotation: Hit_ID=Q5JBT4; Match level="QueryCoverage=99%, HitCoverage=93%, E-value=0.0, Identity=63%"; Hit description =Candidate disease-resistance protein SR1
  Pfam annotation: Domain name=BCMA-Tall_bind; Domain location=585-619; Score=14.6; E_value=0.053; Accession=PF09257.1; Description=BCMA, TALL-1 binding
  Pfam annotation: Domain name=LRR_1; Domain location=506-531; Score =9.6; E_value=5.1; Accession=PF00560.24; Description=Leucine Rich Repeat
  Pfam annotation: Domain name=LRR_1; Domain location=533-554; Score =10.1; E_value=4; Accession=PF00560.24; Description=Leucine Rich Repeat
  Pfam annotation: Domain name=LRR_1; Domain location=576-598; Score =11.8; E_value=2; Accession=PF00560.24; Description=Leucine Rich Repeat
  Pfam annotation: Domain name=LRR_1; Domain location=639-660; Score =7.0; E_value=16; Accession=PF00560.24; Description=Leucine Rich Repeat
  Pfam annotation: Domain name=LRR_1; Domain location=662-687; Score =6.7; E_value=18; Accession=PF00560.24; Description=Leucine Rich Repeat
  Pfam annotation: Domain name=NACHT; Domain location=211-365; Score= -3.9; E_value=0.00012; Accession=PF05729.3; Description=NACHT domain
  Pfam annotation: Domain name=NB-ARC; Domain location=172-465; Score =57.3; E_value=5.3e-14; Accession=PF00931.13; Description=NB-ARC domain
  Pfam annotation: Domain name=TIR; Domain location=14-146; Score =158.9; E_value=1.4e-44; Accession=PF01582.11; Description=TIR domain
  Pfam module annotation: Pfam domain module=BCMA-Tall_bind::LRR_1::LRR_ 1::LRR_1::LRR_1::LRR_1::NACHT::NB-ARC::TIR; Domain location=585 -619::506-531::533-554::576-598::639-660::662-687::211-365::172 -465::14-146
MAATTRSLAYNYDVFLSFTGQDTRQGFTGYLYKALCDRGIYTFIDDQELRRGDEIKPALSNAIQESRIAITVLSQNYASSSFCLDELVTILHCKSQGLLVIPVFYKVDPSHVRHQKGSYGEAMAKHQKRFKANKEKLQKWRMALHQVADLSGYHFKDGDSYEYEFIGSIVEEISRKFSRASLHVADYPVGLESEVTEVMKLLDVGSHDVVHIIGIHGMGGLGKTTLALAVHNFIALHFDESCFLQNVREESNKHGLKHLQSILLSKLLGEKDITLTSWQEGASMIQHRLQRKKVLLILDDVDKRQQLKAIVGRPDWFGPCSRVIITTRDKHLLKYHEVERTYEVKVLNQSAALQLLTWNAFKREKIDPSYEDVLNRVVTYASGLPLALEVIGYKWTEVDDILRDLYGNCTKHHIGVLVEKSLVKVSCCDTVEMHDMIQDMGREIERQRSPEEPGKCKRLLLPKDIIQVLKDNTGTSKIEIICLDFSISDKEETVEWNENAFMKMKNLKILIIRNCKFSKGPNYFPEGLRKLGHLTVLNFDRCEFLTKIPDVSDLPNLKELSFNWKLTSFPPLNLTSLETLNLGGCSSLEYFPEILGEMKNITLRCSLATMPKLCEFCITDSCNRWQWVESEEGSKRFAHVGYLNLPGNNFTILPEFFKELQFLTTLVVHDCKHLQEIRGLPPNLKHFDARNCASLTSSSKSMLLNQELHEAGGIEFVFPGTSIPEWFDQQSSGHSISFWFRNKFPAKLLCLHIAPSTGSFIRYPEVFINGKFQEFESHETDDTESMLGLDHTHIFDLQAYAFKNNNQFEEVAWEKEWNHVEVTYQSVLDDEEEESEEGVLDDEEEESEEGVLDDEEEEREEGVLELESSVIKAIGIHIVREEGSMEEDIRFDDPYLSSSASDYKP

SEQ ID NO: 108100 - protein, 1168 aa, Glycine max
  Coding DNA Sequence Number=SeqID_16415
  Homolog annotation: Hit_ID=A5BIS7; Match level="QueryCoverage=94%, HitCoverage=90%, E-value=5e-74, Identity=30%"; Hit description =Putative uncharacterized protein
  Pfam annotation: Domain name=DUF789; Domain location=877-1162; Score=- 160.9; E_value=0.00046; Accession=PF05623.3; Description=Protein of unknown function (DUF789)
MANLLCLSNVATVLYVVIQVVVCYLRGETSFGNMHIRLGATDYTGFGLLILQARKMHCAPQEIGNDSPKVSEARKDSISTVYQQQNKLTSLEDCQESSLLKINTDSRCAILPIFSFEPDGTWRIVALPVQCQNHINLASGVNMDGLQLLFPPPLNRLKIDQCKGPRVPLPPYAYSAKSCTKKGFTGSNVHRRCQNKIANRVSKLNELPDNSCSQSSLVSGPGLFPGSSAALNSSDKYTSHSKEDDKSLKKNSRKRARKKVKQSKKKSSDSGSPEREVLTEEYVSVSLTSETCSSNDVDKEDVGEFSTSDDRLIKSDCERNCNINIMEAPNSCNSYLNQGMSKATEPIVQSSARECATFEPKNQLQDEGPDFEVIDRGIKDIQHMEPCCFNDVHDSLVLDSVSGGFRSDESINANDTGKPSNKANCTITSDSGDGYSLGQNLTNGIHNNCEHNEGIWHGGQNCISNDKRVKQKRTMSKSSDLNKFGGAGILHGRKGKENSHSVWQKVQKNSSDDGSGDLKKVNTTSSQFASTLEKDPSVIKECNSVSVNGVSKTEDKKHLKNKIGRKSKAKVESGAKTGLDNYSWKSFQFNGSLSNDHGKASFQQNDMLHISSQEIDQQGLNTVSGFSDINCLMDGVQTNGVEQVTSEIGHSAEFHLEESGPQKSASNIIAKTNNENIDSQDSSFIMPGEYINQSNMSEELSPDSCNLEGDEVGQNEKEVSSADYNAQNHSSGTTLWKWIPVGKKDRGLEKSESNSAPPENSDASSRNNSNSESSVEPEVASSENPDSLNASRACNGQIYDKVSCLDEGENHKMGSQVARTLTEHRDKHEAANHMFYECENQDMLENYSYRIAQAVNDACKAQLACEAVHMATGGPVAEFERLLHFCSPVICKSLSSHSCSACSHNHGGGASLCRHEIPDLSLGCLWQWYEKHGSYGLEIRAQGHENPKRQGGVADFPFRAYFVPSLSAVQLFKNHENLCVNNGDRLPNSEVSEACEMVDISANSSTASQHSIFSVLFPQPRNQDKSSQTPKETASINNASIPSINSTCSGYKNWLEAIYQLNLQLMGTQQNWIQLTYEIFTLDLGSCIVSPTVGLQSYNAQGECWFQLKHSAPAAEMVNLEPSLLLKERLRTLEETASLMARAVVNKGNLTCTNRHPDYEFFLSRRRY

SEQ ID NO: 108101 - protein, 1964 aa, Glycine max
  Coding DNA Sequence Number=SeqID_16416
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=54%, HitCoverage=96%, E-value=0.0, Identity=52%"; Hit description =Functional candidate resistance protein KR1
  Pfam annotation: Domain name=AAA; Domain location=217-401; Score= -28.6; E_value=0.0065; Accession=PF00004.20; Description=ATPase family associated with various cellular activities (AAA)
  Pfam annotation: Domain name=LRR_1; Domain location=566-591; Score =10.4; E_value=3.6; Accession=PF00560.24; Description=Leucine Rich Repeat
  Pfam annotation: Domain name=LRR_1; Domain location=634-655; Score =9.3; E_value=5.7; Accession=PF00560.24; Description=Leucine Rich Repeat
  Pfam annotation: Domain name=LRR_1; Domain location=657-679; Score =5.9; E_value=25; Accession=PF00560.24; Description=Leucine Rich Repeat
  Pfam annotation: Domain name=LRR_1; Domain location=681-702; Score =1.7; E_value=1.5e+02; Accession=PF00560.24; Description=Leucine Rich Repeat
  Pfam annotation: Domain name=LRR_1; Domain location=703-725; Score =13.9; E_value=0.63; Accession=PF00560.24; Description=Leucine Rich Repeat
  Pfam annotation: Domain name=LRR_1; Domain location=727-748; Score =10.0; E_value=4.3; Accession=PF00560.24; Description=Leucine Rich Repeat
  Pfam annotation: Domain name=LRR_1; Domain location=750-774; Score =1.7; E_value=1.5e+02; Accession=PF00560.24; Description=Leucine Rich Repeat
  Pfam annotation: Domain name=LRR_1; Domain location=803-823; Score =0.6; E_value=2.3e+02; Accession=PF00560.24; Description=Leucine Rich Repeat
  Pfam annotation: Domain name=LRR_1; Domain location=828-849; Score =11.5; E_value=2.2; Accession=PF00560.24; Description=Leucine Rich Repeat
  Pfam annotation: Domain name=LRR_1; Domain location=851-876; Score =9.6; E_value=5.2; Accession=PF00560.24; Description=Leucine Rich Repeat
  Pfam annotation: Domain name=MotA_activ; Domain location=421-513; Score=-0.7; E_value=0.012; Accession=PF09114.1; Description =Transcription factor MotA, activation
  Pfam annotation: Domain name=NACHT; Domain location=216-369; Score =2.1; E_value=4e-05; Accession=PF05729.3; Description=NACHT domain
  Pfam annotation: Domain name=NB-ARC; Domain location=177-460; Score =169.6; E_value=8.1e-48; Accession=PF00931.13; Description=NB-ARC domain
  Pfam annotation: Domain name=TIR; Domain location=11-151; Score =159.4; E_value=1e-44; Accession=PF01582.11; Description=TIR domain
  Pfam module annotation: Pfam domain module=AAA::LRR_1::LRR_1::LRR _1::LRR_1::LRR_1::LRR_1::LRR_1::LRR_1::LRR_1::LRR_1::MotA _activ::NACHT::NB-ARC::TIR; Domain location=217-401::566-591::634 -655::657-679::681-702::703-725::...
  Pfam module annotation: Domain location=727-748::750-774::803 -823::828-849::851-876::421-513::216-369::177-460::11-151
MTVSASFSYDVFLSFRGSDTRYGFTGNLYNALSDRGIHTFIDEEELQRGDEIRPALVEAIKQSRMAILVFSKNYASSSFCLDELVKIMECVKAKGRLIFPIFYDVDPCHVRHQSGSYGEALAMHEERFTSSKENLKENMERLQKWKMALNQAADVSGKHYKLGNEYEHEFIGKIVKEISNKINRTPLHVADYPVGLESRVQTVKSLLEFESDTGVHIVGIYGIGGMGKTTLARAVYNSIADQFKGLCFLDDVRENATKHGLIHLQEMLLSEIVGEKDIKIGSVSKGISIIKHRLQRKKILLILDDVDKLEQLRATVGGPNWFGSGSRVIVTTRDKHLLASHGVDRKYEVEDLNEEESLELLCWNAFKDDKVDPCYKDISSQAVAYASGLPLALEVVGSLLFGKGIKEWESALEQYKKIPNKRIQDILKVSYNALEEDQQKIFLDIACCLKGYELAEVEDILCAHYGVCMKYGIGVLVDKSLIKIKNGRVTLHELIEVMGKEIDRQESPKELGKHRRLWFHKDIIQVLAENTGTSEIEIISLDFPLFEEDEEAYVEWDGEAFKKMENLKTLIIRNSHFSKGPTHLPNSLRVLEWWTYPLQDLPTDFHSNKLAICKLPRSCFTSLELSGISKKFMNLTVLNFDGTECLTQIPDISSLQNLVKLTFECCENLVAIHDSVGFLDKLKILSAFGCGKLMSFPPIKLISLEQLDLSSCSSLESFPEILGKMENITQLELKYTPLKEFPFSFRNLARLRDLVLVDCGNVQLPISIVMLPELAQIFALGCKGLLLPKQDKDEEEVSSMSSNVNCLCLSGCNLSDEYFPMVLAWFSNVKELELSCNNFTFLPECIKECHSLILLNLDNCEHLQEIRGIPPNLEYFSAGNCKSLSFCCTAMLLNQELHETGNTMFCLPGTRSPEWFEQQSIGPSLSFWFRNKFPVMDLCFVIGPMGKDSILFRPIMTINGNTMETQLTEKRCCLDFRALDYHILIIGTKYMKFGECLDKPLTKNEWNHVVVSIGIEPTPKDVIVKQTGLHVIKPESSMDDVQFTNPYKQPSFKEKQRLVDIVDCHRQFMQQQTTLVSLKPHVRQGGESFSLLPPQACKNNMNWDSNSTGITSTSSVQAAKKIGYIRFIATTPNGFIGFTAAAGQRNGFLAFFSIIGVDGIMAEEMHHQCPSNDGNDNDRTSSPVEQLPMAKLVDRARALLKCLLDVAVESVFETRLKTSFEHEKRVAVQDSKSPVAANISQSSVTYPTCSKMTSVKEEQPQLKLLSKKELPELSKFCISDDGGTKCNTLCSIGEESSVMQQNSVKETNLPNDNGIFPNIESNLNKQQHNDVNALYGDGENTEESLQMFDAKAGEQNEENNMSLQSRIQEAQSDSNAAKQVEHPDQKGDFSDDLVNAIKRIESRILAFQLCSNLSGSTKNSAGLHTTHEAANSDCPVIKRNNGASGSQMNSGKSLLDGRRLVNQKTCNESSKGENSISSNALVEPFCAVNGSLSQSQMANQNRWHHNGAESAKSIDIPQQIGTKQASVGEWLRSRNRIQNSVQNIAMIDRVKSLKRLVSGDAYFGSQASECIQGLRVPLNQDEHTKKHSMLVSKTNRESMVRLNPVAWSKTDQNRKEKGSESSYAQKLAGSKALISGREKPPLHQMVMKPTLLDQRSSEIKVSSHEHRDSRVLDRRITHKTGHLEPRKTRVLPQDHKLEEANSNSDSFRLSSWQGSANSSSDSEDYSLPDGTQYPSSAMMVDSAYEGSSEESNNSYLKKEGGTSRRFGSFKPYRHHRERNPKETVGRLRRLKNKLGLIFHHHHHHHHYHHHDDDVHGHRHTMWNQLQNVFHHKVKHGVTTNKVDKTRRGAVARVLPQRNHVGQFHRLAEGVLRHIRHSKKPNPFKLDGMKQLRNGHSQKKLRWWQNLRPHRRPKITKELLSLGARWNFSPCIYLLLAHGIQAPIRYAEEDFVSDCMVILHFVSAL

SEQ ID NO: 108102 - protein, 235 aa, Glycine max
  Coding DNA Sequence Number=SeqID_16417
  Gene Ontology: Mol. function=succinate-CoA ligase (ADP-forming) activity; Cellular component=mitochondrion; Biological process =tricarboxylic acid cycle
  Homolog annotation: Hit_ID=A7Q7K8; Match level="QueryCoverage=90%, HitCoverage=58%, E-value=6e-87, Identity=78%"; Hit description =Chromosome undetermined scaffold_60, whole genome shotgun sequence
  Pfam annotation: Domain name=Ligase_CoA; Domain location=50-214; Score=203.9; E_value=3.9e-58; Accession=PF00549.10; Description=CoA -ligase
MEERIKSSFILASSKADFDLCVRVKAALNRQSKTRLIGPNCPGIIKPGECKIGIMPGYIHKPGRIGIVSRSGTLTYEAVFQTTAVGLGQSTCVGIGGDPFNGTNFVDCLQKFLTDPQTEGIILIGEIGGTAEEDAAALIKLLITEEALIKIEKVEKNGIGNKESGTEKPVVAFIAGLTAPPGRRMGHAGAIVSGGKGTAQDKIKTLREAGVTVVESPAKIGAAMLDVFKQRGLVQ

SEQ ID NO: 108103 - protein, 111 aa, Glycine max
  Coding DNA Sequence Number=SeqID_16418
MELNACEELAKIASDFKCEKVLKTVDESIVCPTPQKNKEPLTVKSREGQTNLPEKCSFSFLIDNGIQFCNAMKKKRRQWRCQFCTAMKKNCQIKIDNGSAKGNVGKIESSM

SEQ ID NO: 108104 - protein, 425 aa, Glycine max
  Coding DNA Sequence Number=SeqID_16419
  Homolog annotation: Hit_ID=A7PAY0; Match level="QueryCoverage=100%, HitCoverage=99%, E-value=0.0, Identity=81%"; Hit description =Chromosome chr16 scaffold_10, whole genome shotgun sequence
  Pfam annotation: Domain name=BRO1; Domain location=30-408; Score= -155.0; E_value=0.0011; Accession=PF03097.9; Description=BRO1-like domain
MGCVVSAPKDSGGNRRRPGSIGELSVYVPGLRIPKPVDFAQSLGDYLSKNIVERLSALRTRIVVMAGQEGPTITRTKRKTQHGGSTLADLLQALEDYLPVVLGLVKNGSHLQYKVQFTWVNQEDDKEETTMSNAWYEVLSVLHLMAMLSLSQANLLLFPRSSSSNGHLPKVSEESRRASVDIFLKAAGYLDCAVKHVLPQLPVELRRNLPVDLAEGVLRALCLQALGQAIDIQLGMAIDSTKATLAVKRRLACEMVKCWQQAQDNIMNLPLANGWGEKHCLFVKWKYVEAKAAAYYYHGLILDEGNTEKSHGMAVAALQAADEYFKESKKLCEAFNAASPLSRNSPPWGTMKYLSEKIPKDTSSKVRINRDLYSYERIMETAPTLPDFSLALKPDEYQLPQVDSSWRTENIKVGQTDPNHLKGDK

SEQ ID NO: 108105 - protein, 1244 aa, Glycine max
  Coding DNA Sequence Number=SeqID_16420
  Gene Ontology: Mol. function=nucleoside-triphosphatase activity; Cellular component=intrinsic to membrane; Biological process=innate immune response
  Homolog annotation: Hit_ID=Q5JBT4; Match level="QueryCoverage=70%, HitCoverage=91%, E-value=0.0, Identity=53%"; Hit description =Candidate disease-resistance protein SR1
  Pfam annotation: Domain name=LRR_1; Domain location=533-554; Score =10.9; E_value=2.9; Accession=PF00560.24; Description=Leucine Rich Repeat
  Pfam annotation: Domain name=LRR_1; Domain location=576-598; Score =11.2; E_value=2.6; Accession=PF00560.24; Description=Leucine Rich Repeat
  Pfam annotation: Domain name=LRR_1; Domain location=600-622; Score =7.3; E_value=14; Accession=PF00560.24; Description=Leucine Rich Repeat
  Pfam annotation: Domain name=LRR_1; Domain location=624-646; Score =3.5; E_value=68; Accession=PF00560.24; Description=Leucine Rich Repeat
  Pfam annotation: Domain name=LRR_1; Domain location=674-695; Score =8.5; E_value=8; Accession=PF00560.24; Description=Leucine Rich Repeat
  Pfam annotation: Domain name=LRR_1; Domain location=697-722; Score =7.3; E_value=13; Accession=PF00560.24; Description=Leucine Rich Repeat
  Pfam annotation: Domain name=NACHT; Domain location=214-369; Score= -8.5; E_value=0.00027; Accession=PF05729.3; Description=NACHT domain
  Pfam annotation: Domain name=NB-ARC; Domain location=175-469; Score =174.4; E_value=3e-49; Accession=PF00931.13; Description=NB-ARC domain
  Pfam annotation: Domain name=TIR; Domain location=16-149; Score =156.1; E_value=9.7e-44; Accession=PF01582.11; Description=TIR domain
  Pfam module annotation: Pfam domain module=LRR_1::LRR_1::LRR_1::LRR _1::LRR_1::LRR_1::NACHT::NB-ARC::TIR; Domain location=533-554::576 -598::600-622::624-646::674-695::697-722::214-369::175-469::16-149
MAWGSRSSSSSSNYDVFLSFRGEDTRSAFTGHLYNTLQSKGIHTFIDDEKLQRGEQITPALMKAIEDSRVAITVLSEHYASSSFCLDELATILHCDQRKRLLVIPVFYKVDPSDVRHQKGSYGEALAKLERRFQHDPEKLQNWKMALQRVADLSGYHFKEGEGYEYKFIEKIVEEVSRVINLCPLHVADYPVGLKSRVLHVRRLLHAGSDHGVHMIGIHGMGGVGKSTLARAVYNELIIAEKFDGLCFLANVRENSNKHGLEHLQGKLLLEILGEKSISLTSKQQGISIIQSRLKGKKVLLIIDDVDTHDQLQAIAGRPDWFGRGSKIIITTRDKQLLASHEVNKTYEMKELDENHALQLLTWQAFKKEKADPTYVEVLHRVVTYASGLPLALEVIGSHLVGKSIQEWESAIKQYKRIAKKEILDILKVSFDALEEEEKKVFLDIACCFKGWKLTELEHVYDDCMKNHIGVLVEKSLIEVRWWDDAVNMHDLIQDMGRRIDQQESSKEPRKRRRLWLTKDIIQVLEENSKFRNLKVLNFEQCEFLTEIPDVSVLLNLEELSFHRKLTTFPPLNLTSLERLELSCCSSLENFPEILGEMKNLLKLELSGLLGVKGLPVSFQNLVGLQSLDLDDCENFLLPSNIIAMMPKLSSLKAISCKGLQWVKSEEGFMQLHHVKTLSLRENNFTFLPECIRELQFLTTLDVNGCYHLQEIRGVPPNLIDFSAIDCISLSSSSTSMFLNQELHEAGQTKFGFPGATIPEWFNHQSRGTSSSFWFRNEFPDNVLCLLVARVERIGDNDIPMPVVLLNGELLIDRDHHVQLGKKKWDYTYLFDLKSVLDELVDLSEVVLEKEWNHVEITYAGQIETSLVKATGIHVFRQDDIRYDDPYGKRKLEHDLSSESQPLNKKPRLSRWVGPERIINLLGNAADGALFTNAERRYSHISMVSCRRCGVLEETCLHALRDCPEVAAFWRTFFGIAVDLLWESRNDLVFYQNGQTWAYVHLRATDIVFKRYKDYMRARASHNLMTRNLLKWRRPLPLSHGHWLLSLNVSGAYDPSSGTAACGGIFRDYHDRFVLGFSVKLGECWSNDEAEIWGIYHGMKIARKYDIWGLFRDILRQHSDKHNVFDYIRISPKIARQHEFGKIVVVSGSEKAIGFVSDGCPTSTSTSTSTSMQHCFPFCDELKALTSATNHSYFMYAPDSYLMHTPDDPAAYSFVKFGLSMKQQAASIFSACPSFCQPFVSEYI

SEQ ID NO: 108106 - protein, 125 aa, Glycine max
  Coding DNA Sequence Number=SeqID_16421
MYSKILVLECNILEQEAKAFLLSTPIPIKATNSIRNREDTMANNNEEEEEAVAPMVKLGSYGAEVRLLVGGEESAALGYSAAHTFQTQCLRLSSFLATLPRLLWPLSLHSSIPFLIGIYLSQCSG

SEQ ID NO: 108107 - protein, 474 aa, Glycine max
  Coding DNA Sequence Number=SeqID_16422
  Gene Ontology: Mol. function=DNA binding; Cellular component=cell outer membrane
  Homolog annotation: Hit_ID=Q6H5V6; Match level="QueryCoverage=23%, HitCoverage=34%, E-value=4e-13, Identity=38%"; Hit description =Putative uncharacterized protein OSJNBa0014E22.25
MQLKQLQSCFRDPRLSPVTCFQTQGEFGLVVEVFYEVCYSADPPKFQQRGWSHAASVPSEEPEAPKGQKRVPRHQRRAMVESFVNKYRAENAGKFPKISDTQKQVGGSYYVIREIVLELEYESKMNSSNSVDKFFVGKKFDESKLLTTEPVNVPSGNIEIAKESPVKDDSQSVVLDDKESVNTGYDHLEEKREPQTSYLERRLSDKLEIMSTPSNHCIAPESNIVEKFSKEPYPSSLDMPNDIKSEEAVSTYSDSFAPEHSQEEREHSPLFSENDGTGYDKAQGREYDFVRVEDHQKVEEKCIKKADCEIREQPDLEDLSRELLHSSLKVPNDVKSKEAVSNSSDSATQERHPLKEEIDRFSAPFIEKSVSSCSEGQTHDSKFVDMEKHSAFEKGYARKDQDTVDGLKHKIGQSHRSLELDESKMILRLLTFSQISRDSSNKRETSVAVGAQKSTLWENMKSFATGILNIWKKS

SEQ ID NO: 108108 - protein, 299 aa, Glycine max
  Coding DNA Sequence Number=SeqID_16423
  Gene Ontology: Mol. function=metal ion binding
  Homolog annotation: Hit_ID=A7Q9Q2; Match level="QueryCoverage=97%, HitCoverage=88%, E-value=3e-81, Identity=51%"; Hit description =Chromosome chr5 scaffold_67, whole genome shotgun sequence
  Pfam annotation: Domain name=DUF789; Domain location=4-292; Score =413.6; E_value=2.9e-121; Accession=PF05623.3; Description=Protein of unknown function (DUF789)
MTFMSCFNDLNPLWQPLGKDTVEYFTLQDLWDCYYEWSAYGAGTPVMLEDGDTVTQYYVPYLSAIQIYTSKSVAASRNRREDSDGIEFESDSWSEDSGSDNLSRSLSNNSSKAWEDAVSEDSSCDQEGSWLRDNKLGYLYLQYTEMASPYSRVPLAEKIDKLAQSHPALLTLKSVDLSPASWMAVSWNTEKDLEACFLTYHTLSSSFEDCAMECDDIDIGNDLHCSIQGEKCKEKNSGHVSLLPFGLATYKMQGDIWLNPEPYDNEKISYLYSAADSWLKQLNVHHHDFNFFTLHNNTL

SEQ ID NO: 108109 - protein, 246 aa, Glycine max
  Coding DNA Sequence Number=SeqID_16424
  Gene Ontology: Mol. function=hydrolase activity; Cellular component =mitochondrion; Biological process=metabolic process
  Homolog annotation: Hit_ID=A7QAG1; Match level="QueryCoverage=91%, HitCoverage=58%, E-value=3e-67, Identity=58%"; Hit description =Chromosome undetermined scaffold_71, whole genome shotgun sequence
MDYLYGYCDAEAYPLLFPDVGHPTSFRLKKLYFGEYIGLTGAQLDGAEMVACGLATHFVPSVKINTLENVLQTVTNSNLPIAEVIETFAEKANVKEDSSFRRLEIINKCFSKGTLEEIIICLEKESENGAEEWIKNALSSMRSSCPLSLKIFLKSIRTGRVQNIEQCLYRDYTIAGHFLRRTISNDFYEGTRAKLIDKDNKPKWEPSKLELVSEEMVDQCFRDIDEEEMDCLKLPDRSNSQIASRL

SEQ ID NO: 108110 - protein, 184 aa, Glycine max
  Coding DNA Sequence Number=SeqID_16425
  Gene Ontology: Mol. function=oxidoreductase activity; Biological process=electron transport
  Homolog annotation: Hit_ID=A7QRP4; Match level="QueryCoverage=83%, HitCoverage=58%, E-value=6e-26, Identity=35%"; Hit description =Chromosome undetermined scaffold_151, whole genome shotgun sequence
MSLKNNMVVLKIHTCLTYNPGPEFLKNSIRVKPDLDGLGALGDTGWYCIRAILWTVDYELPKSVLAFPGAILNEEVLGTKGCLRLHDFALPFEESLGHGKFLEASELDYGKIEPGMWCPKPNEHVVETGFSQDALMVKEFADLVQKVKGCEMKPEKTWPVLSRKQDSGGVGCSERVDSERLPAC

SEQ ID NO: 108111 - protein, 618 aa, Glycine max
  Coding DNA Sequence Number=SeqID_16426
  Gene Ontology: Mol. function=unfolded protein binding; Cellular component=cytoplasm; Biological process=cellular protein metabolic process
  Homolog annotation: Hit_ID=A7PD22; Match level="QueryCoverage=98%, HitCoverage=97%, E-value=0.0, Identity=87%"; Hit description =Chromosome chr17 scaffold_12, whole genome shotgun sequence
  Pfam annotation: Domain name=Cpn60_TCP1; Domain location=31-590; Score=509.8; E_value=3.2e-150; Accession=PF00118.15; Description=TCP- 1cpn60 chaperonin family
MHAPVLVLKDSLKRESGSKVRYAIIQAAEAVADVVRTTLGPRSMLKMLLDAQGGIVVTNDGNAILRELDLAHPAAKSMIELSRTQDEEVGDGTTSVIILAGEMLHVADAFIDKIHPTVICRAYAKALEDAIAVLDKIAMPINAQDRGIMLGLVKSCIGTKFTGRFGDLIANCFLKGELGSKAGREICLLDLCVCVLCVESKKVSVLNPIILCKRKPSLCSIADRKGGSQLVKLDDLAIDATTTVGVEVGQGLRDVDIKNYIKVEKVPGGQLEDSRVLKGVMINKDVVAPGKMRRKIVNPRIILLDCPLEYKKGENQTNAELLKEEDWSLLLKMEEEYIEELCMQILKFKPDLVITEKGLSDLACHYLSKHGVSAIRRLRKTDNNRIAKACGAVIVNRPDELQESDVGTGAGLFEVKKIGDEYFAFIVDCKEPKACTVLLRGASKDLLNEVERNLQDAMSVARNIIKNPKLVPGGGATELTVSAALKQKSSSIEGIEKWPYEAAALAFEAIPRTLAQNCGVNVIRTMTALQGKHANGENAWIGIDGNTGSITDMKECKIWDAYNVKAQAFKTAIEAACMLLRIDDIVSGIKKKQAPGATPSKPKVETEADADSEQILPD

SEQ ID NO: 108112 - protein, 105 aa, Glycine max
  Coding DNA Sequence Number=SeqID_16427
  Homolog annotation: Hit_ID=A7QCB9; Match level="QueryCoverage=69%, HitCoverage=8%, E-value=2e-09, Identity=50%"; Hit description =Chromosome undetermined scaffold_77, whole genome shotgun sequence
MVMERDPAAAPRVPEDDNVLIMTPTSGEGAEKMDAEDGVNCSDYEHDIENEDLWDGNEESGGYWSGIYDRNKAHTKPLLMKGTNTTSQIAIIGANLCPIESLDYE

SEQ ID NO: 108113 - protein, 342 aa, Glycine max
  Coding DNA Sequence Number=SeqID_16428
  Gene Ontology: Mol. function=carboxylesterase activity; Cellular component=nucleus; Biological process=metabolic process
  Homolog annotation: Hit_ID=Q0ZPW9; Match level="QueryCoverage=97%, HitCoverage=98%, E-value=1e-123, Identity=64%"; Hit description=CXE carboxylesterase
  Pfam annotation: Domain name=Abhydrolase_3; Domain location=99-316; Score=282.3; E_value=1e-81; Accession=PF07859.4; Description =alphabeta hydrolase fold
  Subcellular localization annotation: CTP_CleavageSite=34; ConfidenceScore=5.41e-01
NDTTMASTTSNSQQPKPVLPWRARISISFLCTLSDAARRSNGTVNRLLINLLDLKSHPNAAPVNGVSSNDVTVDASRNLWCRVFSPTVAAASGGALPVVIFFHGGGFAFLSPDSLAYDAVCRRFCRQIPAVVVSVNYRLTPEHRYPSQYDDGEDILKFLDENRAVLPENADLSKCFLAGDSAGANLAHNVAVRVPKSGLRIIRVVGLVSIQPWFGGEERTAAEEKFKGAPLVSMARTDWLWKVFLPDGSDRDHVAANVSGPNSEDLSGLDYPDTLVVVGGFDPLQDWQRRYYEWLKNSGKNVQLIEYPKMIHAFYVFDDLPESSQLITQIKDFINKRISELN

SEQ ID NO: 108114 - protein, 249 aa, Glycine max
  Coding DNA Sequence Number=SeqID_16429
  Gene Ontology: Mol. function=structural constituent of ribosome; Cellular component=ribonucleoprotein complex; Biological process =translation
  Homolog annotation: Hit_ID=A7P6K3; Match level="QueryCoverage=99%, HitCoverage=100%, E-value=1e-116, Identity=89%"; Hit description =Chromosome chr9 scaffold_7, whole genome shotgun sequence
  Pfam annotation: Domain name=KH_2; Domain location=45-102; Score =45.8; E_value=1.5e-10; Accession=PF07650.8; Description=KH domain
  Pfam annotation: Domain name=Ribosomal_S3_C; Domain location=104-201; Score=88.9; E_value=1.7e-23; Accession=PF00189.11; Description =Ribosomal protein S3, C-terminal domain
  Pfam module annotation: Pfam domain module=KH_2::Ribosomal_S3_C; Domain location=45-102::104-201
MATQMSKKRKFVADGVFFAELNEVLTRELAEDGYSGVEVRVTPMRTEIIIRATRTQAVLGEKGRRIRELTSVVQKRFKFPENSVELYAEKVNNRGLCAIAQAESLRYKLLGGLAVRSVVLRCIPSLEKLWACYGVLRFVMESGAKGCEVIVSGKLRAQRAKSMKFKDGYMISSGQPVKDYIDSAVRHVLLRQGVLGIKVKIMLDWDPKGKQGPKTPLPDLVTIHTPKEEEEYARPAAVLATNIEVPVAS

SEQ ID NO: 108115 - protein, 394 aa, Glycine max
  Coding DNA Sequence Number=SeqID_16430
  Gene Ontology: Mol. function=oxidoreductase activity; Cellular component=extracellular region; Biological process=response to oxidative stress
  Homolog annotation: Hit_ID=Q9SZB9; Match level="QueryCoverage=78%, HitCoverage=99%, E-value=1e-126, Identity=72%"; Hit description =Peroxidase 47 precursor
  Pfam annotation: Domain name=peroxidase; Domain location=42-274; Score=411.9; E_value=9.3e-121; Accession=PF00141.14; Description =Peroxidase
MANLLTMFFVMEMIVVSGFSFGASGLSMNYYLLSCPIAEPVVKNTVNTALQDDPTLAAGLVRMHFHDCFIEGCDGSVLIDSTKDNTAEKDSPANLSLRGYEVIDDIKEELEKQCPGVVSCADIVAMAARDAVFFAGGPVYDIPKGRKDGTRSKIEDTINLPAPIFNASELIKMFGQRGFSTRDMVALSGAHTLGVARCSSFKNRLTQVDSEFAKTLSKTCSAGDTAEQPFDSTRSDFDNQYFNALVSNNGVLTSDQTLYNSPQTRNIVNAYAMNQALFFLDFQQAMVKMSMLDAKQGSKGECGEAMEKMNKAFEKVKIMVGMDAEDEDQQAAALNSSNSFAFMDDFNRNCTLSTTQDNRMQDTCRNHNTHSGHNSRPSHNCGSEKFCNVIALVR

SEQ ID NO: 108116 - protein, 72 aa, Glycine max
  Coding DNA Sequence Number=SeqID_16431
MHSSLHPPSKLERPSPHRRVSPPLPPHLRHPQQIYGAPASKWKILKNRRLQNWEYTDIQILKILESWDFREK

SEQ ID NO: 108117 - protein, 162 aa, Glycine max
  Coding DNA Sequence Number=SeqID_16432
MVPTWQEPRKQRHFLRILPSTEDSRHGSRILIRKTKGMKNRELGLVGELAWNGEKEKNFGSVFADWEVGVREFMQGKREKIGLEGRGLSNKIELRSVYRRRKENCQHKQHDTPISYISGLERKKPPMVLFTMDNRCKDLVLFVNVFSWMFIFSGHLLLDVIY

SEQ ID NO: 108118 - protein, 143 aa, Glycine max
  Coding DNA Sequence Number=SeqID_16433
  Gene Ontology: Mol. function=metal ion binding; Cellular component =cellular_component; Biological process=response to stress
  Homolog annotation: Hit_ID=A7P2X6; Match level="QueryCoverage=97%, HitCoverage=63%, E-value=1e-24, Identity=39%"; Hit description =Chromosome chr1 scaffold_5, whole genome shotgun sequence
  Pfam annotation: Domain name=zf-A20; Domain location=4-28; Score =35.9; E_value=1.5e-07; Accession=PF01754.7; Description=A20-like zinc finger
  Pfam annotation: Domain name=zf-AN1; Domain location=83-123; Score =61.1; E_value=3.8e-15; Accession=PF01428.7; Description=AN1-like Zinc finger
  Pfam module annotation: Pfam domain module=zf-A20::zf-AN1; Domain location=4-28::83-123
MEVPSLCASGCGFYGSSANKNLCSKCYKDYLKVTKSNECETKNLNDQVFVLDQSSTSEDSNTDAMVDVTLTDAEGMNNKRKRCKCCNKKVGLLGFGCRCGDVFCGTHRYPEKHACKVDLKEIGRQGLVKQNPVCIGDKLEHKI

SEQ ID NO: 108119 - protein, 386 aa, Glycine max
  Coding DNA Sequence Number=SeqID_16434
  Gene Ontology: Mol. function=endopeptidase inhibitor activity; Cellular component=endoplasmic reticulum lumen; Biological process =response to stress
  Homolog annotation: Hit_ID=P30236; Match level="QueryCoverage=45%, HitCoverage=91%, E-value=1e-67, Identity=73%"; Hit description=22.0 kDa class IV heat shock protein precursor
  Pfam annotation: Domain name=CS; Domain location=261-353; Score=-0.2; E_value=0.022; Accession=PF04969.7; Description=CS domain
  Pfam annotation: Domain name=HSP20; Domain location=264-368; Score =170.8; E_value=3.5e-48; Accession=PF00011.12; Description=Hsp20alpha crystallin family
  Pfam annotation: Domain name=Kunitz_legume; Domain location=31-229; Score=-14.7; E_value=0.00044; Accession=PF00197.9; Description =Trypsin and protease inhibitor
  Pfam module annotation: Pfam domain module=CS::HSP20::Kunitz_legume; Domain location=261-353::264-368::31-229
MNKFVLVLFTVSWVLLFGLLDGKPPIGSGRVIWDTGGQQLFASYAYYITARHPDLGSGGLKLIKTGNSTCPNTILQYFPKYTHGLPMYLLISVISNFIVYEGTPLAIFMAKKPNCVESLVPDPMKGSPDPPSPLNPPNSSRLLVFVDNSIHKTCVGTAGPEAHPGLLTYSGTFHIEILENVRFGYSSYKLVFCFDGSDYQNCSYIGTYDNAKGSLLPFTNHPNTLLADLWSNHFPDPFRVLEQIPFGVDKDETFTALSSHARVDWKETPEGHVIMLDVPGLKRDEIKIEVEGNRVLRVSGERKREEEKEGDHWHRVERSYGKFWRQFKVPDNVDLDSVKAKMENGVLTLTMNKLSPDKVKGPRLVSIAGDDEQAPKLKGNEDKQEL

SEQ ID NO: 108120 - protein, 392 aa, Glycine max
  Coding DNA Sequence Number=SeqID_16435
  Gene Ontology: Mol. function=DNA binding; Cellular component =mitochondrion; Biological process=regulation of transcription, DNA -dependent
  Homolog annotation: Hit_ID=A7QGT6; Match level="QueryCoverage=69%, HitCoverage=63%, E-value=2e-64, Identity=52%"; Hit description =Chromosome chr16 scaffold_94, whole genome shotgun sequence
  Pfam annotation: Domain name=AT_hook; Domain location=69-81; Score =16.7; E_value=0.032; Accession=PF02178.10; Description=AT hook motif
  Pfam annotation: Domain name=DUF296; Domain location=141-261; Score =199.6; E_value=7.4e-57; Accession=PF03479.6; Description=Domain of unknown function (DUF296)
  Pfam module annotation: Pfam domain module=AT_hook::DUF296; Domain location=69-81::141-261
MEEREIFSSGHAVNLLEAPHSFHVALNSVQFSGPTVETPAPAPAPAPAPAPAPVPVIAPVMNSGSTEGKKKRGRPRKYGPDGKVALSPMPISASIPFTGDFSAWKRGRGKPLESIKKTFKFYEAGGAGSGDGIAYSVGANFTPHILTVNDGEDVTMKIMSFSQQGYRAICILSANGTISNVTLRQPTSSGGTLTYEGRFEILSLSGSYITTENGLTKSRSGGMSISLAGPDGRVMGGGLAGLLVAAGPVQSFDGLSCAISTKKKNKDRAHALKELNYMYEEHFTGHFSCHLLHQVVVASFLPGHQLEQQKPKKPRVEHIISMAAPMHVNPTSAAEEIRIGLGGVKPIMTPAAFQVDHIFGNGQSSGNSASDDSASFPENESNPSHADAGVAC

SEQ ID NO: 108121 - protein, 235 aa, Glycine max
  Coding DNA Sequence Number=SeqID_16436
  Gene Ontology: Mol. function=protein binding; Cellular component =chloroplast; Biological process=protein metabolic process
  Homolog annotation: Hit_ID=A7QGU0; Match level="QueryCoverage=75%, HitCoverage=77%, E-value=1e-73, Identity=77%"; Hit description =Chromosome chr16 scaffold_94, whole genome shotgun sequence
  Pfam annotation: Domain name=Clp_N; Domain location=172-225; Score =16.2; E_value=0.018; Accession=PF02861.11; Description=Clp amino terminal domain
  Pfam annotation: Domain name=Clp_N; Domain location=95-147; Score =42.6; E_value=1.4e-09; Accession=PF02861.11; Description=Clp amino terminal domain
  Pfam module annotation: Pfam domain module=Clp_N::Clp_N; Domain location=172-225::95-147
  Subcellular localization annotation: CTP_CleavageSite=58; ConfidenceScore=5.89e-01
MASIPTLSSPLPTISAHSSPHSNPNNHCTLSPTSLFGTRITLLRATSSSRSLPNTNCRATSATVSFSLPTPKPLSDTPEKTPKWSARAIKSYAMGELEARKLKYPNTGTEALLMGILVEGTSKAAKFLRANGITLFKVREETVELLGKSDLYFFSPEHPPLTEPAQKALDWAIEEKLKSGEGGEINVTHLLLGIWSQKESAGQQILDTLGFNDEKAKELAKTIDGDVDLSFKRQA

SEQ ID NO: 108122 - protein, 80 aa, Glycine max
  Coding DNA Sequence Number=SeqID_16437
MREHFAYSSGGRMLSSKVCLIGVSSNYDLVHLHDDYDITSYQVSNIHTGDVVASDVVDVSCQTELVKKVDMPMEEMPDLA

SEQ ID NO: 108123 - protein, 94 aa, Glycine max
  Coding DNA Sequence Number=SeqID_16438
  Subcellular localization annotation: CTP_CleavageSite=31; ConfidenceScore=5.15e-01
MHECKRNSCFLNGGCKGNTMNIKGCLKVRVRAHTPSSPRGETNGERNSTSTIPTTSNKKCLLNLPTKANNNATSIATTRKKKLTLEYNNKEDRR

SEQ ID NO: 108124 - protein, 397 aa, Glycine max
  Coding DNA Sequence Number=SeqID_16439
  Gene Ontology: Mol. function=metal ion binding
  Homolog annotation: Hit_ID=A7Q9D3; Match level="QueryCoverage=50%, HitCoverage=63%, E-value=3e-71, Identity=64%"; Hit description =Chromosome chr19 scaffold_66, whole genome shotgun sequence
MLKTETSEPTNLVIRQAQLNNPIGILQRVVGISRNPLQPDVIERLVGSGNLRGELGDPDTGNGATCRQTGAGGGAWEGGFGGGGRGEVGTASFEVELEEVEERAGDESPEEKASAWRTKKKGGSVGLRGLAGWAFWAFCSGSLTRVECGGGFGLCGGGAAAAGRTQEGTNKEKKEKQNKPTNERVFHYQNGSSSNLGSNPFNSSTWMMLEFITLVVQITIITFTLAISERERSIWPMRIWISGYDIGCILNFLLLIHLTQGNAQNLSDMEQQRNNEETRMSHLMNKWRLELFFAIWFVLGIVWVFESRFGSFHEAPKLHVVCIILLAWNAMCYSFHLLLFVLLCCCVPLISTLLGYNMNMASSDDQISQLPSWRHKEVKSSEDPECCICLAKYKDKE

SEQ ID NO: 108125 - protein, 373 aa, Glycine max
  Coding DNA Sequence Number=SeqID_16440
  Homolog annotation: Hit_ID=Q2HV76; Match level="QueryCoverage=89%, HitCoverage=93%, E-value=2e-33, Identity=34%"; Hit description=F-box protein interaction domain; Galactose oxidase, central
  Pfam annotation: Domain name=F-box; Domain location=7-54; Score=29.7; E_value=1.1e-05; Accession=PF00646.24; Description=F-box domain
  Pfam annotation: Domain name=FBA_1; Domain location=209-367; Score= -24.0; E_value=0.00055; Accession=PF07734.4; Description=F-box associated
  Pfam module annotation: Pfam domain module=F-box::FBA_1; Domain location=7-54::209-367
MKHMNATLPHTLPEDLITEILMMLPVRSILRFKCMCKLWFSLISHPEFARSHFALAATPTTRLYLSANDHQVECTDIEASLHDENSAKVVFNYPLPSPEDKYYNRMIDIVGSCRGFILLMTTSGALNFIIWNPSTGLRKGISYLMDDHIYNFYADRCGFGYDSSTDDYVIVNLRIEAWRTEVHCFSLRTNSWSRMLGTALYYPLDLGHGVFFNGALHWFVRRCDGRRQAVIISFDVTERRLFEILLPLNFAVKDQICDLRVMEGCLCLCGANIGRETTIWMMKEYKVQSSWTKLLVVPIYNQHTGPPLLFFPPVFYPICLTKKDEFLGSNHKTLVKLNKKGDLLERHARCHNIGCGILLRCGVYRESLLSLPE

SEQ ID NO: 108126 - protein, 94 aa, Glycine max
  Coding DNA Sequence Number=SeqID_16441
MKLHVLLLLILLFCIASELTTLSVSDDFTSHSLERCDAETEFNSYGYIAGIKKALNDTSCSYQVIIAASCSSPNFTMENIAIRFGDVHGNQGYV

SEQ ID NO: 108127 - protein, 35 aa, Glycine max
  Coding DNA Sequence Number=SeqID_16442
MYAHGDKIFVKKGRCGKVKMMVVDVLAYGLQLGLR

SEQ ID NO: 108128 - protein, 202 aa, Glycine max
  Coding DNA Sequence Number=SeqID_16443
  Gene Ontology: Mol. function=carboxylesterase activity; Cellular component=nucleus; Biological process=metabolic process
  Homolog annotation: Hit_ID=Q0ZPV7; Match level="QueryCoverage=80%, HitCoverage=48%, E-value=5e-48, Identity=56%"; Hit description=CXE carboxylesterase
  Pfam annotation: Domain name=Abhydrolase_3; Domain location=120-200; Score=-72.6; E_value=0.0061; Accession=PF07859.4; Description =alphabeta hydrolase fold
  Subcellular localization annotation: CTP_CleavageSite=68; ConfidenceScore=5.33e-01
MMPFFSFTHYKSFWRSSIAFAFAFAFFLTFLLIANSLTLQTQSTTIPCNKDPYKELNLIPNPNGTVTRPNKPPQSPPAPDPNLNTLVLSKDLSINQSKSTWARVYLPRVALDHSSKLPLLVFFHGGGFIFLSAASTIFHDFCFNMANDVVAVVASIEYRLAPEHRLPAAYEDAVEALQWIKTNRDDWLTNYVDYSNVFLMGS

SEQ ID NO: 108129 - protein, 341 aa, Glycine max
  Coding DNA Sequence Number=SeqID_16444
  Gene Ontology: Mol. function=oxidoreductase activity; Cellular component=cytoplasm; Biological process=response to gibberellin stimulus
  Homolog annotation: Hit_ID=O04280; Match level="QueryCoverage=99%, HitCoverage=100%, E-value=0.0, Identity=82%"; Hit description =Gibberellin 20-oxidase
  Pfam annotation: Domain name=2OG-FeII_Oxy; Domain location=185-284; Score=167.5; E_value=3.5e-47; Accession=PF03171.11; Description=2OG -Fe(II) oxygenase superfamily
MAIECITNIQSMSQPQKHHQDHKEDEAPLVFDASLLRHELNLPKQFIWPDEEKPCMNVPELAVPLIDLGGFISGDPVATMEAARMVGEACQKHGFFLVVNHGIDAKLISHAHSYMDDFFEIPLSQKQRAQRKTGEHCGYASSFTGRRVYQDYCDAMSNLSLGIMELLGMSLGVGKACFSEFFEENNSIMRLNYYPPCQKPDLTLGTGPHCDPTSLTILHQDQVGGLQVFVDNEWHSVSPNFNAFVVNIGDTFMALSNGRYKSCLHRAVVNSRTTRKSLAFFLCPKGDKVVSPPSELVDDLTPRVYPDFTWPMLLEFTQKHYRADIKTLEAFTNWLLQRKTN

SEQ ID NO: 108130 - protein, 53 aa, Glycine max
  Coding DNA Sequence Number=SeqID_16445
MVTCMTLLITQMWLPEPLELPSLSRSTLVEGLGLSCGAGYTRDLKRNIIKCAL

SEQ ID NO: 108131 - protein, 271 aa, Glycine max
  Coding DNA Sequence Number=SeqID_16446
  Gene Ontology: Mol. function=hydrolase activity; Cellular component =ribonucleoprotein complex; Biological process=mRNA modification
  Homolog annotation: Hit_ID=A7QD49; Match level="QueryCoverage=55%, HitCoverage=58%, E-value=1e-40, Identity=31%"; Hit description =Chromosome undetermined scaffold_80, whole genome shotgun sequence
  Pfam annotation: Domain name=LSM; Domain location=132-202; Score =10.4; E_value=0.0093; Accession=PF01423.13; Description=LSM domain
  Pfam annotation: Domain name=PPR; Domain location=135-169; Score=4.9; E_value=2; Accession=PF01535.11; Description=PPR repeat
  Pfam annotation: Domain name=PPR; Domain location=34-67; Score=12.6; E_value=0.25; Accession=PF01535.11; Description=PPR repeat
  Pfam module annotation: Pfam domain module=LSM::PPR::PPR; Domain location=132-202::135-169::34-67
MATVIRSCGVLVGKMLGYQVLGSVIKSGLDTTMFVANSLISMFGNCDSIEEASCVFDDMKERDTISLNSIITSSVHNGHCEKSIEYFSHMRYTHAKTDYITTSALLPVCGSTQNLRWGRGLHGIVVKSRLESNVCVCNSLLSMYSQAGKSEGFDEYMNLVLDDAEEVNIKKKSRKTLAMLQFLKFCSMRILLKGDNITLMMNTQFVKFQDMPENQKNIDAQSHPGPLGPSRIFLQKAVASGGSNLARLGELGGNHLPYFAINRGGSEEEKG

SEQ ID NO: 108132 - protein, 84 aa, Glycine max
  Coding DNA Sequence Number=SeqID_16447
MWIVSSGMDLTTYLDNVEAMPSKVILMMPKNQELSKFQRFKNQDSRIIKIKIQESREDLIKITQEVFTKSFPQEFYSLVIDYQT

SEQ ID NO: 108133 - protein, 75 aa, Glycine max
  Coding DNA Sequence Number=SeqID_16448
MEAGSLSFNEVLQWRRGERRRHPLGNKPWKEELHYQESVLDKKLREESSMEENNERERGEGGHEIEGEKEGEARA

SEQ ID NO: 108134 - protein, 225 aa, Glycine max
  Coding DNA Sequence Number=SeqID_16449
MALKKLSTKRSRRDVPGEGSSAAPDFDSHHFRSVEHQQCFEAINGWSFHGERRVQLREDEYTNFQEEIARRRWTPLVTPMAKFDPEIVLEFYANALPTEEGVRDMHSWVRGQWIPFDADALSQFLGDPLVLEEGQQCEFSQRRNRADGFNEEAIAQLLCIPGQDFTRTAAGRRVQIMRTSMTTLTQTWMTLLLSNVLPSDHNSDLPLPKCQLVYAILTRMSVHVA

SEQ ID NO: 108135 - protein, 210 aa, Glycine max
  Coding DNA Sequence Number=SeqID_16450
  Homolog annotation: Hit_ID=Q6WAY4; Match level="QueryCoverage=88%, HitCoverage=33%, E-value=3e-21, Identity=33%"; Hit description =Putative uncharacterized protein
MGTNQIRKRFYQVKIKGLDVTSLKEVGRLMRPLQRQAFRKVYGNILDLTTTEVFTEAVASLAQYYDHPLRCFTLGDFQIVPTVEEFEEILGCPLGGRKPYLFSGFHPSLSKITAVVGDSARELDRMKQTQNGIVGLPRKYLEGKARDMANQDEWVPFADTLALLIFGVVLFPNVDGLVDLAAIDAFLAYHHSKESSVVAILADLFDTFDR

SEQ ID NO: 108136 - protein, 178 aa, Glycine max
  Coding DNA Sequence Number=SeqID_16451
MRVLAATLRGHRGLRAFQDLQQRLLYALTGDIAGDGRVLALAGDLVDLVDVDDAGLGTLHVVVGGLNQLEENVLDVLADVPGFGERRRICDRERHVEHLRERLRQVGLAAAGRAEHQDIGFGQFNGLSAGVASLVPGLDALVVVVDGDSQRLLRGVLADDVVLQEVADLCGLGQFIEP

SEQ ID NO: 108137 - protein, 155 aa, Glycine max
  Coding DNA Sequence Number=SeqID_16452
DAGSRQARQGASAGVGGCRGWLNYAASEQIVLRVHHMRAIGAGLFAITPAGERGMCCKAIKLGNARVFPVDSRGSPVTVVAEDVENMDNVANVSHEEPYDSVIENDTLVLTDYAYHVASKVWAREVEKFGRLASKIEGMMVATRLSSSITCLLET

SEQ ID NO: 108138 - protein, 310 aa, Glycine max
  Coding DNA Sequence Number=SeqID_16453
  Gene Ontology: Mol. function=motor activity; Cellular component=cell projection
  Homolog annotation: Hit_ID=UPI00016621D1; Match level="QueryCoverage =97%, HitCoverage=41%, E-value=1e-20, Identity=33%"; Hit description =UPI00016621D1 related cluster
GWTPSPSEDLHVLAIKGLHALTFRGLHILAISRLHVLAIRGLHALTFRGLHVLAFRGLHALAIRGLHVLAIKDLHALSFRGLHALTFSGLHVLTFRGLHVLGITGLHVLVIKDLHALTFRGLHVLAIRGLRALTFRRQHVLAFRGLHALTFGGLHVLPFRGLHVLTFIGVHVLAIRGVHVLPIKGLHVLAISGLDVLAIRGLHALTFRGLHVLAIRGLHDVAFRGLHALTFRGLHVLTFRGLHALTIRGLHVLAFRRQHTLAIRGLHILAFRRQHVLTFRGLHVLAITGLHVLTIRGQHALAIKVLHTLT

SEQ ID NO: 108139 - protein, 42 aa, Glycine max
  Coding DNA Sequence Number=SeqID_16454
QGAESSQVKVRSQDKLTAKINQGTWGRMQVGIDRPIVALSRR

SEQ ID NO: 108140 - protein, 125 aa, Glycine max
  Coding DNA Sequence Number=SeqID_16455
  Homolog annotation: Hit_ID=UPI0000ECBAF8; Match level="QueryCoverage =32%, HitCoverage=48%, E-value=1e-16, Identity=100%"; Hit description= UPI0000ECBAF8 related cluster
AQYANRLSPRVGRFINAAGTTGFPTGKRAVSATQLIYDHDYEFELGTTMVDFNIMVNDDVVGPMTPKKGLKQGMQAWHWPSFYNVVTGKTLALPNLIALQHIPLSPAGVIAKRPAPIALPNSCAA

SEQ ID NO: 108141 - protein, 101 aa, Glycine max
  Coding DNA Sequence Number=SeqID_16456
  Subcellular localization annotation: CTP_CleavageSite=73; ConfidenceScore=5.67e-01
MTVSGFVWGGANSVPAAAVRQRMQALSGMSGRKASVGGFLSSPSNPRAQPWTGGGNYQAGRSERTPTAKALCWADTDTERRKLGERMGLDTPVVLAVNDGY

SEQ ID NO: 108142 - protein, 106 aa, Glycine max
  Coding DNA Sequence Number=SeqID_16457
SLDEDDSVDGISDTDDEVTDMIQPVRIVHPAEGAQGIQNPFWNDVLHYNNINWSHPDEEDICGLEMLLTFNVGQELYVGMKFDSKDAVKKCSQTICYEGASKFQSC

SEQ ID NO: 108143 - protein, 209 aa, Glycine max
  Coding DNA Sequence Number=SeqID_16458
MVKEECKEVSVSSKRLAKKESHFEIKTNTKETSPLRQPPHLLLCKKTLVSTVTPLGLEVIPQVKELLDEGLVRKSLNPCAILVSKIGINRHQIPKISDMMNVLSVATLFCKMSHAPYIFMIHVNRDSLRRNNQHENKEKGMFYSITFLNFLNSDQGLPMDPKRIKVIPEWPTPPSVEERINEFQEPLDLRSNPFQGGGNEAILPPKDIG

SEQ ID NO: 108144 - protein, 39 aa, Glycine max
  Coding DNA Sequence Number=SeqID_16459
MEEKKIFPKGEFSGFSCWSGLGPALSLCCSLSVGACFHA

SEQ ID NO: 108145 - protein, 120 aa, Glycine max
  Coding DNA Sequence Number=SeqID_16460
  Gene Ontology: Mol. function=RNA-directed DNA polymerase activity; Biological process=RNA-dependent DNA replication
  Homolog annotation: Hit_ID=A5AZ88; Match level="QueryCoverage=34%, HitCoverage=3%, E-value=3e-09, Identity=65%"; Hit description =Putative uncharacterized protein
KAYSKPRLIRWMLWLQEFDLEIRDRSGAQNLVVDHLSRIEHHAKAQTDKIKSVREQEVHLHGDNKCLSNLCYSVRFLMSRGIHTIPAPKQWTGRNFYQGDHENFREDYATKQERSEYQAR

SEQ ID NO: 108146 - protein, 217 aa, Glycine max
  Coding DNA Sequence Number=SeqID_16461
ALYTFLAWPTHLVKSLSQQVAVSPTKPPPKPDPEVDDTLYLMTLTIPKLFLRPYQVRWDATMFGVFNPDFPLYIKHEDLSEIAHGGQCLSISVLQLWILHLTETCMQVGNSDIYGFLEPQSIQRSGQSQFESESYIKSWMQSSQRDVYLGAYLNGFQCSGHWQMVVILPKEHLVVWFCSLHNRPDNYLKGIINSAIKGLDDAPQPKSKASARWIVVK

SEQ ID NO: 108147 - protein, 167 aa, Glycine max
  Coding DNA Sequence Number=SeqID_16462
  Homolog annotation: Hit_ID=Q2HW90; Match level="QueryCoverage=92%, HitCoverage=31%, E-value=7e-19, Identity=38%"; Hit description =Putative uncharacterized protein
MGPLQMQALRKTYGKILDLTIAEVSIEAIASLTQYYDQPLRCFTFGDFQLVPTIEEFEEILGCPLGGRKPYLFSGCLPSLSRIATVVKDSARGLDRVKQTRNGIAGLPRKYLEDKARDMAIQGDWVPFMDVLALLIFGVVLFPNVDGLVDLAAIDAFLAYHHSKESP

SEQ ID NO: 108148 - protein, 113 aa, Glycine max
  Coding DNA Sequence Number=SeqID_16463
  Homolog annotation: Hit_ID=A6FJQ2; Match level="QueryCoverage=33%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPQAAREVAIRWMAKRM

SEQ ID NO: 108149 - protein, 119 aa, Glycine max
  Coding DNA Sequence Number=SeqID_16464
MEFGDIVVHFNILDAMKHLSEDHSVFRAKILDQIVDDYMFDFDSLHESERTNHVAGSTYTSDLLYEVQAEEPSSSPTLVPPTVQPPSTLELKPLPVNLKYAYLEDQGNISSDYLCLLCC

SEQ ID NO: 108150 - protein, 176 aa, Glycine max
  Coding DNA Sequence Number=SeqID_16465
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPFFGKPPSTPLVNIGFSKTDDNAFTCTPGFLKPR

SEQ ID NO: 108151 - protein, 43 aa, Glycine max
  Coding DNA Sequence Number=SeqID_16466
MYTFFSIKVLEIKSLKTLTEKLQKENQELEFVLDMHGLENYDK

SEQ ID NO: 108152 - protein, 127 aa, Glycine max
  Coding DNA Sequence Number=SeqID_16467
  Homolog annotation: Hit_ID=Q51617; Match level="QueryCoverage=25%, HitCoverage=47%, E-value=2e-09, Identity=87%"; Hit description =Putative uncharacterized protein
MTLTYKNRRITRPFRLARFGDDGETSDTCSSRRRSQLVCKRMPGADKPVRARQRMLPECRGWLNYAASEQIVLRVHHIAAPFAIQTAQLLGRAIGAGLFAITPAGERGMCCKAIKLGNARVFPVTTL

SEQ ID NO: 108153 - protein, 97 aa, Glycine max
  Coding DNA Sequence Number=SeqID_16468
MERSMIDAASGGALGDMTLVEARNLIEKMASNSQQFSARNDAIVLRGVHEVATDSSSSTENKNLEGKLDALVNLVTQLAMCHTLISSGDYCLMACDL

SEQ ID NO: 108154 - protein, 97 aa, Glycine max
  Coding DNA Sequence Number=SeqID_16469
MECCLPHLVCQQAANHRGQVQIHECLYRFSRSQQGQSSTPFVCPTPEQFAAEVAWPGDWPDAKAGEEPAGSPGRIDEPRMDEDMTDLFDFLGGSGAT

SEQ ID NO: 108155 - protein, 148 aa, Glycine max
  Coding DNA Sequence Number=SeqID_16470
MGDPISRLSFPENNETFSSLTSYPELRRSEFLIGGYVGARASLLSTTPSFVAITHEPIPYGYLHPFARQTQLCPMARRDQVWSFCTHDTRRYLTVICTPLLGRHSCVRWHAETKFGHSAPMIRGDTLRLSAPPFARQTQLCPMARREQ

SEQ ID NO: 108156 - protein, 117 aa, Glycine max
  Coding DNA Sequence Number=SeqID_16471
MASRKCKSVGSRPTAQYDTRRFHSLDAWNRSDGPSPKQARVRGHLVKIDVDSLNIFLETPVVLAEGETLPTYSRYYRLPSDPREIEAALCIPGLGFILNAEGHPGRILRKDLTTLAQ

SEQ ID NO: 108157 - protein, 65 aa, Glycine max
  Coding DNA Sequence Number=SeqID_16472
  Subcellular localization annotation: CTP_CleavageSite=32; ConfidenceScore=5.30e-01
MSPPPLGPHNHSQTHLKLSGQLPLQAPISVARLARLWTAKLALVDFGLARLFSLSGWTEAVRLAG

SEQ ID NO: 108158 - protein, 145 aa, Glycine max
  Coding DNA Sequence Number=SeqID_16473
MIMRGQYIYSSQEEATSSPSSSGATTTSSSFEGPRETSQESKLSRMEANMWAIIDQYKEKLNLVATHKQRLEDEHAKVLVLQVKREAREKVIDSLHKEALMWIDRFTFTLNGSQELLRLLAKAKAMTDVYSNPEEVHGQIDVPHN

SEQ ID NO: 108159 - protein, 174 aa, Glycine max
  Coding DNA Sequence Number=SeqID_16474
  Homolog annotation: Hit_ID=Q51617; Match level="QueryCoverage=23%, HitCoverage=59%, E-value=2e-14, Identity=95%"; Hit description =Putative uncharacterized protein
MTVKTSDTCSSRRRSQLVCKRMPGADKPVRARQRVLAGVGAGLTCGIRADCTESAPLRCEIPHRCVRRKYRIRRHSPFRLRNCWEGRSVRASSLLRQLAKGGCAARRLSWVTPGFSQSRRCKTTASAKLACLQVDSRGSPACERSSGGGINGEFWGLKYFRHVTGAFLLATYET

SEQ ID NO: 108160 - protein, 136 aa, Glycine max
  Coding DNA Sequence Number=SeqID_16475
  Subcellular localization annotation: CTP_CleavageSite=47; ConfidenceScore=5.73e-01
MPSTHDWSLSSLQSLCSLLLPHKAPRNMFQPCSSLRALLVSCSKALVVSRLTSLNSAFSFRILTAVDLNFSLALGFLKLCFEGLLMQAPLELVGLGSSSSMDSFASWKINGSGMEKEEREETPLQGEDESRRSSPP

SEQ ID NO: 108161 - protein, 45 aa, Glycine max
  Coding DNA Sequence Number=SeqID_16476
MGAKHLTRTKEWSHVIEQRHPVGLTEARNQSWKPQDPIGLLRIHR

SEQ ID NO: 108162 - protein, 122 aa, Glycine max
  Coding DNA Sequence Number=SeqID_16477
  Homolog annotation: Hit_ID=UPI0000ECBAF8; Match level="QueryCoverage =33%, HitCoverage=48%, E-value=1e-16, Identity=100%"; Hit description= UPI0000ECBAF8 related cluster
LITVLCRFYGVPVAPSKVIRAPTNRAFIKKYCAARQAQGETPQQPRDGRQRATDAPPPPLEFTSAYPQKGMQAWHWPSFYNVVTGKTLALPNLIALQHIPLSPAGVIAKRPAPIALPNSCAA

SEQ ID NO: 108163 - protein, 56 aa, Glycine max
  Coding DNA Sequence Number=SeqID_16478
MSNEELKLQDKMSNADFQENDRSHPAQVVAAQIRPLLYKHEGCTSSVPSSGLKSYF

SEQ ID NO: 108164 - protein, 165 aa, Glycine max
  Coding DNA Sequence Number=SeqID_16479
NLVEKFLHNARVVSIGEINNLRQDCYYLTVGTVDEIIIDAPWSYDSCPNCTTTFDPSKDGSACHSCQNSVTNTVPRMEHNGDKGNFLFWDATCIKLFGKTAAECRDELIADGDDIKVFPTCVDEILSKTWAVIFKFCSQLRQSSVLDVSEEPHHIQTLIATLGLK

SEQ ID NO: 108165 - protein, 81 aa, Glycine max
  Coding DNA Sequence Number=SeqID_16480
MENNGGLWWIMVVMGDGESPWDVRNGFGRKKEEEMTEKCSRERKLRAHSRHLLEDPNGQIVYKCLVKLQTKCREDPTVNEG

SEQ ID NO: 108166 - protein, 137 aa, Glycine max
  Coding DNA Sequence Number=SeqID_16481
  Homolog annotation: Hit_ID=A4PP05; Match level="QueryCoverage=82%, HitCoverage=32%, E-value=1e-14, Identity=39%"; Hit description=IMP dehydrogenase/GMP reductase, putative
SGSYAWGAAALVHMYDHLNNACKSDGRQLAGYITLLQIYEHFSSIADCVTDLDYDEMSPHACRWLNYEGLFEGIPSIDVLDTELRWGPVVVTHRPEKVVRQFGYVQTIPPQPMGVSLSFEDIDDTCWTSGLNNLGRG

SEQ ID NO: 108167 - protein, 48 aa, Glycine max
  Coding DNA Sequence Number=SeqID_16482
MEDAPVSPRVALPPKAPTSLRKKRPYTWVHGNLRSGGGSMVMLGLQLA

SEQ ID NO: 108168 - protein, 252 aa, Glycine max
  Coding DNA Sequence Number=SeqID_16483
  Gene Ontology: Mol. function=two-component response regulator activity; Cellular component=intracellular; Biological process=two -component signal transduction system (phosphorelay)
  Homolog annotation: Hit_ID=A6E9E9; Match level="QueryCoverage=32%, HitCoverage=37%, E-value=8e-17, Identity=45%"; Hit description=Two -component response regulator
  Pfam annotation: Domain name=Response_reg; Domain location=169-252; Score=48.6; E_value=2.2e-11; Accession=PF00072.15; Description =Response regulator receiver domain
MPEGKVPFINAFLKDKDEERFQNLRVKATNFTVEPRFYLGAGYGKGFYVAPYYRYSKVSSNTFDFYYDYKPTNGVTYQIPLKGSGNTNGNSGGLMVGVQFFLTKSQNLVLDLWIAGAHYGSGKGDFTLTSDYLLTPEMQQQLKKEIENLDIPFVKYTVETNPNGARIKVDDHKDLASNITDYLKKEDYVCEVATNAKEALEKIELFEYDCILLDLMLPDGNGLEILKHIKNDAPESSIIIVSAKDSLDTKLT

SEQ ID NO: 108169 - protein, 20 aa, Glycine max
  Coding DNA Sequence Number=SeqID_16484
MAEHKNICVEEELDSLSKEP

SEQ ID NO: 108170 - protein, 60 aa, Glycine max
  Coding DNA Sequence Number=SeqID_16485
MAEPSKKRKGTSSRSQWHSESQETLIPSSIPSGSLFSSEEQRIRESLLFKPRNPRRHFNF

SEQ ID NO: 108171 - protein, 149 aa, Glycine max
  Coding DNA Sequence Number=SeqID_16486
  Subcellular localization annotation: CTP_CleavageSite=52; ConfidenceScore=5.55e-01
PNSPPPPPPSTVVASHSLSPPLKRTRKTSRLRSLATRPVGAEKPLVHVDPVTGKADGSHSKKLRTYLGIVALDKVDVTYENWMHVPITQKDLIWGDIQLTRIVSMTLYAKCTALARRNGPNFVRAVETLHGRMCEKMHKPSKNKTLPLT

SEQ ID NO: 108172 - protein, 161 aa, Glycine max
  Coding DNA Sequence Number=SeqID_16487
  Homolog annotation: Hit_ID=UPI00016621D1; Match level="QueryCoverage =91%, HitCoverage=41%, E-value=9e-15, Identity=37%"; Hit description =UPI00016621D1 related cluster
GDTPSPSEDCTSLPSEGVHILSFRGLHALTFKGLHVLAFRGLQVLAFRGLHVLPFRGTHVLTFRGLHSLAVRGLHALTFRGLQVLAFRGLHVLAFRGVHVFTFRALHVLAFTGLQDLDFRGLYVLTFRGLHALAFIGLHALTLIGLHVLTIREPYILTFKG

SEQ ID NO: 108173 - protein, 127 aa, Glycine max
  Coding DNA Sequence Number=SeqID_16488
MCPLSFRFRKSSDKRAETNSAPFVIRGQFRWQGDSLAEWCFARTKLVSYLYFPFISNKRQVKRGNYHTLISSEDHPLLGCDPCLTSLRYLAPIVRQFVKFRDMPDVKEGIVARSVKFRDMPEIKRKC

SEQ ID NO: 108174 - protein, 47 aa, Glycine max
  Coding DNA Sequence Number=SeqID_16489
MGCSPRRAQLAQVRALYGSAFAYLTRLGLLPSSASRLSGAGRGTTIR

SEQ ID NO: 108175 - protein, 131 aa, Glycine max
  Coding DNA Sequence Number=SeqID_16490
YLAPFVAQYVKSRDVPKIKRKQAYAIRENSVMKISIVTKFVKFRKVTEKELPKKQSGPLGPSRFFLQKAVASGGSNLARLGELRGKLLPYFAINRGRSEEGRGSAFLALLILSKLLRKIISVKKIQAEALP

SEQ ID NO: 108176 - protein, 141 aa, Glycine max
  Coding DNA Sequence Number=SeqID_16491
MPGADKPVRARQRVLPGVGAGLTYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPIVISNCTTKAQLIPNVIIIFK

SEQ ID NO: 108177 - protein, 173 aa, Glycine max
  Coding DNA Sequence Number=SeqID_16492
  Homolog annotation: Hit_ID=Q5QJQ3; Match level="QueryCoverage=60%, HitCoverage=82%, E-value=2e-57, Identity=100%"; Hit description =Putative uncharacterized protein
RLLEDPPLGRSAAASGISSLKGGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTRISRARYVGGATEFLKWWPNYGYTRRTVFGICALLKPVTFGKRVGSS

SEQ ID NO: 108178 - protein, 116 aa, Glycine max
  Coding DNA Sequence Number=SeqID_16493
  Homolog annotation: Hit_ID=Q2RAY7; Match level="QueryCoverage=62%, HitCoverage=6%, E-value=3e-08, Identity=44%"; Hit description =Retrotransposon protein, putative, Ty1-copia subclass
MVPRSRKGLFMGYGDGVKGYMIWSHSKKKVLLNRDVIFDESHLFHHKLKVPIAGTQSCHSPQEKDVESITKDSEKGGHSETYHVVLQEGEKSEDSNANESLLAAEPDPPQLNSGIN

SEQ ID NO: 108179 - protein, 168 aa, Glycine max
  Coding DNA Sequence Number=SeqID_16494
  Homolog annotation: Hit_ID=Q6UUU1; Match level="QueryCoverage=35%, HitCoverage=40%, E-value=1e-18, Identity=78%"; Hit description =Putative uncharacterized protein
SYAYRTKHLILTIEFRINCCIVRADVSYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108180 - protein, 39 aa, Glycine max
  Coding DNA Sequence Number=SeqID_16495
MIQREWRKELAFPVTRNVIDSDSKCPFASSMGVIWTRIE

SEQ ID NO: 108181 - protein, 156 aa, Glycine max
  Coding DNA Sequence Number=SeqID_16496
  Homolog annotation: Hit_ID=Q6WAY4; Match level="QueryCoverage=85%, HitCoverage=24%, E-value=1e-08, Identity=32%"; Hit description =Putative uncharacterized protein
MGSDQAQSFKKRFHHVKVKNLELASLRKLGQRMDQIQRQSFSKVYGRIWDLAMIEVSVEVIASLTQYYDQPLKCFSFGVFQLAPTIEEFERILGCPIGGRKPYLFSEYYPFMVRVARVVKILKRELDQVKQSRNGVAGILRKCLEEKAKTLASQGE

SEQ ID NO: 108182 - protein, 149 aa, Glycine max
  Coding DNA Sequence Number=SeqID_16497
MAPRKLSLKRSRKDVAVEGTSATPEFDSHRFRSAEHQQRFKAIKGWSFHRERRVQLRDDEYTDFQEEIARRRWTSLVTPMAKFDPDIVLEFYANAWPTEEGIRDVRSWVRGQWIPFDADALSQFLGYPLVLQEGQECEYGQRRNRGQWI

SEQ ID NO: 108183 - protein, 140 aa, Glycine max
  Coding DNA Sequence Number=SeqID_16498
  Subcellular localization annotation: CTP_CleavageSite=27; ConfidenceScore=5.06e-01
MSRLQRTTRPHLQRVMYLQFQRTTRPRRQKVMYLHLCRATRPHLQRTTRPRHSEGYTPSPSEDYMSSSSEDYMSSPLEGYTPSAPRTIRPHLQRTTCPHLQRATRPRLRRATRPHLPRTTCPHHSEGYAPSPCRATRPHL

SEQ ID NO: 108184 - protein, 46 aa, Glycine max
  Coding DNA Sequence Number=SeqID_16499
MVKAPMDEFRDELVKGEDDDDDESLSDYCETQFSTNNMNNPVVQFN

SEQ ID NO: 108185 - protein, 293 aa, Glycine max
  Coding DNA Sequence Number=SeqID_16500
  Homolog annotation: Hit_ID=Q6WAY6; Match level="QueryCoverage=15%, HitCoverage=8%, E-value=3e-07, Identity=53%"; Hit description =Putative uncharacterized protein
MANQEEWAPFMDVLALLIFGVVLFPNMDGLVDLAAIDAFLAYHHSKESPEGKEGVLFSCGDYPNILLIGTRGCINYNSALVIRQLGYPMRGAPTEESLSPFLVRDFGAQSFKLSKLKIINEENFEAPEEDDEVRALKTELGKARLAKEKFKLVATDVRKECAGNSELKLRREERDQSRAHSMVLKEELAACSRSKRNLSQRLCETETNMLAIVNKYQEELNLATAHEYKVADEYAQVYAEKEARGRVIDSLHQEAKMWMDRFALTLNESQELPRLLAKAKAMADTYSAPEEIH

SEQ ID NO: 108186 - protein, 95 aa, Glycine max
  Coding DNA Sequence Number=SeqID_16501
  Homolog annotation: Hit_ID=A6FJQ2; Match level="QueryCoverage=40%, HitCoverage=84%, E-value=2e-11, Identity=92%"; Hit description=50S ribosomal protein L5
  Subcellular localization annotation: CTP_CleavageSite=29; ConfidenceScore=5.36e-01
MTLTYKIGVSRGPFVSRVSVMTVKTSDTCSSRRRSQLSMRKEKIPHQAPFAIQAAQLLGRAIGAGLFAITPAGERGMCCKAIKLGNARVFPVTTL

SEQ ID NO: 108187 - protein, 97 aa, Glycine max
  Coding DNA Sequence Number=SeqID_16502
  Gene Ontology: Mol. function=DNA binding; Cellular component=nucleus; Biological process=regulation of transcription
  Homolog annotation: Hit_ID=A7Q9F9; Match level="QueryCoverage=48%, HitCoverage=14%, E-value=1e-21, Identity=95%"; Hit description =Chromosome chr19 scaffold_66, whole genome shotgun sequence
  Pfam annotation: Domain name=Myb_DNA-binding; Domain location=14-59; Score=16.8; E_value=0.082; Accession=PF00249.22; Description=Myb -like DNA-binding domain
MGRIPCCEKDNVKRGQWTPEEDNKLSSYIVQHGTRNWRLIPKNAGMQAWHWPSFYNVVTGKTLALPNLIALQHIPLSPAGVIAKRPAPIALPNSCAA

SEQ ID NO: 108188 - protein, 56 aa, Glycine max
  Coding DNA Sequence Number=SeqID_16503
VKHEKNMNLGIPRSCFLCMPPNSWVTVTRSGVVDKSRAFAPTYPQFVMWNSDLRSS

SEQ ID NO: 108189 - protein, 194 aa, Glycine max
  Coding DNA Sequence Number=SeqID_16504
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
MRKRHASRREKDGQLSGKRQGRNRRAHEGASRGKRLGGGAYGKTPATRPFYGSWPFAGLLLTCSFLRYPLILWITVLPPLSELIPLAAAERPSAASHWHDRFPDWKAGSERNAINVKTTEADLRCLSQMLGIGSDALSRPAGMQAWHWPSFYNVVTGKTLALPNLIALQHIPLSPAGVIAKRPAPIALPNSCAA

SEQ ID NO: 108190 - protein, 56 aa, Glycine max
  Coding DNA Sequence Number=SeqID_16505
MDTSEPYTRAMRGTVHEPQANLGTDQEFLPGLTPIAVESVKFREILERKQPKTQKQ

SEQ ID NO: 108191 - protein, 47 aa, Glycine max
  Coding DNA Sequence Number=SeqID_16506
DLVGSPLGDLGALRAWELVAITIRPINWSDLPDQSHTTKKIVDVKEA

SEQ ID NO: 108192 - protein, 189 aa, Glycine max
  Coding DNA Sequence Number=SeqID_16507
  Gene Ontology: Mol. function=structural constituent of ribosome; Cellular component=intracellular; Biological process=translation
  Homolog annotation: Hit_ID=A6FJQ2; Match level="QueryCoverage=20%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARGLTMNSQYICFYLMPFFVHGSIFWCPRRRGTTPIHPELGGYSGEQISSGDDGVGPVAQRIRARGYEPRCRGFESLLAHNRPKKGRIFPSGGRKIMIGLADPKLWN

SEQ ID NO: 108193 - protein, 55 aa, Glycine max
  Coding DNA Sequence Number=SeqID_16508
  Subcellular localization annotation: CTP_CleavageSite=17; ConfidenceScore=5.11e-01
MPILAPKFQLKITVKTSAKARGNWKGGLVSSLEEFVSRSKGPTTLRAIGLRSTPN

SEQ ID NO: 108194 - protein, 111 aa, Glycine max
  Coding DNA Sequence Number=SeqID_16509
MATKMKRCPFEALGSIAPITSIPHIENDQGAAKTFKASLTSTHQSKTISWFLLYRIFPLRKKPAANLRNVLLSLSEASHGYSLSSIYCLISKYQGLPSCSSSIKKQCAGLP

SEQ ID NO: 108195 - protein, 124 aa, Glycine max
  Coding DNA Sequence Number=SeqID_16510
  Homolog annotation: Hit_ID=A7Q8B9; Match level="QueryCoverage=40%, HitCoverage=15%, E-value=9e-19, Identity=77%"; Hit description =Chromosome chr14 scaffold_63, whole genome shotgun sequence
MVGAGLKKDLRVSRVVPGGSLNAFLFLLIGVISQRLAMESIDSLPIGWTVGAMIYFTGEVSAQLVELRSCNWVVAITEDRNMPLKDSTETKTGCQERRGGRMGSWSDLVWIVPWTVVGVGGSPK

SEQ ID NO: 108196 - protein, 106 aa, Glycine max
  Coding DNA Sequence Number=SeqID_16511
  Subcellular localization annotation: CTP_CleavageSite=43; ConfidenceScore=5.07e-01
MHRRQQTHRHHLIRLIQLGHLAWSGIYSIWFASRRPTIGGRCRSMSVSTSSASVSRARVSEIAWLGDCLEAQAGEAPAEAPGDAEEACMDEEMTNLLGFLGGSGAI

SEQ ID NO: 108197 - protein, 150 aa, Glycine max
  Coding DNA Sequence Number=SeqID_16512
MAQLISDVIYCLQGSRPQDAQWTRRSPTGSWGVQLWLRASVSPTGCPFPPARSRHHDIGIAPARHPVDPKKSNRVLKFPSSNYGPLSVLRSACCPPARSSGPLLIELSSRSTASPGRRRAKHNSSLGMAAAGTNAPPSPLEFTSAHPQKG

SEQ ID NO: 108198 - protein, 112 aa, Glycine max
  Coding DNA Sequence Number=SeqID_16513
HFLEQVAWPEAQLPLMRPNEAALPEPTPVQADPKPADPQSPVMNQLSSPECEVVPPSPPLIIISNASSDEVAAPPDSPAGETADLPTSPVGGITDLSDSSSGEVVALTDSPV

SEQ ID NO: 108199 - protein, 138 aa, Glycine max
  Coding DNA Sequence Number=SeqID_16514
LCQSFGVPVAPSKVIRPPITRAFIEKYCTQRQVQGDAPQATDVLPPHQAGPAGSFDTEQYLRHLVRQQAANHRAHSQGFASFPCPTPDQFRAKVAWPGDWPEAQAGEAPAEAPDEADEACEDEEMTDLLDFLGGSGAT

SEQ ID NO: 108200 - protein, 95 aa, Glycine max
  Coding DNA Sequence Number=SeqID_16515
  Homolog annotation: Hit_ID=A6FJQ2; Match level="QueryCoverage=40%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARNSIKLMKQSQGCYANLQSGARKVNYELMWKAFQRSISIEWNESSA

SEQ ID NO: 108201 - protein, 118 aa, Glycine max
  Coding DNA Sequence Number=SeqID_16516
MAARCFGIGVFEKDPEIMRGLGLRHQGGHFIIESGEESTIYKAVLSTPVVGSFPMESASKMLEWIIVGKKFGDIGESDASKGFGWLMGVGNEGVVVGHGRQGWGTTSLIEEIGNGWIV

SEQ ID NO: 108202 - protein, 62 aa, Glycine max
  Coding DNA Sequence Number=SeqID_16517
MVEREKFDHIEERLRAIEGGKDYPFVDMAELCLVPDVVIPPKFKVPNFDKYNGTTCSKNNLK

SEQ ID NO: 108203 - protein, 116 aa, Glycine max
  Coding DNA Sequence Number=SeqID_16518
MGPVLPDSHRPFLGGYAEKGTGHPKTEHCLPCFVSCVIFGQDSFEEQAPQGSFVPHGRQDVLTATIGHPEHPGRVRVAGAGVTIKQYFGSAPRMSHSSSLLPPKELQQLTQQIGTS

SEQ ID NO: 108204 - protein, 505 aa, Glycine max
  Coding DNA Sequence Number=SeqID_16519
  Gene Ontology: Mol. function=phenylalanine-tRNA ligase activity; Cellular component=cytoplasm; Biological process=phenylalanyl-tRNA aminoacylation
  Homolog annotation: Hit_ID=A8GDR0; Match level="QueryCoverage=77%, HitCoverage=48%, E-value=0.0, Identity=91%"; Hit description =Phenylalanyl-tRNA synthetase, beta subunit
  Pfam annotation: Domain name=B3_4; Domain location=327-500; Score =374.0; E_value=2.4e-109; Accession=PF03483.8; Description=B34 domain
  Pfam annotation: Domain name=tRNA-synt_2d; Domain location=1-118; Score=94.0; E_value=4.9e-25; Accession=PF01409.11; Description=tRNA synthetases class II core domain (F)
  Pfam annotation: Domain name=tRNA_bind; Domain location=160-261; Score=158.8; E_value=1.4e-44; Accession=PF01588.11; Description =Putative tRNA binding domain
  Pfam module annotation: Pfam domain module=B3_4::tRNA-synt_2d::tRNA _bind; Domain location=327-500::1-118::160-261
MEGLIVDKDISFTNLKGTLHDFLNNFFEEDLQVRFRPSYFPFTEPSAEVDVMGKNGKWLEVLGCGMVHPNVLRNVGIDPEVYSGFAFGMGMERLTMLRYGVTDLRAFFENDLRFLKQFNELWLREWVNPAISSEALSDQITMAGLEVDGVDPVAGAFNGVVVGEVVECGQHPNADKLRVTKVNVGGERLLDIVCGAPNCRTGLKVAVATVGAVLPGDFKIKAAKLRGEPSEGMLCSFSELGISDDHDGIIELPLDAPIGTDIRDYLKLNDNTIEISVTPNRADCLGIIGVARDVGVLNQVALTEPDMSPVAATIDATLPIRVDAPQACPRYLGRVVKGIDVKAPSPLWMREKLRRCGIRSIDAVVDVTNYVLLELGQPMHAFDLGRIDGGIVVRMAEEGETLTLLDGNEAKLSADTLVIADHQKALAMGGIFGGEHSGVNGETQDVLLECAFFSPLSITGRARRHGLHTDASHRYERGVDPALQYKAMERATRLLLDICGGQAGP

SEQ ID NO: 108205 - protein, 130 aa, Glycine max
  Coding DNA Sequence Number=SeqID_16520
  Gene Ontology: Mol. function=metallopeptidase activity
  Homolog annotation: Hit_ID=A5BJI6; Match level="QueryCoverage=52%, HitCoverage=23%, E-value=8e-26, Identity=78%"; Hit description =Putative uncharacterized protein
MTMITNSSSVPWQLLEIQCHSKLAARRFQKPKKGLKLDGSDDNGDVPSMDMRLNTESPLLWIRADPDMEYLAESRPAGMQAWHWPSFYNVVTGKTLALPNLIALQHIPLSPAGVIAKRPAPIALPNSCAA

SEQ ID NO: 108206 - protein, 25 aa, Glycine max
  Coding DNA Sequence Number=SeqID_16521
MQFTNTGAREIVPFLDTTFGQHGTQ

SEQ ID NO: 108207 - protein, 149 aa, Glycine max
  Coding DNA Sequence Number=SeqID_16522
  Homolog annotation: Hit_ID=B0HC01; Match level="QueryCoverage=22%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTLADGEIARIVQRAPDPFAVARVNRQAVRVVQRRTEVVGIL

SEQ ID NO: 108208 - protein, 45 aa, Glycine max
  Coding DNA Sequence Number=SeqID_16523
MEAWGLLFSWFPILGCLAATFSACPAPGSNDNRSVVTLSSICVCS

SEQ ID NO: 108209 - protein, 65 aa, Glycine max
  Coding DNA Sequence Number=SeqID_16524
MPIGWTSQKSGPDIEEEELTDLRSNPLQGEGDDAILPRKGPVTRTMSKRLQEDWARAAEKALGFS

SEQ ID NO: 108210 - protein, 144 aa, Glycine max
  Coding DNA Sequence Number=SeqID_16525
  Subcellular localization annotation: CTP_CleavageSite=27; ConfidenceScore=5.79e-01
IMGSPPASTPPPPPPPPPPPTSDASASTSAVKRTRKASRLRSLSTRPPGVERPVVHVDPATGKADDPHKKKLRTYLGIVARDKVDITYENWKEAKFDIPEASDSRTKKKLLQTDGVEDTDCDKYGISKEKSAQFCQTRRDPSWE

SEQ ID NO: 108211 - protein, 189 aa, Glycine max
  Coding DNA Sequence Number=SeqID_16526
  Pfam annotation: Domain name=Transposase_23; Domain location=49-114; Score=-14.0; E_value=0.04; Accession=PF03017.5; Description =TNP1ENSPM transposase
  Subcellular localization annotation: CTP_CleavageSite=32; ConfidenceScore=5.46e-01
MASFSHLQSQMQSQGLTVPPKPLVGPGPSGPRVSTKGSCVDPSGNDPETGDSDRCGLYIEADPARLVAIGRVCEGPTVVHNTPLLPGQVKVSVEEVRDADAPVPIPTDEVAVSPPKPPPKPDPEVDDPLYLMTLTIPELFLRPYQVRWDATVFGVVNPGFPLYIKHEDLSEIAHGGQCLNISVLQLWIL

SEQ ID NO: 108212 - protein, 81 aa, Glycine max
  Coding DNA Sequence Number=SeqID_16527
  Subcellular localization annotation: CTP_CleavageSite=34; ConfidenceScore=5.20e-01
MTTLVSACYRTITTWVSLPAIATYPSAGGRRVTRGMRVPRKEYARSHHQRLFEKTSENRKDAIYELFSERFGSCIYARGRY

SEQ ID NO: 108213 - protein, 117 aa, Glycine max
  Coding DNA Sequence Number=SeqID_16528
EDIVVFEMCADYRIGRLRMLPDFSQITTWGISACHLTSRVEINRNSLSLDEKGVEDDVSLCESTGSLAPGADDHGISACHLTSRSPSLDDKGAEDDVSLCVSTGLACPWLTKGEDDD

SEQ ID NO: 108214 - protein, 110 aa, Glycine max
  Coding DNA Sequence Number=SeqID_16529
MADEHQQRVTLEDYLSSSVPQFFTSIARPEFPDKSLSEALDRFRGLLRKTPTHRFSESIQLNMFIDGLKPQTKKLLDVMQSYPTRALDKRLQVGWARDPREGPKVLISLR

SEQ ID NO: 108215 - protein, 178 aa, Glycine max
  Coding DNA Sequence Number=SeqID_16530
MAPKKLPTKRSKKHATREGSSAAPQVEVDFDGHRERLVQLRDEDYVEFQEEIAQRQWTQLVSPMAKYDPEIIMEFYANAWPTEEGFKDKHSWVRDPMRMPLTSFWGVHRSWKKASAVSLARGGAKPQASTRRLLASCYAFRVGGLVDACALSATLARLVRISEFRLSAHLYAQRMDLS

SEQ ID NO: 108216 - protein, 122 aa, Glycine max
  Coding DNA Sequence Number=SeqID_16531
PMATPRDSAPPPPLPVVASQSQPVVHVDPATGKVDGPHKKKLRTYLGIVARDKVDVTYKTWKQVPAAQEDIQVEFDILEASDADNDIVDDTVCEKYDISKEKWAHFCQTHRDPSWEDVRKKA

SEQ ID NO: 108217 - protein, 204 aa, Glycine max
  Coding DNA Sequence Number=SeqID_16532
  Homolog annotation: Hit_ID=A6FJQ2; Match level="QueryCoverage=18%, HitCoverage=84%, E-value=5e-11, Identity=92%"; Hit description=50S ribosomal protein L5
MRKEKIPHQAPFAIQAAQLLGRAIGAGLFAITPAGERGMCCKAIKLGNARVFPVTTLSTLEDPRRPWDGSPSGSVDGDRRGAQWARTRAVRLAGRVIDGGVPDRAAELVVEEQHGEIVGAGVAHGCEAHPAAVPAGLVTAGELPPDAPRDRSLRYRGGHRVSIGAGRVEEALEHRDAELALTVFADGVRDDAAPLGGGVPSSNS

SEQ ID NO: 108218 - protein, 76 aa, Glycine max
  Coding DNA Sequence Number=SeqID_16533
  Subcellular localization annotation: CTP_CleavageSite=25; ConfidenceScore=5.07e-01
MQSQMQSQMQSQGLTLPPKAKVGPSAARVSTKDIYGLYVDDSSSRLFALRRAYEESITVHNVALGNDQVKVGIEEV

SEQ ID NO: 108219 - protein, 40 aa, Glycine max
  Coding DNA Sequence Number=SeqID_16534
MEETDHKNEEERKQTEEEAQVGEDMTEEGWRRRHVEQPIE

SEQ ID NO: 108220 - protein, 89 aa, Glycine max
  Coding DNA Sequence Number=SeqID_16535
NTDVLTDHVGFMLVDLKKLAYQNDLFMMAKQAKQGKTIGVNVEDDDSYIDTYVSPLSTQISPNVIGEEEANDIHANGNDHDEGELINIV

SEQ ID NO: 108221 - protein, 55 aa, Glycine max
  Coding DNA Sequence Number=SeqID_16536
MNHKGILSFVFNDYNQEVMPTSCNEPNSVFNQEDLLLKTITMSRSLEKLFVRMEE

SEQ ID NO: 108222 - protein, 142 aa, Glycine max
  Coding DNA Sequence Number=SeqID_16537
DASSKATIPGAFDISGAGVEMRRDEVVLLEPIVPVIHESAEAGESQLRLEAATPERTSQTPEGPLSLGMDLSFAQQVTDPPTPVQERQVDPPTPIMEMPEDPTTLVLRLSSTPPATPVLHLTDEEDMQDQDTQGTQDQPQEF

SEQ ID NO: 108223 - protein, 118 aa, Glycine max
  Coding DNA Sequence Number=SeqID_16538
  Gene Ontology: Mol. function=nucleic acid binding
  Homolog annotation: Hit_ID=A5C693; Match level="QueryCoverage=67%, HitCoverage=36%, E-value=5e-15, Identity=45%"; Hit description =Putative uncharacterized protein
GYILCGTSRGYIYLGLTENKRGYISCGSVLVEGTSTRFKENKGGLLKDHDEDQVNLCLMTKSDENNKEDSVRKKWYIDSGCSKHMTGDVSKFTTISPKKSGHVTYGDNNKGKIIGVGK

SEQ ID NO: 108224 - protein, 127 aa, Glycine max
  Coding DNA Sequence Number=SeqID_16539
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=65%, E-value=2e-33, Identity=100%"; Hit description=LacZ protein
MEKGAEATKPIIEALKSKGVSAIAAVGFCWGGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 108225 - protein, 94 aa, Glycine max
  Coding DNA Sequence Number=SeqID_16540
  Homolog annotation: Hit_ID=A7PII8; Match level="QueryCoverage=97%, HitCoverage=23%, E-value=2e-33, Identity=76%"; Hit description =Chromosome chr13 scaffold_17, whole genome shotgun sequence
MDIDYAIRKDEPLVITDESIPVDVALYERWERSNRLSVMFIKTKISAGIRGFVDQHEKVRDLLKTIDDQFITSDKTLASTLIMKFCSLRLTNVK

SEQ ID NO: 108226 - protein, 59 aa, Glycine max
  Coding DNA Sequence Number=SeqID_16541
MRKRHASRREKRRTGGRSLWKNASNAAFLRFLAFCWPFAHMFFPALSPDSVDNRITAFE

SEQ ID NO: 108227 - protein, 278 aa, Glycine max
  Coding DNA Sequence Number=SeqID_16542
  Homolog annotation: Hit_ID=Q84VI1; Match level="QueryCoverage=83%, HitCoverage=34%, E-value=1e-86, Identity=73%"; Hit description =Envelope-like protein
MRKEKIPHQAPFAIQAAQLLGRAIGAGLFAITPAGERGMCCKAIKLADEDVPTSSTPNVSVPDVKKDVPTSSAPNAEVLSSPSKERSTEEDDQATKETPAPRAPEPAPGDLIDLEEVESDEEPIANRLAPGVAERLQSRKGKTPIKRSGRIKTMAQKKSTPITPTTSRRSKVTIPSKKRKEISSSDSDEDVELDVSTSKRAKKSGKKVPEKVPDAPLDNISFHSIGNVEKWKYVYQRRLAVERELGRTALDCKEIMDLIKAAGLLKTVTKLGDCYEGL

SEQ ID NO: 108228 - protein, 64 aa, Glycine max
  Coding DNA Sequence Number=SeqID_16543
MLIDVGNALACACCVCSWRAKCTDLPGSLALALGHVHTLDIVVCSWGVSALTLSDGPDVGDKRG

SEQ ID NO: 108229 - protein, 146 aa, Glycine max
  Coding DNA Sequence Number=SeqID_16544
  Homolog annotation: Hit_ID=A0ST23; Match level="QueryCoverage=30%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPSRMSLILAFTIGRGTELEFVIMVIAVSFGKPVVPAALMNRPTRGERRFAYWALFRFLAH

SEQ ID NO: 108230 - protein, 265 aa, Glycine max
  Coding DNA Sequence Number=SeqID_16545
  Gene Ontology: Mol. function=methyltransferase activity; Biological process=biotin biosynthetic process
  Homolog annotation: Hit_ID=A6T6L7; Match level="QueryCoverage=63%, HitCoverage=66%, E-value=1e-78, Identity=86%"; Hit description =Biotin biosynthesis; reaction prior to pimeloyl CoA
  Pfam annotation: Domain name=Methyltransf_11; Domain location=5-59; Score=35.9; E_value=1.5e-07; Accession=PF08241.3; Description =Methyltransferase domain
AQRNGAAQHNLQGDIEALPLPDACFDLAWSNLAVQWCDELSAAIGELYRVVRPGGRVAFTTLLAGSLPELNQAWRAVDEHPHANRFLSEKAVRAALSGLRAEGVVHQISLPFADALSAMRSLKGIGATHLHQGRASAPLSRGKLRELQLAWPQQQGQCPLTYHLFTGAANQLGFNTAGYKPVASGSDLTAQGLRNEDALALQRNSRVALRYEQVNPYTFAEPTSPHIISADEGRPIAATTLSSGLRELERLADWVLVEGSNRGIL

SEQ ID NO: 108231 - protein, 134 aa, Glycine max
  Coding DNA Sequence Number=SeqID_16546
EEAQIGADRSSATSNKAEIYNEEAHNAAQKHKPKRVKSVNADAEAFAEALEHTKKRDTGHQSVSLENKTGDSTVLKIGDSAKVVIKQDMKGRKHKYGFNNNKREKTEKKRVVDDETGDKHELYEVLRIPSKTKN

SEQ ID NO: 108232 - protein, 124 aa, Glycine max
  Coding DNA Sequence Number=SeqID_16547
MTLTYKNRSITRPFRLARIGDDADAGSRQARQGASAGLVGCRGWLNYAASEQIVLRVHHMRCEIPHRCVRRKYRIRRHSPFRMRNCWEGRSVRASSLLRQHGERGMCCKAIKLGNARVFPVTTL

SEQ ID NO: 108233 - protein, 216 aa, Glycine max
  Coding DNA Sequence Number=SeqID_16548
  Homolog annotation: Hit_ID=Q84VI1; Match level="QueryCoverage=100%, HitCoverage=31%, E-value=3e-78, Identity=74%"; Hit description =Envelope-like protein
MATSPKETAASGSPAVPSSPHQEQPEFNIQPIQIIPGQASVPEKLVPRRQQGVKIAENPSLATSLREVDTEMDKKIRSIVSSILKDASVPDAEKDVPTSSNPNVSVPDVKKDVPTSSAPNTEALPSPSEEESTEEEDQASEETPAPRAPETAPGDLIDLEEVESDEEPIANRLAPGIAERLQGRKGKNPLKRSGRIKTMAQKKSTPITPATSRRSK

SEQ ID NO: 108234 - protein, 226 aa, Glycine max
  Coding DNA Sequence Number=SeqID_16549
MWMDRFALTLNGSQELPRLLAKAKAMADTYSAPEEIHGLLGYWKNTITKRATRHPYRTRSKSRTMGDQEETQEQMKADMSALKEQMASMMEAMLGMRQLMEKNVATAAAVSSAAEADPTLSATAHHPPSNIVGRGRDTLGHDGNPHLGYNRAAYPYGLSPNYSPPVLQDDAGHIASPVLEREPPQQPDEVHEDPQDYARRDVEFYPPSPNGRHPARCLSPTSRHNQ

SEQ ID NO: 108235 - protein, 85 aa, Glycine max
  Coding DNA Sequence Number=SeqID_16550
  Subcellular localization annotation: CTP_CleavageSite=51; ConfidenceScore=5.34e-01
MTLGIAPARHPLDPKKSNRVLELPSSNYGPLSVLRSACLPPAKSSGPLLIELSSRSTASPGRRKAKHHSSLRMADSGQQTHRHHL

SEQ ID NO: 108236 - protein, 151 aa, Glycine max
  Coding DNA Sequence Number=SeqID_16551
  Homolog annotation: Hit_ID=A0ST23; Match level="QueryCoverage=21%, HitCoverage=65%, E-value=1e-11, Identity=100%"; Hit description =Putative reverse transcriptase
DAGSRQARQGASAGVGGCRGWLNYAASEQIVLRVHHMRAIGAGLFAITPAGERGMCCKAIKLGNARVFPNCGCNCFEAKGQSQNYESKSDKARGDWLLHFAPLEVGDGTMEKSQPRTIGVGKPVVPAALMNRPTRGERRFAYWALFRFLAH

SEQ ID NO: 108237 - protein, 89 aa, Glycine max
  Coding DNA Sequence Number=SeqID_16552
  Gene Ontology: Mol. function=aspartic-type endopeptidase activity; Biological process=DNA integration
  Homolog annotation: Hit_ID=A2I5F0; Match level="QueryCoverage=100%, HitCoverage=47%, E-value=1e-24, Identity=65%"; Hit description =Polynucleotidyl transferase
MEAWNRLCDIFQDNKHFRAVTLEYDFTHTTMEAFSSVFAYCQHLKSLSDQLKNVGFPVDNSRLVLQLVSGLTKPYKGVVTLICQSDPLP

SEQ ID NO: 108238 - protein, 134 aa, Glycine max
  Coding DNA Sequence Number=SeqID_16553
STLEDPDLLLEASLPNKPTYNSKPQETQHKDAQVKVEYEKRLYDQVKVQIAKKNESYAKQANKKRKEVTYQGNPSGVYPDLSSFIGSGVYPDLSSLTGSGVYPDLSSFTGSGVYPDLSSFTGSGVIQTFVACIK

SEQ ID NO: 108239 - protein, 16 aa, Glycine max
  Coding DNA Sequence Number=SeqID_16554
MTEHGDYIDLLLVVYD

SEQ ID NO: 108240 - protein, 68 aa, Glycine max
  Coding DNA Sequence Number=SeqID_16555
MWFEISRHYNYINCNVEAMRNVENKANAVIVRMWVNNVHENVIGSRALESRCVTVPQLMLTCFGISTP

SEQ ID NO: 108241 - protein, 143 aa, Glycine max
  Coding DNA Sequence Number=SeqID_16556
MSASDHAILRDRTHQPTKKSLLELTSHDALLAQNLLSKQLEILTETLGYTMRGEAHEIGQCISIEENTQEIHFMGNQQRQGYTQGGFSGFQQGPYNQQGQWRTHPSNQLNKDQGGSSNRPIQQGPNIFQRMTKLEETLTQFMQ

SEQ ID NO: 108242 - protein, 154 aa, Glycine max
  Coding DNA Sequence Number=SeqID_16557
MASITEAMLKLQKTLEDNATATASNAVREAEPVLQPTINLGRVRNPTVFDRRYSPQAYPYGLPPDFTPRDAPEDGVTVEAPTPTPEASYSSSKVLEKSGRARTGALVSFSFSKADAILPRKGPVTRAMSKRLQEDWARAVEEDLRVLMSLRVDF

SEQ ID NO: 108243 - protein, 114 aa, Glycine max
  Coding DNA Sequence Number=SeqID_16558
MTRGNPSDLQPFDPEIDRTFHRLVKHHFIPFEPPDFEHYNFEHSDFEHSENMAQPPPRERTLREMDAPDFTYESLCIQYPDKDVPYVLKIGLIHLLPKFLGLAEVGIVGARYAG

SEQ ID NO: 108244 - protein, 157 aa, Glycine max
  Coding DNA Sequence Number=SeqID_16559
MVSRDSRQPRGAKLVSYTDFRGPLLDDMRPFFGPCEVLGTHHWAICEILGTTSHLHVEILWSPATLAKSRGAKLVSYLYFPFISNKRQVKRGNCHTLISSGDLCSMTCDHSLVLVRCLAPIIRQLVNFRHAGNQKILMHIRKFPDTPESNGSVLHNK

SEQ ID NO: 108245 - protein, 175 aa, Glycine max
  Coding DNA Sequence Number=SeqID_16560
  Homolog annotation: Hit_ID=Q6WAY4; Match level="QueryCoverage=88%, HitCoverage=28%, E-value=7e-18, Identity=36%"; Hit description =Putative uncharacterized protein
MGTNQIGKRFYQVKIKGLDVTSLKELGRLMGPLQRQAFRKVYGKILDLTTTEVFTKVVVSFAQYYDQPLRCFTFGDFQIVPTIEEFEEILGCPLGGRKPYLFSGFLPSLSKIAAVVGDLARELDRMKQTRNGVVGLPRKYLEGKARDMANQEEWVPFADILALLIFGVVLFPNVD

SEQ ID NO: 108246 - protein, 106 aa, Glycine max
  Coding DNA Sequence Number=SeqID_16561
QCIARSNAPEYLRDTHRSRRGCTTSRKEIGRFFQGSPPPTGYIYLGCYTENKRGYISCGSVQVEGTSTWLFKENKGGYIPCESLSCKGFYKVERNLKNHWLLGDWI

SEQ ID NO: 108247 - protein, 266 aa, Glycine max
  Coding DNA Sequence Number=SeqID_16562
SGLVKIDADSLNTFLETPMVLAKGETLPAYSRYCRLPTDYREKKVALCIPGRGVLSYSNLAPTSHTSDLTVDRARLIFGLVSHLDMNIRVLISCQMTSIAQSNTYRLRFPTLITALCRARGVVYDSLTFEARARARPAELPSTSIAPTPASTSAGPFVPMVAPLDSILSVEQFNEIVAWSGTQPSLHKEDEGPTAQVRQVAAATPERSLEATSEPSAQGEDIPSPQPAADPSTPLLEMPQDPTTSFLAMDTSPPATLVLHLTDEED

SEQ ID NO: 108248 - protein, 40 aa, Glycine max
  Coding DNA Sequence Number=SeqID_16563
MGCYMIHMVNILGNSYSYPFFVSMLSAFDDERLLPHHHVF

SEQ ID NO: 108249 - protein, 245 aa, Glycine max
  Coding DNA Sequence Number=SeqID_16564
  Homolog annotation: Hit_ID=A5AK77; Match level="QueryCoverage=38%, HitCoverage=11%, E-value=1e-10, Identity=38%"; Hit description =Putative uncharacterized protein
MTRGNPGDLQPFDPEIDITFHRLVRHNVHPGHSVHFEHFEHPDHFEHSVAGDSEYSDFEHSAINFHTENMTQPPPRERTLREMAAPDFTYESLCIQYPDEGVPYVLKTGLIHFLPKFHGLAGEDPHKHLKEFHIVCSTMKPPDVQEDHIFLKAFPHSLEGVAKDWLYYLPPFQNAAGPSKPYVPPPIQQHQQQRQQATEAPPQPSLEELNPKNVSAITLRSGKQIEVPPPVVTPAPEPVKLHSTP

SEQ ID NO: 108250 - protein, 79 aa, Glycine max
  Coding DNA Sequence Number=SeqID_16565
MMTKGMTKSSKINQRTTQVNQRSIKKNSRVQDKNQEEFKTQEESLETRIKIQGSRSQESGSRFKTQDSRMKRRLNQDKY

SEQ ID NO: 108251 - protein, 67 aa, Glycine max
  Coding DNA Sequence Number=SeqID_16566
  Gene Ontology: Mol. function=oxidoreductase activity; Biological process=electron transport
  Homolog annotation: Hit_ID=A4WG74; Match level="QueryCoverage=100%, HitCoverage=27%, E-value=1e-30, Identity=88%"; Hit description =Oxidoreductase FAD/NAD(P)-binding domain protein
MADWVTGKVTKIQFWTDALFSLTLHAPVHPFKAGQFAKLGLDVDGERVQRAYSYVNAPDNPDLEFYL

SEQ ID NO: 108252 - protein, 244 aa, Glycine max
  Coding DNA Sequence Number=SeqID_16567
  Gene Ontology: Mol. function=protein serine/threonine kinase activity; Biological process=protein amino acid phosphorylation
  Homolog annotation: Hit_ID=Q5QJQ3; Match level="QueryCoverage=40%, HitCoverage=77%, E-value=4e-51, Identity=94%"; Hit description =Putative uncharacterized protein
DAGSRQARQGASAGVGGCRGWLNYAASEQIVLRVHHMRAIGAGLFAITPAGERGMCCKAIKLGNARVFPVDSRGSPRFNGYDQNGIPANARVNVTVNCSCGNSQVSKDYGMFITYPLRPGNNLHDIANEARLDAQLLQRYNPGVNFSKGSGPLTSITKIDAQVRGGETRQDYKDTRRFPLEAPSCALLFRPCRLPDTCPPFSLREAWRFLIAHAVGISVRCKSFAPSWAVCTNPPFRPSAAPYP

SEQ ID NO: 108253 - protein, 92 aa, Glycine max
  Coding DNA Sequence Number=SeqID_16568
MVFESDPPSPRSAKLMASLAKQMDKLQRNVERRMGERFDEIRRSTQELSGRMEDIERRGGIVGHLILLKEVMMAMKKVEGIDIGGIGMKWMM

SEQ ID NO: 108254 - protein, 142 aa, Glycine max
  Coding DNA Sequence Number=SeqID_16569
VRKECAGLREENAATARALEQETKRARKEERGRDKFHGALWETNMLAIVSKYQEELNLAMTHEHKVVDEYAKVYAEMSGRSSTHQFPSRKPGGHGRTKSDPLGESSLHIATTWPSCPRPALIKLLLMWQGRRPSTSHPNREP

SEQ ID NO: 108255 - protein, 44 aa, Glycine max
  Coding DNA Sequence Number=SeqID_16570
MRTRSPLKARACNPLQARMCSPLMARTYSPLKVIDACNLGREIW

SEQ ID NO: 108256 - protein, 148 aa, Glycine max
  Coding DNA Sequence Number=SeqID_16571
  Homolog annotation: Hit_ID=A0ST23; Match level="QueryCoverage=22%, HitCoverage=67%, E-value=2e-12, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLRNPKDSLELTSVQELLDKINSNCDPVGKPVVPAALMNRPTRGERRFAYWALFRFLAH

SEQ ID NO: 108257 - protein, 129 aa, Glycine max
  Coding DNA Sequence Number=SeqID_16572
MAKFDPEIVLEFYANAWPTEEGVRDMRSWVRSQWIPFDADAIGQLLGYPLVLEEGQECEYGQRRNRSDGFDEKAIAQLLCIPGQDFARTAARRRVRIMRTNLTTLTQIHVFFHISFVIFILCYCFDLRD

SEQ ID NO: 108258 - protein, 201 aa, Glycine max
  Coding DNA Sequence Number=SeqID_16573
MTYLVSAEDGINLRVSTSSSPRLTKVTEDDVSLYVLSGFSSYRQQKVYTITTRVFPPVSVTQKQQKVYTDNHSGISARQCDSKVSMTDLVSADDDVNLRCVNGLCRPRLTKGAEDDVSLCVLSGFSSYRQQKLYTDNQSGISARQRVSKFSMTNLVSAEDDVNLPVLTGLSAAIDEGRRRQSLSLRVIRLFVLQTAKSLYG

SEQ ID NO: 108259 - protein, 166 aa, Glycine max
  Coding DNA Sequence Number=SeqID_16574
AEMTASEEDLILMWAFLTGRQIDWAHLVRYRMHKALRANAPLPYPQLVTLFLRHFQIPLDDEPFVQVKHSFTIGVGVVTSFGYRKDHDGRVPQQDERTPSPPPQQDDSSALMNEVLLELRGLHTYVGERFDSLDGRFEGMDTRITQLEEDVTYLHRCFDLPPPSKS

SEQ ID NO: 108260 - protein, 176 aa, Glycine max
  Coding DNA Sequence Number=SeqID_16575
  Gene Ontology: Mol. function=cation transmembrane transporter activity; Cellular component=integral to membrane; Biological process=potassium ion transport
  Homolog annotation: Hit_ID=A7QXI2; Match level="QueryCoverage=28%, HitCoverage=4%, E-value=8e-17, Identity=78%"; Hit description =Chromosome undetermined scaffold_225, whole genome shotgun sequence
  Pfam annotation: Domain name=MutS_V; Domain location=33-157; Score= -128.7; E_value=1.2e-05; Accession=PF00488.12; Description=MutS domain V
DAGSRQARQGASAGVGGCRGWLNYAASEQIVLRVHHMRAIGAGLFAITPAGERGMCCKAIKLGNARVFPVTTLSTLEDPHSCTEHSLVVIDELGRGTSTHDGMAIAHATLYYLLKQKRSMVLFVTHYPKMGTELEFVIMVIAVSFGKPVVPAALMNRPTRGERRFAYWALFRFLAH

SEQ ID NO: 108261 - protein, 165 aa, Glycine max
  Coding DNA Sequence Number=SeqID_16576
  Gene Ontology: Cellular component=ribosome
  Homolog annotation: Hit_ID=Q2HSY3; Match level="QueryCoverage=76%, HitCoverage=58%, E-value=3e-11, Identity=29%"; Hit description =Nucleic acid-binding, OB-fold, subgroup
  Pfam annotation: Domain name=DUF223; Domain location=64-160; Score= -6.8; E_value=0.013; Accession=PF02721.5; Description=Domain of unknown function DUF223
MTFLFSSNFFSRIAPVCHCLQNQKAMSRKENLICELHTRKGTWKIVVCITDVWQARKQNSKHTIEMVLMDQTGSKIGATLWQELFTELRDELQCGSSYLIQNLRIVDNQSEYRVSLVPYLVYFLKSTSVKEIHRPEIPFNIYLIAPFTDIISGLAPRHTLVGQFV

SEQ ID NO: 108262 - protein, 212 aa, Glycine max
  Coding DNA Sequence Number=SeqID_16577
MAPRKLASKRSRKDKAAEGTSSAPEYDSHRFRSAEHQQRFEAIKGWSFLRERRVQLRDDEYTDFQEEIVRRRWASLVTPMAKFDLDIVLEFYANAWPTEEGVRDMRSWVRGQWISFDADAISQFLGYPLVLEEGQECEYGQRRNRSDGFDEEVIAHLLCIPGQDFARTAAGRRVRIMRTNMTTLTQIWMTLLLSNIQPSDHNSDLPLPKCQL

SEQ ID NO: 108263 - protein, 95 aa, Glycine max
  Coding DNA Sequence Number=SeqID_16578
  Homolog annotation: Hit_ID=A6FJQ2; Match level="QueryCoverage=40%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVFPVTTLSTLEDPLAGQPYGGESFPGLIHTARHTMGAGKGRNRYN

SEQ ID NO: 108264 - protein, 26 aa, Glycine max
  Coding DNA Sequence Number=SeqID_16579
MGDFAKIFNRSSSFVVRSSSFFGLQP

SEQ ID NO: 108265 - protein, 182 aa, Glycine max
  Coding DNA Sequence Number=SeqID_16580
LRLPAIRQPLILQFKAAFHCDKYDGKTYEIQVRQHKGKLYFADGLTRLRTELQIYESVTINFLAYDHPSKFDLHFTPPLDQQKCKRRRATRKHIWTYEITQSMLGAPYPLQLSASVTQCLIHCGDHMTILRRFGPPLQWNVVVLDKGIGDKYVTLPWYKFLQEGDFSHGDELSFYYRRAEKI

SEQ ID NO: 108266 - protein, 36 aa, Glycine max
  Coding DNA Sequence Number=SeqID_16581
MLPNIVEEEEADDVHANLAIYLEADKKSHTAKIIGD

SEQ ID NO: 108267 - protein, 138 aa, Glycine max
  Coding DNA Sequence Number=SeqID_16582
EYMSSVEGGQLGMSGTWRYVAGVKRPWGRQASSWQSTNKRTKTTKQGGLCGGWPAIILEWYLELASRNRLPRDVKMASGNRLPMGDRTLVIDYLLGVIDYTVEFVGFYVQKLCNSSLSTGNRLPERKSLEKDILTMRS

SEQ ID NO: 108268 - protein, 42 aa, Glycine max
  Coding DNA Sequence Number=SeqID_16583
MLQLQCLIKAKGRLGTPTSNGNGVQPKEAAGGLAVEEKARGR

SEQ ID NO: 108269 - protein, 110 aa, Glycine max
  Coding DNA Sequence Number=SeqID_16584
MAASDIAILKDRAHVPTKKSLLELTSQDALLAQNKLHGVPSVVELTILAAISPMKNQLMKDQGGPSTRPQQQMPSLYDRTTKLEETLAQFMQVLMSNQKSTESAIKNLEV

SEQ ID NO: 108270 - protein, 53 aa, Glycine max
  Coding DNA Sequence Number=SeqID_16585
MGAKHLTRTKEWSHVIEQRSPDEIRGFKDNPVCCLQLTIGLGVFDRSYEMLET

SEQ ID NO: 108271 - protein, 243 aa, Glycine max
  Coding DNA Sequence Number=SeqID_16586
  Homolog annotation: Hit_ID=Q2HW90; Match level="QueryCoverage=35%, HitCoverage=17%, E-value=6e-10, Identity=37%"; Hit description =Putative uncharacterized protein
MGSNQAPLFKKRFYHVKIKSLEVASLQELGQLMDQLQRQAFRKRYGKIWDLAMIDVSIEAMASLTQYYDQPLRCFTFGDFQLVPTVEEFEEILGCPLGGIKPYLFSWFYPSMARISKEALGGDSEGFGGSSLAGCDLRLRTSRYLTPIVRQSVKFRDMSGVERSINAQSIKFRNIPEAKEATKAVPSGESKPARLGELGGNLLPLFPINRRKGPRCFREQIREGFSSFFTVLHPFFVRSSFFN

SEQ ID NO: 108272 - protein, 140 aa, Glycine max
  Coding DNA Sequence Number=SeqID_16587
MVEGLGSTSGTPMVEREMITMIVETLPVFYYEKLVGYMPYSFANLVFAGKRIEVGLKRGKFDYVAPAGMNNRRFKASGAKKKEGDAHTVTQLLLGRSPNKPLTTLPICPTSTKLFSPHRKLFQSGARLAKGTRSTTKGPH

SEQ ID NO: 108273 - protein, 222 aa, Glycine max
  Coding DNA Sequence Number=SeqID_16588
MAPNKLPAKRSRKDTIGEGSSAAPQVDVEFDGNRFWSEEQQQCFEAIKGWSFLKERRVQPRDGEYAEFQEEIARRQWAQLVSPMAKYDPQIVMEFYANAWPTKEGDFAQSLAGRRVQIIRTNMTTLTQIWMMLLLSNILPSDHNSDLPLPKCQLIARIVPPRHPVDSEKSNRALRFSALITCLCQFYGVLVNPTKLIRPPISKAFIEKYCKPREAQQQEEGQ

SEQ ID NO: 108274 - protein, 163 aa, Glycine max
  Coding DNA Sequence Number=SeqID_16589
  Homolog annotation: Hit_ID=Q9LKS4; Match level="QueryCoverage=56%, HitCoverage=14%, E-value=2e-08, Identity=37%"; Hit description =Putative uncharacterized protein T15F17.d
MHRPPIGNLVPLGLEIEATIRRNRAERRRKLLQDRTIASILEEEAQSSHSTSSYSLSSSESTTDLPEASVMAEEHQHRVTLEDYSSSSVPQFFKSIAWPKVLAHNINYPHSLNHLIQGNLFHGLPNEDRYTHLATYIEIHNTVKIVGVPDDAIRLSLFSFSLA

SEQ ID NO: 108275 - protein, 107 aa, Glycine max
  Coding DNA Sequence Number=SeqID_16590
TTEERWRQFKFDLTSKWALAADKDSVDDTVCEKYNISKEKWTQFCQSRRDHSWEAIQKQNIAPHLLSRGGYEFLENKLMEEKKKKQLEEAAKSGSTDIVIDPSSPIR

SEQ ID NO: 108276 - protein, 156 aa, Glycine max
  Coding DNA Sequence Number=SeqID_16591
DVQFEVELMNLDVGQWRNHPGNQFNRDQGGSSIRPQPQGPSLYDCTTKLEETLAQFMQVSMSNQKSTESAIKNLEVQVGQLAKHLADRPSRSFSANTEKNPKEECKAVMKRSRMTNHVDERKAEKKMEEHKQQLAVKLALEPVDDLVELEEIVEEA

SEQ ID NO: 108277 - protein, 135 aa, Glycine max
  Coding DNA Sequence Number=SeqID_16592
LKGLNGEEGEVPEESEEVQALKAELKKTKVAKEKLKVAVTRVRKECDKLKDINMTAAKALKRETKKARKEEWSRDKFRGALLGNNNDLELRKAEKDKSRMENVMLKDKLRNCQRSKGSLKEQLSKTEDNMLIVID

SEQ ID NO: 108278 - protein, 150 aa, Glycine max
  Coding DNA Sequence Number=SeqID_16593
METLQKVRKAWGVVQKKDKELRGSGPIGGYREWLEAHVQGLDWLPSLRTAKREEVEAPEEDEEVQALRTELEQAQTVKERFKSVPLRIRKENAELRDVNVATTKALEQETKRARREEHGRNKFRGALWGSNNELKLRREERDQSRVDRMS

SEQ ID NO: 108279 - protein, 156 aa, Glycine max
  Coding DNA Sequence Number=SeqID_16594
  Homolog annotation: Hit_ID=Q9KHC4; Match level="QueryCoverage=26%, HitCoverage=8%, E-value=2e-07, Identity=69%"; Hit description=SocE
DAGSRQARQGASAGVGGCRGWLNYAASEQIVLRVHHMRAIGAGLFAITPAGERGMCCKAIKLGNARVFPVTTLSKEGGGCRPTRPGEQGCFHQKAPSSVGTPGRPNRETCRASCINESANARGEAVCVLGALPLPRSLTRCARSFGCGERYQLTQR

SEQ ID NO: 108280 - protein, 148 aa, Glycine max
  Coding DNA Sequence Number=SeqID_16595
LGHHFKNSVAPPTYLALLIRLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 108281 - protein, 118 aa, Glycine max
  Coding DNA Sequence Number=SeqID_16596
WSNGGLMPTNNGPRTKLGYDRHPLILEEGQRCKYTERRSQFSGFYEEAIGQLLCSPGHDFALSVAGRQLVYNIMTQINVHVAQLISNAIHQFIGVAPPRHPVDPEKSNRALGFSTLIT

SEQ ID NO: 108282 - protein, 58 aa, Glycine max
  Coding DNA Sequence Number=SeqID_16597
EVCDDIAERLEPHLSLGVVTPGSSTHGVIEECLKLARSVTQNHLVYVRSRRRRRTDQA

SEQ ID NO: 108283 - protein, 80 aa, Glycine max
  Coding DNA Sequence Number=SeqID_16598
  Homolog annotation: Hit_ID=A6FJQ2; Match level="QueryCoverage=47%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLCMETGKGVKMDDDEQSGWTTRKT

SEQ ID NO: 108284 - protein, 62 aa, Glycine max
  Coding DNA Sequence Number=SeqID_16599
ARPRGHSGLMFDCQIEKQKPQEKGQNGYFLELSRPKTCPGQHLAHLGHGKASALNNQLAWAS

SEQ ID NO: 108285 - protein, 107 aa, Glycine max
  Coding DNA Sequence Number=SeqID_16600
STKYLSPPERASRTPTNRAFIKKYCVSRQAQGETPQQPGDGQQRATDAPPSPLEFTSAHPQKGSMIPWICMCRNLPFGGRATRDSRDACSTKGIRAESPPTFYLRKT

SEQ ID NO: 108286 - protein, 235 aa, Glycine max
  Coding DNA Sequence Number=SeqID_16601
MEAMKEQMATMMEAMMSVKKIMEANAVAIAATSIVAKVNPTSPSGINQMNHPTSNMVGKDLGSMGGPHYAQSQNKHAFPPCGLPPNYTPSNVAYTSSENVNNSTPILIESRQPQTDHAHVSQPMGKTHEMPHHNLADFEPCLGYATEGQAIGGIPLQNPLEGPRYHPQLHLLHSTTSKNPHAMAKMGKLDHLEERLRAIEGGEDHAFANLEELFLVPDIITPPKFKVLDLTSGIL

SEQ ID NO: 108287 - protein, 173 aa, Glycine max
  Coding DNA Sequence Number=SeqID_16602
  Gene Ontology: Mol. function=oxidoreductase activity, acting on other nitrogenous compounds as donors; Cellular component=cytoplasm; Biological process=electron transport
  Homolog annotation: Hit_ID=A8GCD0; Match level="QueryCoverage=100%, HitCoverage=30%, E-value=2e-80, Identity=84%"; Hit description =Hybrid cluster protein
  Pfam annotation: Domain name=Prismane; Domain location=1-172; Score= -270.5; E_value=0.081; Accession=PF03063.11; Description=PrismaneCO dehydrogenase family
MFCVQCEQTIRTPAGNGCAYAQGMCGKTAETSDLQDLLVAALQGLSAWALQARSLGIVDHEIDSFAPRAFFSTLTNVNFDSQRIIGYARETLLLRDSLAARCRLLDAGVRVDHPMAALQLAGDDMPALLQQAAQFALNGDKAEVGDDVHGLRMLCLYGLKGAAAYMEHAHVLG

SEQ ID NO: 108288 - protein, 191 aa, Glycine max
  Coding DNA Sequence Number=SeqID_16603
  Homolog annotation: Hit_ID=A6FJQ2; Match level="QueryCoverage=19%, HitCoverage=84%, E-value=5e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSSLQRYTKALTNLQRAQLVEKTRQKPQVRRQALEDAVCVLGALPLPRSLTRCARSFGCGERYQLTQRRSFAPSWAVCTNPPFSPTAAPYPGNYRLESNP

SEQ ID NO: 108289 - protein, 163 aa, Glycine max
  Coding DNA Sequence Number=SeqID_16604
  Homolog annotation: Hit_ID=B0HC01; Match level="QueryCoverage=20%, HitCoverage=70%, E-value=4e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTMAPYVVEICTPTPRHQDSYTLTPRCQDPCTPPCIAKIRSPNLKSSRLDQNHGIL

SEQ ID NO: 108290 - protein, 37 aa, Glycine max
  Coding DNA Sequence Number=SeqID_16605
MVIFHHGDAAEDKGEEVASLRSFLEKTSLRSFFEGIL

SEQ ID NO: 108291 - protein, 88 aa, Glycine max
  Coding DNA Sequence Number=SeqID_16606
MAYTHIPDSTSDSPQISASPYQLDFTLYASGSYNAQWNAPGLLHDKHTLHSSRILRKVEVDEPWLGLWLPLNYQVDVGASQHRTLELG

SEQ ID NO: 108292 - protein, 118 aa, Glycine max
  Coding DNA Sequence Number=SeqID_16607
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=66%, HitCoverage=86%, E-value=2e-30, Identity=79%"; Hit description=LacZ protein
MSYVTESDIGDPLESTCRHASLALAVVLQRRDWENPGVTQLNRLAAHPPFASWRNSEEARTDRPSQQLRTEWRMAPDAVFSPYASVRYFTPYGALSVQSALMKCYDHSYMSRVPLFNF

SEQ ID NO: 108293 - protein, 60 aa, Glycine max
  Coding DNA Sequence Number=SeqID_16608
VQSKHPFPPYGLPPNYAPPNAVHVPEQNVDHSAPIPLESQQPQSGHAHAAQPMGETHEVP

SEQ ID NO: 108294 - protein, 177 aa, Glycine max
  Coding DNA Sequence Number=SeqID_16609
MVEYNGNKGDQCPLHPGELHDVEMFLVSKELLQGLIDEGRIEIGHVRREEAKVFMQSSDTNPGKPKPLGSDGRQDTSVMRVRASMPIGKITNIFGMSGMTHSGCMFAPLELQAKSKDKGKAKEDVVEREKICPVTNNEAPIRKLVEEEGNFGKKEISAKVVMKFLRIIQQSELKVIK

SEQ ID NO: 108295 - protein, 323 aa, Glycine max
  Coding DNA Sequence Number=SeqID_16610
  Gene Ontology: Mol. function=oxidoreductase activity, acting on CH-OH group of donors; Cellular component=plasma membrane; Biological process=electron transport
  Homolog annotation: Hit_ID=A6TA90; Match level="QueryCoverage=58%, HitCoverage=31%, E-value=1e-103, Identity=93%"; Hit description =Monooxygenase, FAD-binding; Glucose-methanol-choline oxidoreductase
AGTKPISGLPTPPGTPAWGSKWKAAVADAYTHHVSMDAHGAHQSYRNNYLDLDPNYKNVFGQPLLRMTFDWQENDIKMAQFMYDKMAPIAKAMNPKLIAGSPKNANSHFDTTSYQTTHMNGGAVMGEDPKTSAVNRYLQSWDVHNVFSIGASAFPQGLGYNPTGTVAALAYWSARAIREQYLKNPGPLDATVSSELIKRGEYLARAGDCVACHTDGKSGKTFAGGLAMETPIGTIYSTNITPDKKTGIGDYSFEDFDNAVRKGVAKNGSTLYPAMPYPSFALVKEDDMRAMYAYFMHGVQPVEQANKDSDIPWPLSMRWPGIL

SEQ ID NO: 108296 - protein, 65 aa, Glycine max
  Coding DNA Sequence Number=SeqID_16611
MPMRGRNNTIVNTHRRRTKHAIGRLGRRPTKVTKKTQNKTHKKTQPSFFKRKKKDSKKDVKVTNE

SEQ ID NO: 108297 - protein, 75 aa, Glycine max
  Coding DNA Sequence Number=SeqID_16612
MELIENMAANDHAILPDRTHIPTKRTYVEELMSLVANRQGFHPGGFAGYQQGGNFAHNQGQGWQSHPGNQFNKDQ

SEQ ID NO: 108298 - protein, 67 aa, Glycine max
  Coding DNA Sequence Number=SeqID_16613
MKKQQWKRRSSKKINGASMRSFNGDFHHGDAAEDKGQEVRGPNLDKKFREEASMEEENERERRGRGN

SEQ ID NO: 108299 - protein, 105 aa, Glycine max
  Coding DNA Sequence Number=SeqID_16614
  Subcellular localization annotation: CTP_CleavageSite=28; ConfidenceScore=5.67e-01
MGSPPASTPPPPSSDASASPSAVKRTHKASRLRSLSTRPPGADRPVVHVDPATGKADGPHRKKLRTYLGIVARDKVDATYENWKEVPTSQKDLIWEDIQPKYCNK

SEQ ID NO: 108300 - protein, 52 aa, Glycine max
  Coding DNA Sequence Number=SeqID_16615
MTKARQKGENGGDACHPARLGEQGDFLQKQPPSGGSSGGPKWAWLLFAPHFF

SEQ ID NO: 108301 - protein, 85 aa, Glycine max
  Coding DNA Sequence Number=SeqID_16616
MYKISLPPLKRLVLPSSHAFIVICFYSLTVGILKIVTSGLPLSENGALSAIPTEGNCVEQPKAALSSIPTEGNCTERPKGALSEP

SEQ ID NO: 108302 - protein, 76 aa, Glycine max
  Coding DNA Sequence Number=SeqID_16617
MAPKKLSAKRSRRDTAAEGTSAAPEFDSHHFRSVEHQQRFEAIKEWLFHRERRVQLRDDEYTDFQEEIAHRRWTLL

SEQ ID NO: 108303 - protein, 102 aa, Glycine max
  Coding DNA Sequence Number=SeqID_16618
ITMHGSKLVGEGCMNENAIHGAPKKGREWRIALSNHYAWLQTPITTHGSKLVGGGCMNENAIHGAPKKGREWRIALSNHYAWLQSRGWRMHERKRNSWGSEK

SEQ ID NO: 108304 - protein, 119 aa, Glycine max
  Coding DNA Sequence Number=SeqID_16619
  Homolog annotation: Hit_ID=Q6WAY3; Match level="QueryCoverage=51%, HitCoverage=2%, E-value=1e-07, Identity=39%"; Hit description =Gag/pol polyprotein
MIHEETQIGCGRALLSSSWGTGKLSSNLEFSWQAQCYLSDNESCEGNDTEDPSVNFEQLVNQVEDGEDEALGLPPDLKRMVEQEDREVKPHQEEIEVVNLNGGEERKEVKVGTGMSTNT

SEQ ID NO: 108305 - protein, 269 aa, Glycine max
  Coding DNA Sequence Number=SeqID_16620
  Gene Ontology: Mol. function=peptidase activity; Cellular component =membrane; Biological process=protein homooligomerization
  Homolog annotation: Hit_ID=Q1GXF1; Match level="QueryCoverage=93%, HitCoverage=89%, E-value=1e-117, Identity=86%"; Hit description=SPFH domain, Band 7 family protein
  Pfam annotation: Domain name=Band_7; Domain location=21-193; Score =199.7; E_value=7.2e-57; Accession=PF01145.16; Description=SPFH domain  Band 7 family
MTGVSVIVIVLVVIAIAKGVRIVPQGEEWVVERLGKFAGILKPGLNVINPVFSTISYKVTTKDIILDVPEQEVITRDNAVILANAVAFIKVTNIERAVYGIENFREAMRNMVQTSLRSIIGGMDLNHALTSRDRIKAELKEAIADEALDWGLTVKSVEIQDIKPSANMQHAMEQQASAERERVAVVTRAEGQKQSLILNAEARLEAARKDAEAQMVGANASAEAIKMIAEAVKENNSSAMFLLGDRYIQSLQKMADSSNSKIVVMPGDV

SEQ ID NO: 108306 - protein, 160 aa, Glycine max
  Coding DNA Sequence Number=SeqID_16621
MLPFDFRHVMELHGLPNDGCQVPRSDQIRVASQQTDGPRTKLGDCSSQHKLCFNNTTHAPRFLMNVLVVHMKNKSCSFNTSHAPSALVVLLGLKALPQLLVLAQGPRCPEDVLSFHASFNHLLNRHHHSKVVVNRPFVTHLHHHRHSPHAEELEGEALDP

SEQ ID NO: 108307 - protein, 96 aa, Glycine max
  Coding DNA Sequence Number=SeqID_16622
MDCDLFVEDKPAPEHNVCLQVMEGGQEVLKGFNFLEKGLKNNSENFFLKNSPFAKRKPRAKRNSVHALSRESQALSAQPLHLRLIWSAKLAKVELS

SEQ ID NO: 108308 - protein, 50 aa, Glycine max
  Coding DNA Sequence Number=SeqID_16623
MWTWPRIAPRSRMSGCEYPLVRGHERGPTKQKILMLKGCYGGVTTLGDNC

SEQ ID NO: 108309 - protein, 172 aa, Glycine max
  Coding DNA Sequence Number=SeqID_16624
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCDEPPFRPNRAPYPVTIVLSPT

SEQ ID NO: 108310 - protein, 120 aa, Glycine max
  Coding DNA Sequence Number=SeqID_16625
MGSSQMPSLKKRFYQVKVKSLGITSLKELGQMMGQLQRQAFRKAYDKIWDLAMVEVSIEAIASLAQYYDQPLRCLHLCGLPAINHDSLNLGAGIRPQKASRKWGGWNTEKIFGGKSKNLG

SEQ ID NO: 108311 - protein, 227 aa, Glycine max
  Coding DNA Sequence Number=SeqID_16626
  Homolog annotation: Hit_ID=Q5QJQ3; Match level="QueryCoverage=44%, HitCoverage=80%, E-value=1e-54, Identity=99%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTLRVELLSWTPSQADETWNLGTELEFVIMVIAVSCSGPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPN

SEQ ID NO: 108312 - protein, 198 aa, Glycine max
  Coding DNA Sequence Number=SeqID_16627
  Homolog annotation: Hit_ID=Q5QJQ3; Match level="QueryCoverage=15%, HitCoverage=24%, E-value=4e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPLEELNFNENGGFNLWQLPADIDSRETCRASCINESANARGEAVCVLGALPLPRSLTRCARSFGCGERYQLTQRRSFAPSWAVCTNPPFSPTAAPYPVTIVLSPT

SEQ ID NO: 108313 - protein, 94 aa, Glycine max
  Coding DNA Sequence Number=SeqID_16628
MSRNFTDYATIPFLIFGMLRNFMDSAIMFPLDSRHVTKLHGLPNDGFQVPQSDQAKVASHQTNGPRTKLGLVMSFKTKKREHRLKGASKKYQQE

SEQ ID NO: 108314 - protein, 66 aa, Glycine max
  Coding DNA Sequence Number=SeqID_16629
MIMRGQDIYSSQDEATTSPSSSGSEEAKREEYSEEIYPQEEGQPLMVKEECKEVLLGTDRSHTQIK

SEQ ID NO: 108315 - protein, 131 aa, Glycine max
  Coding DNA Sequence Number=SeqID_16630
MEDSIGKITRITFPSQEGPLLTVKNTLENGGFNPIGKITKITFPSQEDHVSQSRGSALDGEEHIGEWKNPIGENNKDHISQSRGFALDGEKHIGEWRNPIGKLTKITFPSQDGPLLTVKNTLENGGIQSGK

SEQ ID NO: 108316 - protein, 185 aa, Glycine max
  Coding DNA Sequence Number=SeqID_16631
PRKREEVEALEEDEEVQTLRIELEQAQAIKERACTEEHGRNKFRRALWGSNNELKLRREERDQSRIDSLILKDELKVCSRSKRSLSQRLCETETNMLAIISKYQEELNLATTHEHRVADEYAQVYAEKEARGRVIDSLHQEATIWMERFAFTLNGSQELPRLLAKAKAMADTYSAPKEIHGLLSY

SEQ ID NO: 108317 - protein, 93 aa, Glycine max
  Coding DNA Sequence Number=SeqID_16632
  Subcellular localization annotation: CTP_CleavageSite=85; ConfidenceScore=5.10e-01
MHMTQMQFTNTGAREIVSFLDTTFGQRGTQRKPNKGVSHGKTLHKVKWPNSLKTVPSGVANCRNLPFGGRARRDSRDACSTKGIRAESPPTFI

SEQ ID NO: 108318 - protein, 151 aa, Glycine max
  Coding DNA Sequence Number=SeqID_16633
  Gene Ontology: Mol. function=transcription factor activity; Biological process=regulation of transcription, DNA-dependent
  Homolog annotation: Hit_ID=Q21VP8; Match level="QueryCoverage=32%, HitCoverage=15%, E-value=5e-17, Identity=77%"; Hit description =Transcriptional regulator, LysR family
AQYANRLSPRVVRFINAAGTTADHNFTQETAMTMITNSSSVPEVQPDIQLDDRIGNWVDDRVDVGFRLCNPPQDGLVTRRLFPMQLVICAGEPLESTCRHASLALAVVYNVVTGKTLALPNLIALQHIPLSPAGVIAKRPAPIALPNSCAA

SEQ ID NO: 108319 - protein, 225 aa, Glycine max
  Coding DNA Sequence Number=SeqID_16634
ELRRRRWDQVLTHLPEKRIDVALVKEFYSNLYDPEDHSPRFCRVRGQVVRFDADTINDFLDTPVFLEDGEEYPAYTRYLSTHPDPDTIAATLCTPGGRFVLNVDGLPWKLLEGHDETCSDMEACLIYGLVSRMDMDVGSFISQQISQIAQSSTSRLGFPTLIIALCDIQGVVSDTLIFESLRPAINLAYVKKNCWNPADPSITFPGPRRTRTRASASASEAPLPT

SEQ ID NO: 108320 - protein, 95 aa, Glycine max
  Coding DNA Sequence Number=SeqID_16635
MDRSWMNQSRMSPEYEDGVEKFLQFASERGRPNEEGKYYCPCINYLNTCVVVNDAKDILGGVEEKSPAFQEPRDLRSNPFQGRGNDAILPRKGIG

SEQ ID NO: 108321 - protein, 156 aa, Glycine max
  Coding DNA Sequence Number=SeqID_16636
  Homolog annotation: Hit_ID=A6FJQ2; Match level="QueryCoverage=24%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPALESHDRYLGFPTLIGRSKTQLFEFIFDRVWKKLKGWKGRALSQARGDVEGRKPQGTELEFVIMVIAVS

SEQ ID NO: 108322 - protein, 96 aa, Glycine max
  Coding DNA Sequence Number=SeqID_16637
MKANMEAMKDQMTSMMEAMLSMRRMEDNVAAVAATSATTEVDLTHPSDINQTSHPVPDMVGQGGEVLGSTGGPHVVQNKNSCPPYGLPPNYTPPNA

SEQ ID NO: 108323 - protein, 379 aa, Glycine max
  Coding DNA Sequence Number=SeqID_16638
  Gene Ontology: Mol. function=6-pyruvoyltetrahydropterin synthase activity; Cellular component=integral to membrane; Biological process=tetrahydrobiopterin biosynthetic process
  Homolog annotation: Hit_ID=A8G9X5; Match level="QueryCoverage=28%, HitCoverage=89%, E-value=2e-55, Identity=95%"; Hit description =Putative uncharacterized protein
  Pfam annotation: Domain name=PTPS; Domain location=1-111; Score =200.2; E_value=5e-57; Accession=PF01242.10; Description=6-pyruvoyl tetrahydropterin synthase
MATTLFKDFQFEAAHRLPHVPEGHKCGRLHGHSFMVRLEVTGEVDPHTGWVMDFAELKAVFSPIWERLDHHYLNDIPGLENPTSEVLAAWIWQQLKPQLPELTAVMILVGLHRQPPVARDAGFDAQAGRLFFLADRLQRNNARLVVLQRRQQRVQRLDVALARHRMLHLVGAPQRLIQHLHAAAHIHLRRNRHPSVGGTAHLVGAAGLNLAAITMLFEQLGQRRQIVDAGFAAGDHHMARGVTLLAHHRQQLLGAGVAPGVALFCFDQDPLQVDFPIGFLFPGMFGIAPTAPYRAALQADKNGRHAGEKAFALQGLEHLIDRGAMTHSTSELNIQQAIDDSKFSLFHWTLIILGFLILAIDGFDTAAMGYIAPSVAKDW

SEQ ID NO: 108324 - protein, 95 aa, Glycine max
  Coding DNA Sequence Number=SeqID_16639
IREEAEETQVRQVAATTPERSLEATSEPFAPVVNLPSPQPAADPSTPLQQMPEDPTTPVLAMDTSPPTTLVLQLTNKEDDQFCQKVVLMISDQTG

SEQ ID NO: 108325 - protein, 90 aa, Glycine max
  Coding DNA Sequence Number=SeqID_16640
MGAKYLETVKQRLHAIKKWSPNEIRGQENILIARFPDHNYGVKTINFIITPLTYRELLVGSSLRHLEVSLICACQSNTSLYYAKTKGILA

SEQ ID NO: 108326 - protein, 82 aa, Glycine max
  Coding DNA Sequence Number=SeqID_16641
  Gene Ontology: Mol. function=oxidoreductase activity; Biological process=metabolic process
  Homolog annotation: Hit_ID=Q9SXZ7; Match level="QueryCoverage=78%, HitCoverage=13%, E-value=3e-24, Identity=81%"; Hit description=NADPH oxidoreductase homolog
  Pfam annotation: Domain name=ADH_N; Domain location=30-82; Score= -20.4; E_value=0.083; Accession=PF08240.3; Description=Alcohol dehydrogenase GroES-like domai
MDTILGLIVLIYHLCESVSFSSGRYFGGNNNDVVSHLPFDVGFEVVGIIATVGDSVTDLKVGMPCAFMTFGGYAEFLMMGSA

SEQ ID NO: 108327 - protein, 83 aa, Glycine max
  Coding DNA Sequence Number=SeqID_16642
MKVTALKQTSHDMIAHIGKARAAVEELKRFLVADSLEEVNKKLDKFYMVLILRSLHSDFDHVRDQVLAGDQVPSMDSLNYFPS

SEQ ID NO: 108328 - protein, 128 aa, Glycine max
  Coding DNA Sequence Number=SeqID_16643
MELLLESKMRQGGWGEAFSSTASPAAASFAWTPLPFEKTRAGGARKNGERGLTARLPEDPLWVLPKLPEEHVPETFRKKCSSGRNQTFSGRTLLPETFRKKGSSGKRLGFPEEVSGRGIIPEEQFFRK

SEQ ID NO: 108329 - protein, 342 aa, Glycine max
  Coding DNA Sequence Number=SeqID_16644
  Homolog annotation: Hit_ID=A2Q1D6; Match level="QueryCoverage=26%, HitCoverage=14%, E-value=1e-10, Identity=42%"; Hit description =Ovarian tumour, otubain, related
MMLATDDIESPTSTLCFPESTVQMNNNNNNTMVSTNHIGEGAIETVNGGGDSESWRYFTKHNNEEELVETDEKRIMYDTMSCLQDDDDIMVAVEALRGAVATCTQQTVKWRNCHSAIILPEEVSIWKLSGKPFSGNFPENLLPEEEFVTSRSTHKLLPEERHPECFRKNRLPEVSGRSFFRNFHWLSREVFEDLVVPCFVFEVLLVAVLPISSEMDADQWRYDFAVSQEVHMDYDYDNQEECGVNEPHVDCSNAFNTSQVFATRDDVLQWARTVAHENEFVAVIMRSDTETGSRERSSFFLIGCERSGTYKCRNKEFVRNDTGSRKCGCPFRLRGKPVHGGE

SEQ ID NO: 108330 - protein, 456 aa, Glycine max
  Coding DNA Sequence Number=SeqID_16645
  Gene Ontology: Mol. function=nucleotide binding; Cellular component =Golgi apparatus
  Homolog annotation: Hit_ID=Q6E278; Match level="QueryCoverage=91%, HitCoverage=98%, E-value=1e-147, Identity=54%"; Hit description =Putative uncharacterized protein
  Pfam annotation: Domain name=DUF246; Domain location=91-379; Score =494.5; E_value=1.3e-145; Accession=PF03138.5; Description=Plant protein family
MEVRSEGIQVRCDKLQSPVIPRTRLRIWFIRVCSSIVVWTCLVQLVTVSELWHSHLISGITNGIYHITQVQLPIQEDNGVAQSPPVFLPPIARFLNLTLVVPELDKTSFWADPSNFEDIFDVKHFIYSLRDEVRIVKRVPKKFSSKHGYATLEMPPVSWSNEIYYLEQALKFTPQIENLGHKLIQMLHEKGPFVALHLRYEMDMLAFSGCTYGCTDKEAEELKQLRYAFPWWREKEIISDERRSQGLCPLTPEEAALVLRALGFGRETQIYIAAGEIYGGERRLAQLRALFPRIVKKETLLTWDDLQQFQNHSSQMAALDFMVSAASNAFVPTYDGNMAKLVEGHRRYSGFKKTILLDRKKVVELVDMHQNGTLSWIEFADAVRRVHEKRIAQPTRRRVILDKPKEEDYFYANPHECLCEETNCDDLLGPRNSSQITAPKTLDYKNFVGNQGKEST

SEQ ID NO: 108331 - protein, 87 aa, Glycine max
  Coding DNA Sequence Number=SeqID_16646
MGDVVAMMDIPGKYLYLGACHSVWNFHETQAAHHGEGGGSCLCMTGEKKESHEDSISGGFNFFSVSLTFGNSIEIVGGITGGISGNC

SEQ ID NO: 108332 - protein, 173 aa, Glycine max
  Coding DNA Sequence Number=SeqID_16647
  Homolog annotation: Hit_ID=Q84VH5; Match level="QueryCoverage=76%, HitCoverage=28%, E-value=9e-23, Identity=83%"; Hit description =Envelope-like protein
ILIVSEHQIAKEITAKQVQHWPKKGKLSAGKLSVKYAILHRIGAANWVPPIILPLLPQRESPLSLHYKLFEGTHVPDIVSTSGKAAASGAVSKDALIAELKDTCKVLEATIKASTEKKMELELLIKRLSESGIDDEEAAEEEGEAAEEEEEAAEEEEDAAEETESDDDSEATP

SEQ ID NO: 108333 - protein, 131 aa, Glycine max
  Coding DNA Sequence Number=SeqID_16648
  Gene Ontology: Mol. function=receptor activity; Cellular component =late endosome membrane; Biological process=intracellular protein transport
  Homolog annotation: Hit_ID=A9P847; Match level="QueryCoverage=85%, HitCoverage=96%, E-value=2e-39, Identity=70%"; Hit description =Putative uncharacterized protein
  Pfam annotation: Domain name=Sec20; Domain location=38-129; Score =5.6; E_value=0.0028; Accession=PF03908.4; Description=Sec20
  Pfam annotation: Domain name=V-SNARE; Domain location=8-106; Score =39.5; E_value=1.2e-08; Accession=PF05008.6; Description=Vesicle transport v-SNARE protein
  Pfam module annotation: Pfam domain module=Sec20::V-SNARE; Domain location=38-129::8-106
MAFSKHASLTGIFTVGFLLVHHVRASADQRERLTMSVERLNQSSERIRDSHRTLLETEELGINIIQDLHSQRETLLNSHKRLHGIDDAIDKSKKVLTTMSRRITRNKWIVASVIGALVFAIVIILFYKLSH

SEQ ID NO: 108334 - protein, 106 aa, Glycine max
  Coding DNA Sequence Number=SeqID_16649
MASANNFQPPPPPPPPIYSDGDGNSSVHSDGGSTNLFDRGPSVHFDDGSTDHLDSDSSGCYTASVVLYSDGNFGNCIFFVFVTFLFLACDLCETQKLRLLVVVSAS

SEQ ID NO: 108335 - protein, 97 aa, Glycine max
  Coding DNA Sequence Number=SeqID_16650
MQLRKKVLPWNPSEEVSSVESRRRRFFRWIQRKKVLPQFKLATAEESSSVESSERSSCATFHGRTFFRSCIFQLRKNLLPWIRRGRPSSFPAIYTIS

SEQ ID NO: 108336 - protein, 126 aa, Glycine max
  Coding DNA Sequence Number=SeqID_16651
  Homolog annotation: Hit_ID=A5AV29; Match level="QueryCoverage=71%, HitCoverage=16%, E-value=1e-07, Identity=36%"; Hit description =Putative uncharacterized protein
MMSTADSVTLTQFIERMRIFKFLFGLNSEFDLIQVQILGKEKLPSLLEVFYILLARVPQKAHPLHLGSLSQRLTVMIDGVAIVGSQVILRRHDLDFMERRRYLSALEDSKVPHKGMLIKQCLLPKV

SEQ ID NO: 108337 - protein, 110 aa, Glycine max
  Coding DNA Sequence Number=SeqID_16652
  Homolog annotation: Hit_ID=A7QMP6; Match level="QueryCoverage=96%, HitCoverage=28%, E-value=4e-08, Identity=31%"; Hit description =Chromosome undetermined scaffold_127, whole genome shotgun sequence
MKHKIPRIAINANQVVNKMKRWSTKPNDVVDMMNTSGFGWDDTRKCVTCDSSQKHPKVGNHVNKEFKEFEKLQSIFGKDRANGCGAEGCVDGMENEIGENQVGDDDEWLH

SEQ ID NO: 108338 - protein, 58 aa, Glycine max
  Coding DNA Sequence Number=SeqID_16653
  Subcellular localization annotation: CTP_CleavageSite=47; ConfidenceScore=5.32e-01
MKVRACSPLKAWACNPIKARTCSPLKVRTCSLLKAKVCSPLKVRTCSALEARTCSPLK

SEQ ID NO: 108339 - protein, 423 aa, Glycine max
  Coding DNA Sequence Number=SeqID_16654
  Gene Ontology: Mol. function=phosphoprotein phosphatase activity
  Homolog annotation: Hit_ID=A7UQU7; Match level="QueryCoverage=44%, HitCoverage=32%, E-value=2e-22, Identity=32%"; Hit description=IMP dehydrogenase/GMP reductase, putative
MVRTRGLGRALGTGRGRETTQDVPKADVPWHCRPTASARRQRVRVPEDVAQRPEDVPQLHEDAPHVSDGTPDMTSAADAVDTEGVATEVSLGSPTADEGFPGGPRNPLVLTGYAEHVAHNIWSGQCSVITSDPRLISAFVERWHPKTSSFHLPVASTHVHVVHLQAFKDLAQTGGFAWGAATLVHMYDHLNDASQASTRQMGGYITLLHCWIYEHFPSVHRCSVDAAYDEGSPRACRWLTGKAHMTGIKGAPYRTRMDALTVTDVSWMPYAEHRGVRGFDLISSYTGQLRWGQLVMYTRPERVTRQFDYIQTVPPSSVTESLTSDEIDDRWIHFSDHLVGAWEICVVPRQVAPYYMEWFFRISHPFVTPIEETLESRQLPPPHVEEFVEPPIPEVSVASDLPTHSVPEVTPQMTVLGRDRDAP

SEQ ID NO: 108340 - protein, 418 aa, Glycine max
  Coding DNA Sequence Number=SeqID_16655
  Gene Ontology: Mol. function=catalytic activity; Cellular component =nucleus; Biological process=regulation of transcription
  Homolog annotation: Hit_ID=A7QI82; Match level="QueryCoverage=81%, HitCoverage=78%, E-value=8e-72, Identity=50%"; Hit description =Chromosome chr17 scaffold_101, whole genome shotgun sequence
  Pfam annotation: Domain name=TCP; Domain location=59-260; Score =156.2; E_value=9e-44; Accession=PF03634.4; Description=TCP family transcription factor
MELEADHQNGIRSRPNFPLQLLEKKDVDDVTEQPCSTTSVVTTAAATITSGNNDLHVAEQSKKPPPKRSSTKDRHTKVDGRGRRIRMPAACAARVFQLTRELGHKSDGETIEWLLQQAEPAVIAATGTGTIPANFTSLNISLRSSGSTMSAPSHYFRGNYFNPSTFSTSAAAASAAAVAQLRSRAEWDRNMSMVMEDSRRSMLENTSSISAILNFNPMGNVNVIQQAKQELREESAAAGGGGSLDSVASDSDGSLGRKRRPEQELSQMGSYLIQSSTGSLPSSHASNTAAFWMVAGHGNQAMSGGGGSDGSSDNPIWAIPSVGNSGVYRGAMSAPGGIHFMNFASPMNLIPGAQLGSAMVGGGSGGGNSGSQLLSESRFRLTASRSLRPAPGNLTAETMDVIPPVNIPEGKNNHKCMI

SEQ ID NO: 108341 - protein, 61 aa, Glycine max
  Coding DNA Sequence Number=SeqID_16656
MSNLASKLKALKLELGEDLTSQNKKKETKDALSKRNKRKMKNLLATYKKSGHNKSVQGAFM

SEQ ID NO: 108342 - protein, 311 aa, Glycine max
  Coding DNA Sequence Number=SeqID_16657
  Gene Ontology: Mol. function=ubiquitin protein ligase binding; Cellular component=cullin-RING ubiquitin ligase complex; Biological process=ubiquitin-dependent protein catabolic process
  Homolog annotation: Hit_ID=Q0WL17; Match level="QueryCoverage=94%, HitCoverage=56%, E-value=1e-98, Identity=52%"; Hit description =Cullin 3-like protein
  Pfam annotation: Domain name=Cullin; Domain location=1-242; Score =120.3; E_value=5.7e-33; Accession=PF00888.13; Description=Cullin family
MLCDDKYEDLGRMYNLFCRVTDGRAKIREVMTSHIRESGKQLDTYPERLKDPKSLNSSFEYFINLNPRSPEFISLFVDNKLWKGLKGVSVEITLGKVMMLFWYLHEKDLFEKHENLSRNIAELLYANHPELSNGPTLAVQVLTTGFWPTQSTVTSDLKATFGKGQKHELNVSTYQMCVLMLFNKADRLSYKEIELATEILASYLKRCLQSLDLVKGRNVLRKEPKSKDVGENDAFFVNDELYRIKIGTITAQKESEPEILETRQRVEQDRKSQIEAAIVRIMESRKQLDHNNLMTGYKASCSCGSLQIQHR

SEQ ID NO: 108343 - protein, 493 aa, Glycine max
  Coding DNA Sequence Number=SeqID_16658
  Gene Ontology: Mol. function=protein binding; Cellular component =cytoplasm; Biological process=red or far red light signaling pathway
  Homolog annotation: Hit_ID=A7QEE7; Match level="QueryCoverage=83%, HitCoverage=96%, E-value=7e-54, Identity=36%"; Hit description =Chromosome chr1 scaffold_84, whole genome shotgun sequence
MVILAATSNNKIHQLQTFNSQNNNYHLRDASFSSYLNNKKEILAESGHGYVSSRKEPLGVKKEDDGEIGVFEAEKYFNGEEMESPPRIADNDANKHLPQKDEQTVLVTRKYKVQYGTPSVRSESSLNSQSALLQSAVRNSSRNMKSKLQRKSFLAGLGCKCYCSDKNSVDISDHTGEISFSKNATHGKTTSRNMFNAEPEANHSFKMTKPNAAEISINKDVYFQRPEKLGVGLSKENSLALSAVNSISGNHLLKMQLQQVEKSRNSLEVFGSPILSIRNKSLSFDKRLAKTSSWDDAPKIEETDFSAKSGGNYNDADSDASSDLFEIESLTGKSNTFLGRSTSNVVSSCASPTTCYAPSEVSIEWSVATASALEYSAMSDYDDQRSIATTRSPIRTSIVSSNAKPKVIKEMQRRRPSMLLGCKSQKAVGVAVNAFTTYEKTSSNTNSRCRSDTFPQVTETKEGSFGARHKQHAYATTPLQRSLSPHPSQLLYI

SEQ ID NO: 108344 - protein, 86 aa, Glycine max
  Coding DNA Sequence Number=SeqID_16659
MYTEYTTRKVLVMEWIEVRAYALVIPELIDLKDDLQKHLLIESACPLNINNALLMECPSAPATSIGGTGSSVIMILLYLMSMEKLL

SEQ ID NO: 108345 - protein, 747 aa, Glycine max
  Coding DNA Sequence Number=SeqID_16660
  Gene Ontology: Mol. function=nucleoside-triphosphatase activity; Cellular component=intrinsic to membrane; Biological process=innate immune response
  Homolog annotation: Hit_ID=Q8W2C0; Match level="QueryCoverage=90%, HitCoverage=57%, E-value=2e-84, Identity=40%"; Hit description =Functional candidate resistance protein KR1
  Pfam annotation: Domain name=LRR_1; Domain location=545-570; Score =5.0; E_value=37; Accession=PF00560.24; Description=Leucine Rich Repeat
  Pfam annotation: Domain name=LRR_1; Domain location=611-632; Score =5.2; E_value=34; Accession=PF00560.24; Description=Leucine Rich Repeat
  Pfam annotation: Domain name=LRR_1; Domain location=634-659; Score =9.9; E_value=4.5; Accession=PF00560.24; Description=Leucine Rich Repeat
  Pfam annotation: Domain name=NB-ARC; Domain location=229-483; Score= -16.3; E_value=3.1e-09; Accession=PF00931.13; Description=NB-ARC domain
  Pfam annotation: Domain name=TIR; Domain location=2-103; Score=32.7; E_value=4.6e-08; Accession=PF01582.11; Description=TIR domain
  Pfam module annotation: Pfam domain module=LRR_1::LRR_1::LRR_1::NB -ARC::TIR; Domain location=545-570::611-632::634-659::229-483::2-103
MDDQGVRKGEEITPTLMKAIQESKIAIVIFSENYASLTFCLQELVKIMECFKHNGRLVWPVFYKVDQVDMGHPKGSYVEALVKHETRISEKDKLKKMETLCSATSCSQPRTCTLAFTLATPCAYSHSQPHFLSQARLSHVLFCVIVRETIEAHDLVRYGGADEGFEIVGILVQSFLVRVELEVVICFFELIESFVYGFESIVECSCLAFQLNDVVVVGFVSDVGLEGYDKEAEFGIECTNMGSFEIQEVSKRINRIPLGVAKSPVGLVSRAEGIYGTGRIGKTTLACAVYNFVADQFKGLSFLFDVRENSDKNGLVYLQQTLLSDIVGEKDNSWGIIIITTRDIHQLHSHGVETERTYKVDGLNHDEALELFSWHAFKSKQVNPSFQNISLRIIQHFDCLPLPLEILGSDLFGKTVPEWNSALDAYERIPHKSIQKILIVSYDGLEELEKEIFLDLACYFVGYKQRNVMAILQSGRGITLDYAIQVLIDKNHPQPGERSRLWFYKDIVRVLKENNGSDKTQIIVLDLPKDKEVQWDGNTLKKMENLKILVVKNTCFSRGPSALPKRLRVLKWSRYPESTLPADFDPKKLVIFDLSLSFFTFKNQGNMKFKSLTDMKLSDCKLLEEVPDLSGATNLKKLHLDNCKELREIRGLPPNIEYLSAINYTLLTSKSKERLMNKDQLSQVRSISVAGVHLRVSGFVTSSQQLISVSWDVSNVDESKSAAHTHTENGWNCVEISFENEGKSGIE

SEQ ID NO: 108346 - protein, 67 aa, Glycine max
  Coding DNA Sequence Number=SeqID_16661
MSFTEGRVVLILEGGSNLDFISKSMHAYLEVLLADKPIIESVPGTSFNSYQVDQQQRETLPFEKSYM

SEQ ID NO: 108347 - protein, 57 aa, Glycine max
  Coding DNA Sequence Number=SeqID_16662
  Homolog annotation: Hit_ID=A7PU23; Match level="QueryCoverage=49%, HitCoverage=5%, E-value=2e-07, Identity=89%"; Hit description =Chromosome chr7 scaffold_31, whole genome shotgun sequence
MSQSDVNTVCFADETSHLIYSGSDDSFCKVKLNKEEFRYDDGLNYNKKSNFDASLSK

SEQ ID NO: 108348 - protein, 61 aa, Glycine max
  Coding DNA Sequence Number=SeqID_16663
  Gene Ontology: Mol. function=metal ion binding
  Homolog annotation: Hit_ID=A7P414; Match level="QueryCoverage=78%, HitCoverage=7%, E-value=4e-16, Identity=77%"; Hit description =Chromosome chr1 scaffold_5, whole genome shotgun sequence
MNKGHMMHGVFHSNGFGHLLCVNGLEMGSSLAGNQIMEFWNRLCYGLQARLTLFQQLFLIC

SEQ ID NO: 108349 - protein, 182 aa, Glycine max
  Coding DNA Sequence Number=SeqID_16664
  Gene Ontology: Mol. function=aminoacyl-tRNA ligase activity; Cellular component=mitochondrion; Biological process=tRNA aminoacylation for protein translation
  Homolog annotation: Hit_ID=A7R3J0; Match level="QueryCoverage=74%, HitCoverage=26%, E-value=3e-42, Identity=60%"; Hit description =Chromosome undetermined scaffold_528, whole genome shotgun sequence
  Pfam annotation: Domain name=tRNA-synt_1e; Domain location=34-182; Score=-98.2; E_value=2.8e-09; Accession=PF01406.10; Description=tRNA synthetases class I (C)
MAESTHSKSSLNRLEDAIAKLTTTQLIFAATQAFVQVSVEIKRAYEIGEDPLLLSNIFCDEYNVDMDDLQCETPSKESRVSENLNKIKDRITQIINNGYAYEVDGNVFYVDDKCPNYGMLSRQRLAHNTAGEKVVVGSRKCHPTDFALWKAAKLGEPSKDNPWDLGGPGWHMECSLEGLVSP

SEQ ID NO: 108350 - protein, 80 aa, Glycine max
  Coding DNA Sequence Number=SeqID_16665
MEGSKKILTGKKEAAGKGGVMQGGWRNIFMCVLASLCPVQHLRPAPYAYTDQKWLCHCSCSNPLRIAVGTTAECHMSAPH

SEQ ID NO: 108351 - protein, 1007 aa, Glycine max
  Coding DNA Sequence Number=SeqID_16666
  Gene Ontology: Mol. function=structural constituent of ribosome; Cellular component=intracellular; Biological process=translation
  Homolog annotation: Hit_ID=A7PMW3; Match level="QueryCoverage=39%, HitCoverage=70%, E-value=5e-95, Identity=47%"; Hit description =Chromosome chr14 scaffold_21, whole genome shotgun sequence
  Pfam annotation: Domain name=DUF1666; Domain location=763-1007; Score= 385.7; E_value=7.1e-113; Accession=PF07891.3; Description=Protein of unknown function (DUF1666)
MGTKSLLMLKSHIDSINIRVVNDFVCVNMLWAFASLRVFVCNYVFYEFGLVIRYIFRFLHLGDAEDEIIVQKLKHVERNQVSDSEIDGFQEELASFLFWSEDFHEETEAETESSVSFMEVAPESEKRDGDTDCSAFSMEIIALEREKRDGETECSVFMDTHCDVHEDGVKTEVPTESSVSEEIDSDIREDGMSRGIEEKGSSFMNSDTDNYVTHDNNREIERETQELGFMETDSDVHEDGKRNDEDETENSVFVENDSDLHRRIMEREEEEIKEHVSAEIDTVVHEEFKKIDENETGSGVLMENVSSETVNDDGAETDENDEGFVHGEDTKIEEKEEETYGHVFVDTNSVTTTSKCEYLSGKDISGFMEEPTTLRFSFREFHMGLDISTVSDNAYASPKIITDKEFSEFGSEKKPVAQAQTEDSVQEEVSAPSTHIPLHFESNMFGGSDSSDEDYFLYNENSVTSDSESESSSSSGLNWGNSNKMDDSIVYQFLGGKNDGEGFQPEILKLMLREERKEVVEEKQSSCDGKVSEFNAHAIYSGDGYMEMEPCMKGLNSLNAHGFGGKESGKSGVKDQKEGSQNGYVCSGLKKSEEIRWEDELSDSESDEGDFEWEHDDLVEQLKLELKNSRQGGLATIVEEEEEAEEEVVVVEEEEEEQERVSPRVVEDPKPVEIEEKLEYEDQIDEIDKVYKSYAEKMKKLDILNYQTMHALGLLQLKDPLKLISFPKSAIQGAKPVISQNLWPRKASKNSSDPLVKLVHELQRDLELVYVGQVCLSWEILCWQHKKALELQQYDSQGSHSHRYNHVAGEFQLFQVLVQRFIENEPFQGPRLQNYVKNRCVIRNLLQVPGIKDDSKVDEEEDAIASGKLADIIKESMRVFWEFVRADKDYGNVIFKASRHNRIDLKDPMISGLMVDIKTQLQKKERRLKDIVRTGNCIVKKFQKHHEDELDHEQLVARVGLRLISRVVNMSKLRKEQLIWCNEKLLRIKFLSRKIVQVEPSFLLFPC

SEQ ID NO: 108352 - protein, 239 aa, Glycine max
  Coding DNA Sequence Number=SeqID_16667
  Gene Ontology: Mol. function=endoribonuclease activity; Cellular component=extracellular region; Biological process=response to stress
  Homolog annotation: Hit_ID=Q9FQL6; Match level="QueryCoverage=90%, HitCoverage=95%, E-value=1e-104, Identity=76%"; Hit description=S -like ribonuclease
  Pfam annotation: Domain name=Ribonuclease_T2; Domain location=16-205; Score=367.6; E_value=2e-107; Accession=PF00445.9; Description =Ribonuclease T2 family
LLILQYLAVLSISQEFDFFYFVQQWPGAYCDTKQSCCYPKTGKPSADFSIHGLWPNYNDGSWPSNCDPDSVFDKSQISDLISNMEKDWPSLSCPSSNGMRFWSHEWEKHGTCAESELDQREYFETTLKLKQKVNLLRILKNAGIEPDDGFYTLESISEAIKEGTGFTPGIECNRDSARNSQLYQVYMCVDTSGSNLIECPVLPRSKCGVEGRIPEYEEPRDLRSNPFQGGGDDAILPLK

SEQ ID NO: 108353 - protein, 80 aa, Glycine max
  Coding DNA Sequence Number=SeqID_16668
  Homolog annotation: Hit_ID=A5BZX7; Match level="QueryCoverage=72%, HitCoverage=9%, E-value=2e-13, Identity=53%"; Hit description =Putative uncharacterized protein
MKAFGYRASNSDHTLFLKRGNDQDEISSLQQYHASKFEMKQLGNLKYFLGIEVARSKHGGNLVTWRSKKQPVVVKSSAEA

SEQ ID NO: 108354 - protein, 259 aa, Glycine max
  Coding DNA Sequence Number=SeqID_16669
  Homolog annotation: Hit_ID=A5ATA8; Match level="QueryCoverage=89%, HitCoverage=56%, E-value=4e-19, Identity=25%"; Hit description =Putative uncharacterized protein
PNTDTLSNIGIDASLFLWIFLMAPSDKNQSAKRDSGTSPATHMHEALTLERLNGTNYVEWSLNAQNKIRGREPWEDENCLVKSWLLDSMTKEIRSLFIRLAMAKDIWDTVQQTYSVNQDASRSYQLYREECPKDVEKYNNMINSQRVYIFLAGLDSHLDAAMLDSESTMGTAFVVKKYSKKGIRKCTHYNGDNHVVETSFKLHGYPNWHPKGKTTPNTKVDATSKSHISIAAGFLTKSGISNSVLNLFVVTRGSEWIID

SEQ ID NO: 108355 - protein, 42 aa, Glycine max
  Coding DNA Sequence Number=SeqID_16670
MRFGRQACEEKGLDEVAKGPHNVTLRRIKAGVVRGGGRVTTT

SEQ ID NO: 108356 - protein, 479 aa, Glycine max
  Coding DNA Sequence Number=SeqID_16671
  Gene Ontology: Mol. function=zinc ion binding; Cellular component =nucleus; Biological process=regulation of transcription
  Homolog annotation: Hit_ID=A5AJU8; Match level="QueryCoverage=87%, HitCoverage=88%, E-value=1e-100, Identity=51%"; Hit description =Putative uncharacterized protein
  Pfam annotation: Domain name=zf-Dof; Domain location=131-193; Score =139.7; E_value=8.5e-39; Accession=PF02701.6; Description=Dof domain, zinc finger
MSEVVIKDSAIKLFGRTISLPRNTKNEVSPDEPAPPEDSSSSFPREVSSTTEYDAGDKKPSRKELTSTQEDVEASHQTLEETKSPTSSSCNLENPKTPSTERETSILKSFKNGHQSDTTTTCPSQDKTPKKPDKVLPCPRCNSMDTKFCYYNNYNVNQPRHFCKHCQRYWTAGGTMRNVPVGAGRRKNKNTPSVSHFRQIMVPEGLQNGSLHGAVLTFGSDSPLCDSMASVLSLAEKTTQNGVLNGFHSPNTNTITSNKGDEYYDTVMGSTLSEKRHNATTSTNSHEKSLDNHKSYHHQGFTPQLCFPGSSSSSPWPYPWNPTKTPSAFCNPVPFYTTQAFWGCMPPPSWSVNYQSAPSSGPNSPTLGKHSRDGDILFQKPSTDMAENNNNNNTVLIPKTLRIDDPTEAAKSSIWSTLGIKNEKGNSLNGGGLFKAFASKGSSDEKKNNHVMMVEASLSPVLQANPAALSRSLVFHERT

SEQ ID NO: 108357 - protein, 60 aa, Glycine max
  Coding DNA Sequence Number=SeqID_16672
MAYLHYKWIQIPSNKTRNRITGNILNQTEQEAPYKDDELVGLQVLLQVDPKCHYLSSCGC

SEQ ID NO: 108358 - protein, 263 aa, Glycine max
  Coding DNA Sequence Number=SeqID_16673
MEDILKMEDLFKRWTEYLDSTRSRVSHPPPVNCDFCGGEHCNDDCHLYSMKNSWWRHELHPYNQYEEEGTPNLEGVFAEFMAYHASSITNQNSMQNQEIQVGMARATPWKIIGGSKSYNPTINMKKKEKTIESTQRAFKSLEIQVGKLVKEVAKFVATREENFVEVEAHEESLVEEHDSREKGEEKSEEKAQQWKKCSQVEIQQESILQVNTPPHQLIVKEERHGEHEKSISVILSLITSTSLAMTWKVFPKYMSFMESLAKR

SEQ ID NO: 108359 - protein, 58 aa, Glycine max
  Coding DNA Sequence Number=SeqID_16674
MRMRKHIWQNFERSKQGYSYVKADLDSSCKKAKPLAILRQILCLFGQSNFNQNSPLPS

SEQ ID NO: 108360 - protein, 72 aa, Glycine max
  Coding DNA Sequence Number=SeqID_16675
MTSPCDCNAAKLHAMDLSVEDKEVNQKENALCSWIQAPQPYYVPIDENCFLSMVAKQEQRRDFLQDEENIDW

SEQ ID NO: 108361 - protein, 46 aa, Glycine max
  Coding DNA Sequence Number=SeqID_16676
MDKAEAIVALIPNVRLNLLTCDVANYKREGYYPCLPCPVTIPDKGQ

SEQ ID NO: 108362 - protein, 192 aa, Glycine max
  Coding DNA Sequence Number=SeqID_16677
  Homolog annotation: Hit_ID=Q2HSV3; Match level="QueryCoverage=58%, HitCoverage=18%, E-value=1e-09, Identity=33%"; Hit description=IMP dehydrogenase/GMP reductase, putative
MGKAHMTGIKGAPYRRRLDALTVIDVCWMPYGEHRGVRAFDLISSFTRQLRWGQIVVYVRLERVLRQFGYLQTVPPPPVCDSLMGDDIDDRWLHFSDHLVPSGELCVVPGHYMEWFFQISHPFVTWIEETIAPRHPFVSVATDLPTHSVVHCEGCQGMAQDLGAIAEDLERVINLRMVTPQMEVLGRARDAA

SEQ ID NO: 108363 - protein, 194 aa, Glycine max
  Coding DNA Sequence Number=SeqID_16678
  Gene Ontology: Cellular component=extracellular region; Biological process=cellulose and pectin-containing cell wall organization and biogenesis
  Homolog annotation: Hit_ID=Q9ZP31; Match level="QueryCoverage=100%, HitCoverage=100%, E-value=9e-74, Identity=58%"; Hit description =Expansin precursor
  Pfam annotation: Domain name=DPBB_1; Domain location=62-143; Score =0.7; E_value=0.005; Accession=PF03330.9; Description=Rare lipoprotein A (RlpA)-like double-psi be
  Pfam annotation: Domain name=Pollen_allerg_1; Domain location=102 -179; Score=187.6; E_value=3.1e-53; Accession=PF01357.12; Description= Pollen allergen
  Pfam module annotation: Pfam domain module=DPBB_1::Pollen_allerg_1; Domain location=62-143::102-179
MAQVCLLLVGLLTMFSSAYGYGYGGGWVNAHATFYGGSDASGTMGGACGYGNLYSQGYGTNTAALSTALFNNGLSCGSCYEIRAGIVPVSYRRVPCRRRGGIRFTINGHSYFNLVLITNVGGAGDVHGVAIKGSRTGWMPMSRNWGQNWQSNNYLNGQSLSFKVTTSDGRTVVSYNVAPAGWSFGQTYTGAQFR

SEQ ID NO: 108364 - protein, 256 aa, Glycine max
  Coding DNA Sequence Number=SeqID_16679
MVGCNSGNDDDNDNRDNRMVAMMVGGSGNNNDDGGDDNGGSGGKKVVVVTVVVMETIMMRCGGGRNRVGEDNDSDSDSDNMLMDRAIGGAIAILGSRHHRLELLKVDATVSVGRMGQYIQQSLYDFAKMVLINIFAHPYATVRHADADKWVDTQIGHYIGIGTPFFFFFFFFSSHSFKVCDLYCGDADADKWVDTQIGHYIGIVLLLLLLLLQFSLPLEHAIELVGGDLAVAVGFEAVENCLEFVHVFKVEKEFSF

SEQ ID NO: 108365 - protein, 218 aa, Glycine max
  Coding DNA Sequence Number=SeqID_16680
MAYGRSYLHMRCFQGLWQWSQYVHSPHGEGLNGAWTIEILRRSAPPGKVEGIFLECHPVVAGLHHFGGGHPVWFLLFSSHNFSMSMVGVWSVSWMIVLRCSAFLVLASLESRSALVLLYLGNIVRAFKDDSCPASFYVGRTVNVKVPLVWVVVISSHHPSCEFRLSQNLLDGVVHFDYHLMTLEVGLESSGQALLGVMEYTVSEMDRELVLPFLLYEG

SEQ ID NO: 108366 - protein, 114 aa, Glycine max
  Coding DNA Sequence Number=SeqID_16681
PPSVGSWWFYYPHCGGGLLPTLTSSLSWWVLRWQRREDGANGEKEDTKDKGNSVLRICNTRMEGCWVGVGRRCIGWLGSFCVCLGVLGGAGNKEEGTGSESHGLSNHMDDWVLL

SEQ ID NO: 108367 - protein, 361 aa, Glycine max
  Coding DNA Sequence Number=SeqID_16682
MTSRKRRDVPTPGEASNWDFSRFTSEIAWHRYQDNIQLRNILPKRNVELGPGMFDEFLQEFRRCRWDQVLTQLPEKRIDVALRTTVPDFAGCEDRSFTLTLTRLTTSSTPQSSWRTGTKYLSTHPDSDTIAATLCTPGGRFVLNADGLPWKLLRKDMTTLAQTWSVLSYYDLAPTSHTSDVNLDRARLIYGLGVVSDTLIFESLSPAINLAYVKKNCWNPADPSITFPGTRRTRTRASTSASEAPLSTQPPSQPSSQRPRPSPASTSASLGMHGQMLRSIHVGQQLIMENMHRLSLHLQMDPPLITPEAYRQQVAWPGDQPSTDRGEEPSGAAEDPAVDEDLIADLASADWGPWADLGGGS

SEQ ID NO: 108368 - protein, 193 aa, Glycine max
  Coding DNA Sequence Number=SeqID_16683
  Gene Ontology: Mol. function=nucleoside-triphosphatase activity; Biological process=proteolysis
  Homolog annotation: Hit_ID=A7Q615; Match level="QueryCoverage=55%, HitCoverage=33%, E-value=9e-10, Identity=34%"; Hit description =Chromosome chr14 scaffold_54, whole genome shotgun sequence
  Subcellular localization annotation: CTP_CleavageSite=91; ConfidenceScore=5.60e-01
MAFSPLRSPLHFPERPLFTSIRPIPNQTFISNNPHRTPRTTLSLAPITLTPSLTFASRSTPTPSPSSNDNIVSKDLIHALFCFVVGFSALAAFHAPPPAFAIAAPWTYWAKRGTVEKERAKSHRYSDYTDRLLETMSFLLKTIDEVQNGNGDVSEAEATLEAVKSKKEGLRKETNGRLYRHCGNGPGRLSTRY

SEQ ID NO: 108369 - protein, 368 aa, Glycine max
  Coding DNA Sequence Number=SeqID_16684
  Gene Ontology: Mol. function=pyridoxal phosphate binding; Cellular component=mitochondrion; Biological process=cysteine biosynthetic process from serine
  Homolog annotation: Hit_ID=A5YT86; Match level="QueryCoverage=18%, HitCoverage=18%, E-value=1e-22, Identity=80%"; Hit description =Cysteine synthase
  Pfam annotation: Domain name=Glyco_hydro_17; Domain location=48-265; Score=-87.6; E_value=5.1e-06; Accession=PF00332.9; Description =Glycosyl hydrolases family 17
MKKIQGLQAPHGAYIIVDAMEKYNMHLANSIMERTEVACRDLSTTNVMILQIHMERVVGVEHAKNVHFETTWPEIWEDTNGQVDIFVMGIGSDGTVFGVGQYLKSKNPNVKIYEVEPSESNITTKKILEPSHFENIKVSTSFSFVTALTSPFPPSNAQFQEPNGATLLGPLLQFLHETVLIIVTETGWPSSSAAANKFNANLWYAEIYLKGLVKHLKSGMGTQLLKDGVTEVFVYEMFDKEEGTTGRSWGVLFPNRTAKYHCVDFSCSSVASGSLHIAVMIIIFFLSLLGIIAESQGADSSDHVYTIVENMAETSKNGASTGCAQELLGGEEEEEKSVVSVENQLRKEMTVYEQFLMAFIHMGAGKSI

SEQ ID NO: 108370 - protein, 53 aa, Glycine max
  Coding DNA Sequence Number=SeqID_16685
MQEQLHVELVGLGSSSSMDSFVSWKMNGSGMEKEKREEMPLQGEDESRRSSPP

SEQ ID NO: 108371 - protein, 174 aa, Glycine max
  Coding DNA Sequence Number=SeqID_16686
  Gene Ontology: Mol. function=endonuclease activity
  Homolog annotation: Hit_ID=Q2HUP4; Match level="QueryCoverage=80%, HitCoverage=47%, E-value=9e-60, Identity=77%"; Hit description =Endonuclease/exonuclease/phosphatase
KLQGMCGGGLGENKGSRLEKAFDGQRKTLSNLYDMDQLRNNVNARSLPGSNALYGSSTVSKEQGPLHRRPDVVKSKQGFPHFRERVWVKKLVHDRRIRFGTWNIGTLTGKSMKIVDVMVRRKINFMCLQETKWTGEKAKELDNSGFKLWYTGKIRLRNGVGIIVDKEWKKDVMD

SEQ ID NO: 108372 - protein, 73 aa, Glycine max
  Coding DNA Sequence Number=SeqID_16687
MGDQATNIFHQLQCFKGYLDVSTFEGSLSEIDSLRERFPNTLSELYASLSGCHSLSGCHSLSGFASLSETSTT

SEQ ID NO: 108373 - protein, 159 aa, Glycine max
  Coding DNA Sequence Number=SeqID_16688
  Homolog annotation: Hit_ID=Q6WAY3; Match level="QueryCoverage=47%, HitCoverage=3%, E-value=2e-07, Identity=43%"; Hit description =Gag/pol polyprotein
MNFAARKPVEFTPIPVSYADLLPCLLDNSMVAITPTKVHQPPFLREYDSNATCACHGEAPGRSIEHCRALKRKVQGLIDMGWLKFEENRMIFNFHRKWVQAIGQFAQTTYAPEFGTSKTVGGGVVKQRESSTTRDPWSLNPFLEIRRREEEASRKRGRL

SEQ ID NO: 108374 - protein, 139 aa, Glycine max
  Coding DNA Sequence Number=SeqID_16689
MKHGASQAALSRLGVKQHRHSVDEKFDDLDLLETESLAGFMLILESAKPRKFYLTNVKIVISFNIQNIQIYWTFVSLVSTITQGKLLFMVISMIFGNLDPIIETYLQPIGSTLGVQEKYVASPLADNPTVAQITNWNET

SEQ ID NO: 108375 - protein, 53 aa, Glycine max
  Coding DNA Sequence Number=SeqID_16690
MNEGMKLTSGGSQRQLRVGLRKKSHDHEQFAAVGAQAEGERRNDRVLVREGMK

SEQ ID NO: 108376 - protein, 149 aa, Glycine max
  Coding DNA Sequence Number=SeqID_16691
MGEDQEMHDSIMSEEVGVNHELAKSLVGYPYAGRFTKDEKIIIANMTKSMVKPRNILLTLKEHNAAKEKKAKAADDLLSEMDPLSEMHPLSKASSSLSGWETLEEDKTKICSPSAQPARPTRTLSLLTLSAPTLAKRKFTNLRLARYAR

SEQ ID NO: 108377 - protein, 111 aa, Glycine max
  Coding DNA Sequence Number=SeqID_16692
MYDFMSLYALWLFVDAKGGEKVAIKSRTHIIKFVIIKKREIVEASFMMMNQAILMMPKAQVIDSRLQDQASRTQSKIQDSREEIKKQQVKTSYRISIKRFFQKPNVGSSGL

SEQ ID NO: 108378 - protein, 76 aa, Glycine max
  Coding DNA Sequence Number=SeqID_16693
MSVEGEILIARRQWNEGFNPCSFSLTFGNPNRATRGGALESTINVTIDNGECLSDYIEVRDEFIAIGVRMNKCKDS

SEQ ID NO: 108379 - protein, 78 aa, Glycine max
  Coding DNA Sequence Number=SeqID_16694
MAAEWRRKRERRHHFKEKMSLEEAHHHRRSWIRAWRKRKKEMNEGRGRKEHEILCSKRALKSEPTNPRSISRFSTKCV

SEQ ID NO: 108380 - protein, 140 aa, Glycine max
  Coding DNA Sequence Number=SeqID_16695
MCIVRNNNACVCVQGRRNLWDISLALANTVVDSRSISLADANAELCFEAFSLALSFARLSSVNHMGVRFAWKLLTVLAIKLDPPLPLALQDVTWTVPPFPLAIRGDVDGTAIATGDTGHGHNFAVFRATALQCLGQQHAE

SEQ ID NO: 108381 - protein, 206 aa, Glycine max
  Coding DNA Sequence Number=SeqID_16696
  Gene Ontology: Mol. function=glyceraldehyde-3-phosphate dehydrogenase (NADP+) (phosphorylating) activity; Cellular component=chloroplast; Biological process=reductive pentose-phosphate cycle
  Homolog annotation: Hit_ID=A7QPE5; Match level="QueryCoverage=47%, HitCoverage=21%, E-value=1e-43, Identity=88%"; Hit description =Chromosome chr18 scaffold_137, whole genome shotgun sequence
  Pfam annotation: Domain name=Gp_dh_N; Domain location=24-145; Score =41.4; E_value=2.9e-13; Accession=PF00044.15; Description =Glyceraldehyde 3-phosphate dehydrogen
  Subcellular localization annotation: CTP_CleavageSite=32; ConfidenceScore=5.02e-01
MAGLIHVANVPPLVLAGCPVSSFLTRASGGILCTAVGAGGTQPRTFKTDVKILDNETITVDGKPIKVVSSRDPLKLPWAELGIDIVIEGTRVFVDGPGAGKNIQAGAKKVIITAPAKGADIPIYIVGINEGDYTHETSNIVRGRCPWMLCSPQVMHLKSSDYMELETLCMLCEAGFLTLAMCYTAGIQLSLMLVLGFMLPVTPEIS

SEQ ID NO: 108382 - protein, 90 aa, Glycine max
  Coding DNA Sequence Number=SeqID_16697
MDEDQWMYDSVMFEEVDMNDQNEDEAGVNEEQVFATHDDVLHWARSVTYEIGFVAVIMRSNINNGIRGRTLFVLVSCEISGQYRAKKQDL

SEQ ID NO: 108383 - protein, 93 aa, Glycine max
  Coding DNA Sequence Number=SeqID_16698
MECWEGGDKLQTERIWGRRREWGGWGGVGWGFNVGWGGVAPGPEAPRVAPGAGAPPVAPSARALPVAPGAGALPPCATCRVHSGGAGVGGALQ

SEQ ID NO: 108384 - protein, 103 aa, Glycine max
  Coding DNA Sequence Number=SeqID_16699
  Homolog annotation: Hit_ID=Q51617; Match level="QueryCoverage=59%, HitCoverage=88%, E-value=1e-16, Identity=75%"; Hit description =Putative uncharacterized protein
  Subcellular localization annotation: CTP_CleavageSite=97; ConfidenceScore=5.68e-01
MLCKKAVSSFGPPIVVRSKLAAVLSLMVMAALHNSLTVMPSVRCFSVTGVSRGPFVSRVSVMTVKTSDTCSSRRRSQLVCKRMPGADKPVRARQRVLAGVGAG

SEQ ID NO: 108385 - protein, 88 aa, Glycine max
  Coding DNA Sequence Number=SeqID_16700
MLDQFHSCMQDSIENIIDVKADDNCGYRAIVALLGMGEELWSLVHTHLHKELTSWFEEYINLVGGIERFEELKCSLLVDGLSMVTMDK

SEQ ID NO: 108386 - protein, 178 aa, Glycine max
  Coding DNA Sequence Number=SeqID_16701
  Homolog annotation: Hit_ID=Q6WAY6; Match level="QueryCoverage=24%, HitCoverage=7%, E-value=2e-09, Identity=61%"; Hit description =Putative uncharacterized protein
EGRTGVLSSCEGFSIVPLMGTRGCINYNPILAIRQLGYPMRGAPSEKSIMPFIVGGFSDPNARVLQGAAREEETETPEESEEVQTLKAELQKAQIVKEQFKSTAINYKEKLSLAATHEQRLEDEYAKVSILQAEREARERVIDSLHREAMMCKNRFAFTLNGSQELPRLLAKAKAMGD

SEQ ID NO: 108387 - protein, 59 aa, Glycine max
  Coding DNA Sequence Number=SeqID_16702
MVGTDDRNKEKITTFDIMGERRLSLKLLLAALNGKDSAVVMCRFCRLMGTTTAELLLNR

SEQ ID NO: 108388 - protein, 230 aa, Glycine max
  Coding DNA Sequence Number=SeqID_16703
PHYDTHRFTSEDAWNRYADNVLVRFILLESYVKLFVTEFDEFRTELVRSNWHKTLTNLMEGSIDVALVKEFYANLYVPGDKPPKQVRVRGHLINFEADSLNTFLETLVILEPGETLPTYSKFCKLRPDPQELAAQLCIPGRGFVLNAEGLPWKLLRKDLTTLAQTWSILSYFNLAPTSHTSNLNLDRASLAINLAYIKKNSWNLDDPTVSFPGTRKARARGSESPSSTTP

SEQ ID NO: 108389 - protein, 63 aa, Glycine max
  Coding DNA Sequence Number=SeqID_16704
IMVRTRGLGRALGQVTGRGVGRGDRDDSDDAPQRRRPTASARRQRVAVTADHIDEPVIPAPDV

SEQ ID NO: 108390 - protein, 206 aa, Glycine max
  Coding DNA Sequence Number=SeqID_16705
  Subcellular localization annotation: CTP_CleavageSite=47; ConfidenceScore=5.85e-01
MAATSPPGTPAAPPRQGASNMSIRRPSWPNWRAASRNWRNGARRRMRCSTPTSRTRACATPRPSRRRWAADRTAWAEALAPCGRGAQAASAGSPPPAFKALRPAAPPARAPRASCAPLRPGFPAAPRTCARCRAPARRHSPAAGRAGGLRRRRSSATARASARPCAAPPRPPAGRPGAAAASAPGAGRPGWRRGAASRAPGAVRSG

SEQ ID NO: 108391 - protein, 172 aa, Glycine max
  Coding DNA Sequence Number=SeqID_16706
  Homolog annotation: Hit_ID=A7UQU7; Match level="QueryCoverage=62%, HitCoverage=18%, E-value=2e-10, Identity=35%"; Hit description=IMP dehydrogenase/GMP reductase, putative
MSPRASRWLTSKAHMKGITGAPYRARCDALTVTDVSWLPYTKHRGLRTFDLISSFQGQLRWGPMVVTARPERVVQQFGYIQSIPPPSVSARLSHDDIYDRWMHFAEHVLPVGELCLVHGHDDYDGYEAIAQRLERVLNLRMVTAGTKLYEIMQDCLTIARGGASADGSVRAR

SEQ ID NO: 108392 - protein, 67 aa, Glycine max
  Coding DNA Sequence Number=SeqID_16707
MFPHGKMPRKWVFRPDLIPTYQTPLIYVFILFIGVEGRGPEFQEPLDLRSIPFQGGNDAILPPKGIG

SEQ ID NO: 108393 - protein, 90 aa, Glycine max
  Coding DNA Sequence Number=SeqID_16708
  Gene Ontology: Mol. function=RNA-directed DNA polymerase activity; Biological process=RNA-dependent DNA replication
  Homolog annotation: Hit_ID=Q5NRP4; Match level="QueryCoverage=74%, HitCoverage=4%, E-value=7e-09, Identity=41%"; Hit description =Putative gag-pol polyprotein, identical
MEGGIGPILDLTPKEEKIIEGLKSEENKVPLATPSFQAYALHWWTPLVRERRIHRDPLVEYWNDLKSALRNRHFPSYYERELMDKLQRLR

SEQ ID NO: 108394 - protein, 230 aa, Glycine max
  Coding DNA Sequence Number=SeqID_16709
  Gene Ontology: Mol. function=pyridoxal phosphate binding; Cellular component=chromoplast; Biological process=cysteine biosynthetic process from serine
  Homolog annotation: Hit_ID=Q6FBQ5; Match level="QueryCoverage=99%, HitCoverage=68%, E-value=1e-106, Identity=85%"; Hit description =Subunit of cysteine synthase A and O-acetylserine sulfhydrolase A, PLP-dependent enzyme
  Pfam annotation: Domain name=PALP; Domain location=21-230; Score =189.4; E_value=8.8e-54; Accession=PF00291.16; Description=Pyridoxal -phosphate dependent enzyme
MSTDQQFPTPNNLGIAVYSNNAEAIGNTPLVRINRLIKTDATILAKVESRNPAFSVKCRIGAALIADAEKRGVLKEGMHIIEPTSGNTGIALAFVAAAKGYPITLTMPASMSLERRKVLKALGANLVLTEPAKGMKGAVDEAVRLAVEQPDVYFLPQQFENPANPQIHADTTGPEIWQATGGQVDILVAGVGTGGTITGISRYFEQVQNKPLYSVAVEPAESPIITQTRN

SEQ ID NO: 108395 - protein, 109 aa, Glycine max
  Coding DNA Sequence Number=SeqID_16710
  Homolog annotation: Hit_ID=UPI0000ECBAF8; Match level="QueryCoverage =37%, HitCoverage=48%, E-value=1e-16, Identity=100%"; Hit description= UPI0000ECBAF8 related cluster
MTMITNSSSVPKNVKGKCKSLIGQRNAWEYVMNAWETLVDCPSEQQFDEYLKSRPAGMQAWHWPSFYNVVTGKTLALPNLIALQHIPLSPAGVIAKRPAPIALPNSCAA

SEQ ID NO: 108396 - protein, 236 aa, Glycine max
  Coding DNA Sequence Number=SeqID_16711
GLHHYNPVLAIRRLGYPMKGAPSEEGLTPFITRGFNSTNTGVLQRVHKAWEISQRKYKELMGSSNGPIDSYHMWLKAYAQDLDWLLSLRNTKGVEIETPEQDEEENAELRDVNIAPTKALEQETKSNSELKLRREERDQSRVDGLIPKDELRVCLRSKKSLSQWLCETKTNMLAIIRKYQEELNLATAHEHKVADEYARVYAEKEARGRVIDSLHQEATMWMNRFALTLNESQELP

SEQ ID NO: 108397 - protein, 66 aa, Glycine max
  Coding DNA Sequence Number=SeqID_16712
MALYAYGREPKIPGPDWRGPTVGAAAFFSAQEEAGYGHGGGLAIEPTKRGQAAQWLFAANLNGMSQ

SEQ ID NO: 108398 - protein, 193 aa, Glycine max
  Coding DNA Sequence Number=SeqID_16713
  Gene Ontology: Mol. function=RNA-directed DNA polymerase activity
  Homolog annotation: Hit_ID=Q2HTU8; Match level="QueryCoverage=89%, HitCoverage=78%, E-value=4e-11, Identity=26%"; Hit description=H+ -transporting two-sector ATPase, alpha/beta subunit, central region, related
MGNFSQDNWRWDLQWRRNLFDHEHDLAVSFMEGITSICIQRNVKDIMMWKAEPNGVYSTKSAYSLMLKLNDSGSQDRQAPTKGNLLRRHVDIQDAGCPLCGQGQEEVGHLFFNCKRTINMWWESMGWIKAVGPLLASPLNHFVQFCVGFGTNTNQSRWSAWWVALTSIIWHHRNLLIFWWVALTSLGFFGGQH

SEQ ID NO: 108399 - protein, 40 aa, Glycine max
  Coding DNA Sequence Number=SeqID_16714
MKKKVRRKHNNGMSAHKYNFNKKQCALNAQVQAQRTWATG

SEQ ID NO: 108400 - protein, 68 aa, Glycine max
  Coding DNA Sequence Number=SeqID_16715
MAHLAGQFSLSAIPYRVGIALNAPFAFRETTKVVIIKIPTNSLETQANHHRGGGELPMHNRVTSTLAA

SEQ ID NO: 108401 - protein, 307 aa, Glycine max
  Coding DNA Sequence Number=SeqID_16716
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIELFLIDIGSCRVLVELVDNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 108402 - protein, 102 aa, Glycine max
  Coding DNA Sequence Number=SeqID_16717
MLLLIFSLVLQEYNKMKLCKVSYQNIKQEMKFGNQELLITKEFLFLQKPLLLEKAIQLLSCYQDRIKVFIPISKTFASQRRVFKAQSIKVSIQGKKQKKPLN

SEQ ID NO: 108403 - protein, 160 aa, Glycine max
  Coding DNA Sequence Number=SeqID_16718
  Homolog annotation: Hit_ID=A0ST23; Match level="QueryCoverage=15%, HitCoverage=51%, E-value=3e-07, Identity=100%"; Hit description =Putative reverse transcriptase
FHWWSREVFGDSVVPCSVFEVLLVVVLPISSEALRPIPEEVFLENTSGRTSSGMGLSNFRKKVSWKLLRHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 108404 - protein, 214 aa, Glycine max
  Coding DNA Sequence Number=SeqID_16719
  Gene Ontology: Mol. function=branched-chain-amino-acid transaminase activity; Cellular component=chloroplast; Biological process =branched chain family amino acid metabolic process
  Homolog annotation: Hit_ID=P0AB82; Match level="QueryCoverage=100%, HitCoverage=77%, E-value=1e-103, Identity=77%"; Hit description =Branched-chain-amino-acid aminotransferase
  Pfam annotation: Domain name=Aminotran_4; Domain location=12-214; Score=184.6; E_value=2.6e-52; Accession=PF01063.10; Description =Aminotransferase class IV
MSTKKADFIWFNGEMVKWEDAKVSVMSHALHYGTSVFEGVRCYDSHKGPVVFRHREHMQRLHDSAKIYRFPIKASVDELMEACREVIRVNKLKSAYIRPLAFVGDVGLGVNPPDGFTTDVIIAAFPWGAYLGAEALEQGINAMVSSWNRVAPNTLPTAAKAGGNYLSSLLVGSESRRRGYQEGIALDTQALPGITRDAIIKLAKDLGIEVREHV

SEQ ID NO: 108405 - protein, 223 aa, Glycine max
  Coding DNA Sequence Number=SeqID_16720
MPLSPVILVTLADNELISVASSFLSLGGAYLHRTAWLFRYGNETDAALHSPHRRLPAGLDLSSVATGPPLLNMFPYKPPRGRHIFQRLGPAQPTRLDDINCSPSMIGERVRFHVGPVLLKRQSSGVYQMLELVFKSQAFFGGVARGFPMEVGRSSREISQPSGVGLGGKFLIALEPPPKWALLAWRIGVGAGAWGASLWMGADALGCTGAELEESPTRAEKLE

SEQ ID NO: 108406 - protein, 256 aa, Glycine max
  Coding DNA Sequence Number=SeqID_16721
MAPRKLSTKRSRKDAVAEGTSAAPEFDSHRFRSAEHQQHFEAIKGWSFHRERRVQLRDDEYTDFKEEIARQRWTSLVTPMAKFDPDIVLEFYANAWPTEEGVRDMRSWVRGQWIPFDVDALSQLLGDPLVLEEGQECEYSQRRNWADGFDEEAIAQLLCIPGQDFARTASGRRVQIMRTNMTTLTQTWMTLLLSKILPSNHNSDLPLPKCMPPTRHPLDPDKSNRALGFLALITGLCQSFGVPVTPSKVIRLPITQ

SEQ ID NO: 108407 - protein, 87 aa, Glycine max
  Coding DNA Sequence Number=SeqID_16722
  Subcellular localization annotation: CTP_CleavageSite=44; ConfidenceScore=5.30e-01
TALSLPHVAFLSPSFSIEAPDKVSTFGAHFCSKSRKESIFGVVKCVATSGTSKFQLERIDGDPMLRETRIWATWEYVSSDGGGQQGM

SEQ ID NO: 108408 - protein, 61 aa, Glycine max
  Coding DNA Sequence Number=SeqID_16723
MTAYSGHQWSWVVENEVLGPLYTRARLAHLWSLSAVPSLVGIGLSAPLGAQRNSLSGWNCT

SEQ ID NO: 108409 - protein, 58 aa, Glycine max
  Coding DNA Sequence Number=SeqID_16724
MWHLPGVKNKSKPALLKEKLTKAPVLALPDFSKTFELELKNFIVPPSTTPPMIKSFMP

SEQ ID NO: 108410 - protein, 69 aa, Glycine max
  Coding DNA Sequence Number=SeqID_16725
MALPALSNWYFPDDSDCGLPDRLDRPAAQPARPDFDRFLIAGHPRALALSFAGWRVATLLFALLLDREE

SEQ ID NO: 108411 - protein, 72 aa, Glycine max
  Coding DNA Sequence Number=SeqID_16726
MQVSSLGRAELAWASNPCTKWVKRGKGEGDGLRPRVHSEIMGACHIAPIPLIFMLKHAPTKCSVKCLNGICA

SEQ ID NO: 108412 - protein, 73 aa, Glycine max
  Coding DNA Sequence Number=SeqID_16727
MGNEEGVQEQMKADMSALKDQMASMMEAMLKIQKSIEDNAIAAATNTTREAEPVLQPAMNSGRDRSATGFNRR

SEQ ID NO: 108413 - protein, 111 aa, Glycine max
  Coding DNA Sequence Number=SeqID_16728
MPYNRVMKISGSLITVNLECLSSSVNGLMEISEYIKTNWDLLSRLAKVQAGQVFYVQDPCDSRWSGVLQGRTISISDHIDGSLVDVSEMPTFYQQMPFINGEDQEDVVHEN

SEQ ID NO: 108414 - protein, 133 aa, Glycine max
  Coding DNA Sequence Number=SeqID_16729
MERYLQHFVRQKAANHSGQVQIHECLYRFSLSQQGQGSALFACPTLEQFGVEVAWPGDWLEVQAGEEPAGSPGEADESHMDEEMTDLLGFYRGSGAAQTGEEEPTGSPGEADESHMDEEMTDLLGFLGGSGAA

SEQ ID NO: 108415 - protein, 138 aa, Glycine max
  Coding DNA Sequence Number=SeqID_16730
  Homolog annotation: Hit_ID=Q6UUU1; Match level="QueryCoverage=43%, HitCoverage=40%, E-value=1e-18, Identity=78%"; Hit description =Putative uncharacterized protein
AFDDCIHVAEATTMDTFALDDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108416 - protein, 174 aa, Glycine max
  Coding DNA Sequence Number=SeqID_16731
  Gene Ontology: Mol. function=glutamate N-acetyltransferase activity; Cellular component=cytoplasm; Biological process=arginine biosynthetic process
  Homolog annotation: Hit_ID=A7PSR6; Match level="QueryCoverage=35%, HitCoverage=14%, E-value=2e-18, Identity=81%"; Hit description =Chromosome chr8 scaffold_29, whole genome shotgun sequence
LAYGADSAAVAITTTDLVSKSVAIESLVGGTKLKVGGMAKGSGMIHPNMATMLGGKPIMRIVASCLHWIQEHRVPTAAQVVEGSSMMDKRSSVTQDDFGRNISRDGGGDNIEVTFLSSTRAKGCDGNGLLVFHTTRSKGCDVDHDFKKYLIFIICMIPDKGFVGASKTWQQNSG

SEQ ID NO: 108417 - protein, 284 aa, Glycine max
  Coding DNA Sequence Number=SeqID_16732
  Homolog annotation: Hit_ID=A1G0X0; Match level="QueryCoverage=36%, HitCoverage=20%, E-value=9e-20, Identity=54%"; Hit description =Phospho-2-dehydro-3-deoxyheptonate aldolase
IRIDLAERAGGDADAAAIAELGATAGGDVDHRGGALAELCWQCPVHQPDALDRARIQGLAEAGDRFGQQHAVDAVLQIGVVAAHVHAAIGILDHARRLQQHLAERRGGAQRLLLDVLGGDLVLAAADVRRQCVAGLVELGADGDRVEVLHGSGGIGGHSEGRQAGQGQGEGDAVRGESCACPAGRGHAAFGRSRCPFPGVQSCADAVRPFAAAVGSATMNVSHLRKPAMSLSAVSPVPDPVAAATGAAWSPESWRGKTALQMPTYPDPVALDAALHELKRLPPL

SEQ ID NO: 108418 - protein, 73 aa, Glycine max
  Coding DNA Sequence Number=SeqID_16733
MENWQTALGNEFAGLQTRWLRMHERQSIHGALNKRCMNDNQFMGLRIKVENGELANSARQSIRGAPDSLVEDT

SEQ ID NO: 108419 - protein, 292 aa, Glycine max
  Coding DNA Sequence Number=SeqID_16734
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMSGGLRIYCLALPANLLPSAVRQFSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108420 - protein, 157 aa, Glycine max
  Coding DNA Sequence Number=SeqID_16735
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=5e-24, Identity=100%"; Hit description=LacZ protein
MAGTFIIIKATLDHGMSRFVLTVYRNAIAAIMLAPWCNPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 108421 - protein, 97 aa, Glycine max
  Coding DNA Sequence Number=SeqID_16736
IPTQGSKLEGGGHMNENTIDGSPKKGGGHMNETAIHGAPKKGENGELHEAITTIAPNSEGGGHMNENAIHGAPKRLRMENCTKQSLRMAPNSKVEDT

SEQ ID NO: 108422 - protein, 133 aa, Glycine max
  Coding DNA Sequence Number=SeqID_16737
MHRSPTGNLVPLDLEIEATLRRNRAERRRKLLQDRIVASILEEETHFSDSSSSDLPSSRESATYLPKSVSMADEHHQRVTLEDYSSSSVPQFFTSIACPEVQAHNINYPHSLIHLIQGNLFQGLPNEDPYAHL

SEQ ID NO: 108423 - protein, 69 aa, Glycine max
  Coding DNA Sequence Number=SeqID_16738
  Subcellular localization annotation: CTP_CleavageSite=34; ConfidenceScore=5.08e-01
LKEEGGSSSWCLSKRAICAYVLGNPRRGSVRDVRAQCVASLPSESFVPSRAQRTQLTKPDFTNSRLASF

SEQ ID NO: 108424 - protein, 172 aa, Glycine max
  Coding DNA Sequence Number=SeqID_16739
MASITEAMLKLQKTLEDNATATASNAVREAEPVLQPTINLGRNRNPTVFGRRYSPQAYPYGLPPDFTPRASPEDVSQAPTFEGKLPPYADYPLQEDDEEDTHLGPLLPLKDPSPHELPQPNIVRHVPSSPAPIKESVPFTEDKGKIDALEERLRAIEGLGNYPFSDLADLCL

SEQ ID NO: 108425 - protein, 444 aa, Glycine max
  Coding DNA Sequence Number=SeqID_16740
  Homolog annotation: Hit_ID=Q6WAY6; Match level="QueryCoverage=52%, HitCoverage=40%, E-value=4e-10, Identity=25%"; Hit description =Putative uncharacterized protein
MGTRGCINYNTVLSIRQLGYPMRGVPLEEGLTPFIAQGFNSTNVGVLRRVCKAWEMVQKKDEELWGSSNGPIGGYHKWLKAYAQGLGWLPNLRATKEVEVEAPEEGEEVQALRMKLEQAQAVKEKFKSAVARIRKENAELRDINIATTKALVQKTKRARKKEHGRNKFRGEERDQSRVDGMILKDELKTCLRSKRSLSQQLCETETNMLAIISKYKEELDLATAHEHKVADEYARVYAEKEARGRVIDSLQQEATMWMDWKDAITKPDPRHPYHTRSKSRMMGDLEEVQEQMKADMSVLKEQTTSMMEAMLGMKRLMESNAATATAASTVAEADPALPTVAHHPILNIVGQGRSTLGHVSNPHPGYNRGAYHYDLPPNYTPPTMHKDAGHVTPLILEGEPPRHPDRVHEDPREGAQGDVNSYSPFPVEGPAPNTLPQPNITGEP

SEQ ID NO: 108426 - protein, 146 aa, Glycine max
  Coding DNA Sequence Number=SeqID_16741
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=81%, HitCoverage=96%, E-value=5e-26, Identity=56%"; Hit description =Putative uncharacterized protein
  Subcellular localization annotation: CTP_CleavageSite=31; ConfidenceScore=5.13e-01
MTMITPSSKLTLTKGNKSWKGFCGIEPKLLLQNARSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASAD

SEQ ID NO: 108427 - protein, 209 aa, Glycine max
  Coding DNA Sequence Number=SeqID_16742
  Gene Ontology: Mol. function=DNA binding
  Homolog annotation: Hit_ID=A2QMJ6; Match level="QueryCoverage=100%, HitCoverage=30%, E-value=1e-19, Identity=31%"; Hit description =Contig An07c0050, complete genome
MGARKTQEELTDWRERTLYRSDWEEYGHEVYDIYEEISENRRKRRRLDNSRDPSPVPADDENNQADGYKVEPTAGEYDEDINPGADDHKDIEMDDATAPDQNTTIPQDEEDPEMNNTRITQTTNPKTNQKQTNESDSSSPTNTNLGYRSPILTRRKRIQPEPKQEEESSSSSSDDDLPATREYPSSEQDDGDGMPLYSQPMSPANWPSD

SEQ ID NO: 108428 - protein, 92 aa, Glycine max
  Coding DNA Sequence Number=SeqID_16743
MYERRKTPLSTTVATYPSAGGRRVTRGMRVPRKEYVRSRHQRLFEENVGKTGKDVIYELLSERFGSCIYARGRVFPFAPTYSSIWDEKIRPT

SEQ ID NO: 108429 - protein, 90 aa, Glycine max
  Coding DNA Sequence Number=SeqID_16744
MQGSRMSKHENKRDAYAMHDMNAFYGHESPKNYFFLLVHLGAQCPMCTIKKVIWTFRLPVTKDETNIQCMLEIKCGSDLIRTDFWSKNVG

SEQ ID NO: 108430 - protein, 79 aa, Glycine max
  Coding DNA Sequence Number=SeqID_16745
SIRSFNGDFPPWRCSGRQRRRGEWRHHALGNKPWKKELHHQECALNKKLEEDDLMEEKKDKRGEHEIEGIKEGEKWNFE

SEQ ID NO: 108431 - protein, 102 aa, Glycine max
  Coding DNA Sequence Number=SeqID_16746
MSNQKSTESAIKNLEVQVGQLAKQLADRPSSSFGANIEKNPKEECKAVMTRSKMVSMNEGEKRIGEEQLVTEPEIDLVMEPLSETEEEVKAEDDQQKKIPII

SEQ ID NO: 108432 - protein, 197 aa, Glycine max
  Coding DNA Sequence Number=SeqID_16747
MIPSVRGLGNLHTARSTRELELEGEKEKRPMLNHLRLAVIGMDKLYPTNNAVDVVEWGPNLHRSAWRGAFDRTLTLKDCCSLVDNSRELIDIVVDKYLLIDKRLEITYWGAQLLRARHSRPYTPQALSQLVSERVEGDELVKPPSMDKCCPMSVVYDGHVFGVSGKVMQSSKERDPSPEPWLGDSRKIGPAMQEKAL

SEQ ID NO: 108433 - protein, 196 aa, Glycine max
  Coding DNA Sequence Number=SeqID_16748
MSRGSGDLGDVRRAPGSQPIKEQSPQRKEACVAAGQLWILSGIWKFASSNRLPRIVMAAQLIHDRVVMECLEGVWETLEGNERCRFRVTIQLTATSLVHPEVPARTLQQPVEWILPTPTPYRLVEPVQVIEVSSSEEDPEEDLEELPAVDALNFPEDDEDPLPDVDSLEDIMSASEADSTEESSPGGTANSGDTSS

SEQ ID NO: 108434 - protein, 152 aa, Glycine max
  Coding DNA Sequence Number=SeqID_16749
MSSQGVVSDSLTFERLSPFLERVAWPGAQPSLHREGEGPTAQEPRQVHNASSGTTILEPFTFQQDAGEEHVRPETAATPERSFEGTSEPPTPIADLSSPQLAADPSTPVLDIPEDQTTPVLTLNTSPPATLVLHLTDEEYAHVEESFMMNQD

SEQ ID NO: 108435 - protein, 116 aa, Glycine max
  Coding DNA Sequence Number=SeqID_16750
  Homolog annotation: Hit_ID=UPI00006A2D9E; Match level="QueryCoverage =86%, HitCoverage=68%, E-value=5e-09, Identity=18%"; Hit description =UPI00006A2D9E related cluster
LHVLAFRGRHVLAFGGLHALAFRGAYALAFKRLHAFAFRGLHPLAFRGLHVLAFRGLHALAFRGLHALAFKRPHALTFRGAHTLVLRGLHVMRILKLAKYRLKAQVEKDEGPSGEG

SEQ ID NO: 108436 - protein, 164 aa, Glycine max
  Coding DNA Sequence Number=SeqID_16751
MSNHKSTESSLKNLEVQVGQLAKQIADKSSNSFVANTEKNPKGECKVVMTRSKRFVEVEIEDSVVSKKKAAGKKGIDKKKDDVKVREKKREKAVNEGAKVPYPVVPSKKEKDRHLARYFQETGNNHALRRSFTANATLLQVFKGYVNKETQVYSPGKHCCGRKL

SEQ ID NO: 108437 - protein, 223 aa, Glycine max
  Coding DNA Sequence Number=SeqID_16752
MEGETPEEDDEVQALKTELEKAQAVKEKFKSAAVRIRKENAELRDVNIATTKALEQETKRARKEEHDRNKFQGAQWGSNSELKLRREERDQSRVDDLILKDELRVCLRSKRSLSQRLCEAETNMLAIIGKYQEELNLAMAHEQKVADEYARVYAEKKARGRVIDSLHQEATMWMDWFALTLNGSQELPRLLAKAKAMVDTYSTLEEIHGLLRYYQHMIDLMPI

SEQ ID NO: 108438 - protein, 271 aa, Glycine max
  Coding DNA Sequence Number=SeqID_16753
  Gene Ontology: Mol. function=enoyl-[acyl-carrier-protein] reductase (NADH) activity; Cellular component=plasma membrane; Biological process=metabolic process
  Homolog annotation: Hit_ID=P0AEK5; Match level="QueryCoverage=44%, HitCoverage=45%, E-value=8e-58, Identity=94%"; Hit description=Enoyl- [acyl-carrier-protein] reductase [NADH]
VLQWLLFLSAVPPVQLLTGWCVTAKAPPDISAGKCSGHAARRVPFAIQAAQLLGRAIGAGLFAITPAGERGMCCKAIKLGNARVFPCDVAEDASIDTMFAELGKVWPKFDGFVHSIGFAPGDQLDGDYVNAVTREGFKIAHDISSYSFVAMAKACRSMLNPGSALLTLSYLGAERAIPNYNVMGLAKASLEANVRSSLSIPSTSRGGPVPAFVPFSEVGKPVVPAALMNRPTRGERRFAYWALAECILAYYVGTDEGVSEVLHVAGEKRLH

SEQ ID NO: 108439 - protein, 136 aa, Glycine max
  Coding DNA Sequence Number=SeqID_16754
  Homolog annotation: Hit_ID=Q6UUU1; Match level="QueryCoverage=44%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWA

SEQ ID NO: 108440 - protein, 52 aa, Glycine max
  Coding DNA Sequence Number=SeqID_16755
MEMQRKTKEKSLIALKVVGPFLLDSNSSRDGTNPPSNSLYGNPQTRKQRDKQ

SEQ ID NO: 108441 - protein, 69 aa, Glycine max
  Coding DNA Sequence Number=SeqID_16756
MPYINMRERRRVKNQPFMRYYSHEWLSEDSNRVPPHQDMELTCERVKCFKRFFLDVDVRRKVNIEFANF

SEQ ID NO: 108442 - protein, 178 aa, Glycine max
  Coding DNA Sequence Number=SeqID_16757
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=48%, HitCoverage=72%, E-value=5e-24, Identity=66%"; Hit description=LacZ protein
  Subcellular localization annotation: CTP_CleavageSite=51; ConfidenceScore=5.58e-01
MKHFTDTLISAQHSKPVYTPLAPNTAKPPSPRALADSLMQLARQVSPTGKRAVSATQLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 108443 - protein, 76 aa, Glycine max
  Coding DNA Sequence Number=SeqID_16758
  Gene Ontology: Mol. function=aspartic-type endopeptidase activity; Biological process=RNA-dependent DNA replication
  Homolog annotation: Hit_ID=Q6WAY3; Match level="QueryCoverage=76%, HitCoverage=2%, E-value=5e-09, Identity=48%"; Hit description =Gag/pol polyprotein
SDDESREGTNTGDPTVDFEQEASQTENEEDEDVGLPPELERITAQEDREMRPHQEETELVDLGTGSGKKEVKVGTG

SEQ ID NO: 108444 - protein, 108 aa, Glycine max
  Coding DNA Sequence Number=SeqID_16759
MSILTLGSKKKRRKISNQRKRERRFPIKGKKEARKFPIKEWEKEKRKERKFPTKEWEKVKREERKGKKAPDQGSKGNRRNMQKGNNLQSQVMTYLWFGIRMKHLPVRD

SEQ ID NO: 108445 - protein, 104 aa, Glycine max
  Coding DNA Sequence Number=SeqID_16760
NRPNSQKGPQWSRQPSQRALLRACEARLTGALSKGGKMRGVATNEDISTSHVDKSGAFAPTYPPSKRKSELREELATQLAQASKVASSRSNRLLEEETGRPKWA

SEQ ID NO: 108446 - protein, 45 aa, Glycine max
  Coding DNA Sequence Number=SeqID_16761
MVKVGTSYVPINVSFSPKVGPGLPGIKQGDNQEFIYSAESDLPSQ

SEQ ID NO: 108447 - protein, 120 aa, Glycine max
  Coding DNA Sequence Number=SeqID_16762
  Subcellular localization annotation: CTP_CleavageSite=77; ConfidenceScore=5.37e-01
RQKHRRTSALASVAVTLRVTTTPAALNAPLQGASHSPFRLRNCWEGRSGFPSHDVVKRRPVNCNTTHYRANWSSTAVAAALELVDPPGCRNSISRDLLSGNRLPEDVIDYQWPKMIYNSY

SEQ ID NO: 108448 - protein, 214 aa, Glycine max
  Coding DNA Sequence Number=SeqID_16763
MIMRGQDIYSSQDEATTSPSSSESQETKGEKSSEEIYPQEEGQPLVVKEKCKEVSVSTKSLAKKETHFTIKTNIKETFPLRQPPHFLFCKKTLASIATPRGLEFIPQVKKLLDEGIIRHQVPKIAGMMNVLNGATLFCKITRAPNIFMVCVHRDPLGSDQGLPMNPKRVKVILEWLTPPSVEERINEFQEPRDLTSNPFQGGGNDAILPSKGIG

SEQ ID NO: 108449 - protein, 140 aa, Glycine max
  Coding DNA Sequence Number=SeqID_16764
MSRNKEEEHLWPREYFSSHWKHRPFSLRIASSSSVRRLKGTVEELVHAGVGNNGGVVKDVDVGGCRELEDAPVVGIKPEMKQLKAMGAVCIAIPLDPHKWLKQIVSGGREGMQSKTIIDHFGASIGTKLMLVLPYKMMRW

SEQ ID NO: 108450 - protein, 127 aa, Glycine max
  Coding DNA Sequence Number=SeqID_16765
SEENEVNTMKEILDTYGKASGARKLFLALSKIEYGHVSTIGQLVICLRWGTIATYPLAGGRRETHRCIFQGRKMHGAATNVYLRKTSEKPKRCGLQTLIVKGSGVVFTHGEGISTLRVCHKGQQPLT

SEQ ID NO: 108451 - protein, 211 aa, Glycine max
  Coding DNA Sequence Number=SeqID_16766
  Gene Ontology: Cellular component=integral to membrane; Biological process=toxin biosynthetic process
  Homolog annotation: Hit_ID=Q5PCV2; Match level="QueryCoverage=34%, HitCoverage=32%, E-value=5e-30, Identity=90%"; Hit description=DedD protein
  Pfam annotation: Domain name=Colicin_V; Domain location=131-211; Score=-4.2; E_value=0.0015; Accession=PF02674.7; Description=Colicin V production protein
  Pfam annotation: Domain name=SPOR; Domain location=36-112; Score =43.5; E_value=7.3e-10; Accession=PF05036.4; Description=Sporulation related repeat
  Pfam module annotation: Pfam domain module=Colicin_V::SPOR; Domain location=131-211::36-112
  Subcellular localization annotation: CTP_CleavageSite=33; ConfidenceScore=5.05e-01
PKPVEKPQPQQVAQTPPPAKTQPQPQQQQAAIPAPTGKAYVVQLGALKNADKVNEIVGKLRSSGFKAWTSPSTPVQGKITRILVGPDASKDKLKGQLGELQQISGLSGVGTEIPTQTFSFSVRMRPEPDDRALIRGFVREALSLVTWGCAFFVASHYYTYLAVWFTGFEDELVRNGIAIAILFIATLIVGAIVNYVIGALVEKTGLSGTDR

SEQ ID NO: 108452 - protein, 134 aa, Glycine max
  Coding DNA Sequence Number=SeqID_16767
  Subcellular localization annotation: CTP_CleavageSite=58; ConfidenceScore=5.05e-01
MSYLAIITPIPLCLSASMPSTRHPLDPDKSNRALGFLALITGLCQSFGVPVTPSKVIRLPIIWAFIEKRSTTTSSGRSHWITGHEALSIALGSPAGSQPPWAEQFGAEVAWLRDWPKAQAGEEPAGSPGEAKEA

SEQ ID NO: 108453 - protein, 153 aa, Glycine max
  Coding DNA Sequence Number=SeqID_16768
  Pfam annotation: Domain name=Transposase_23; Domain location=51-121; Score=6.5; E_value=0.00023; Accession=PF03017.5; Description =TNP1ENSPM transposase
  Subcellular localization annotation: CTP_CleavageSite=34; ConfidenceScore=5.41e-01
MASFSQMQSQIQSQIQSQGLAPPPEHLVGPSSPRVSTKGSCVNPSGNNPETGDSDRCDLYIEADPARLVAMGRVYEGSIVVHNTPLLPDQVKVSVEEVTDADAPVPVPTDEVSLVGQTLHTFLAWPTHLVKSLSQQVAVFPAKPPPKPDSKVD

SEQ ID NO: 108454 - protein, 99 aa, Glycine max
  Coding DNA Sequence Number=SeqID_16769
MAGLSKKKKSTYIRISNPYGHTNCQSIRYFGKLLGDEDMTKSKGKVPLEGLGGPMIRARARKAKEALQQVLSILFEYKSKFQGEKSKVVSCIMTQMEED

SEQ ID NO: 108455 - protein, 96 aa, Glycine max
  Coding DNA Sequence Number=SeqID_16770
MITSKGTDSRSCYVESGHLLQQPSDKLLELIGPVLVSAELLSGFKWFPFYAWEMCRSKAFVFDDDRDDLMKMRFSSLIQDNDSRIQDTTSRRSLVF

SEQ ID NO: 108456 - protein, 43 aa, Glycine max
  Coding DNA Sequence Number=SeqID_16771
MALTFLGFWTAWESSLNVWSALGQQHFGRKEQAAFVVAEGWTI

SEQ ID NO: 108457 - protein, 148 aa, Glycine max
  Coding DNA Sequence Number=SeqID_16772
MMMEAMMSMRKMMEVNTATVVVASTTSEMDLIHLYSFNRVGHPVSDVVGQGGEAVENACGPHYVQPYPGYTTEGHAFPGAPMPNPPGGPQYQSPPRPLHFAIGGRPSIVLEKDRIEYMEERLRAIEGRGNYALLTWKNCAWYPTWLFL

SEQ ID NO: 108458 - protein, 224 aa, Glycine max
  Coding DNA Sequence Number=SeqID_16773
  Homolog annotation: Hit_ID=Q6WAY4; Match level="QueryCoverage=91%, HitCoverage=36%, E-value=3e-19, Identity=33%"; Hit description =Putative uncharacterized protein
MEQARSVPFVLMHSSANSSLKELGQLMGQLQRQAFRKTYGKIWDLAMMEVSTEAISSLAQYYDRSLRCFTFGDFQLSPMVEEFEEILECPLGGRRPYLFSGFYPSLARISKIVQISAQELDHGKQVRNGVVGILRKCLEEKARTLAGRGEWALFIDILALLIFGGVLFPNVDGLVDLAAIDAFLAYHDHKESPVVARLADLYDTFDRRCEKSSTRIVCCTPALY

SEQ ID NO: 108459 - protein, 175 aa, Glycine max
  Coding DNA Sequence Number=SeqID_16774
  Homolog annotation: Hit_ID=Q6UUU1; Match level="QueryCoverage=34%, HitCoverage=40%, E-value=1e-18, Identity=78%"; Hit description =Putative uncharacterized protein
MDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWA

SEQ ID NO: 108460 - protein, 124 aa, Glycine max
  Coding DNA Sequence Number=SeqID_16775
GEGRHKRIQEVSPLFFWKREKGDTKEFRQLVLRSFGKGRRETQKEFRRLVLVEFFLAKGEERHKRIQAVSPSFFWKREKRDTKRIQAVSPCRILFGKGRREKSDTKRIQAVSPCQILFGKGRRE

SEQ ID NO: 108461 - protein, 291 aa, Glycine max
  Coding DNA Sequence Number=SeqID_16776
  Homolog annotation: Hit_ID=UPI00005EFF03; Match level="QueryCoverage =30%, HitCoverage=17%, E-value=1e-28, Identity=70%"; Hit description =COG3497: Phage tail sheath protein FI
  Pfam annotation: Domain name=Phage_tube; Domain location=75-238; Score=-41.3; E_value=3.3e-05; Accession=PF04985.5; Description=Phage tail tube protein FII
ETVLLYVDRPLDLENIDDILGTINSYMRRLTKLKAIFGGRAWLDEELNTAETLAAGEVYIDYDFGPKSPTERITMRVRINNKYAVEELGTGAHEYTPPELSIVKTDLRTGAQDVPTPMDDGMEALTCQIKFYGIDADMLSRFGFVTGNRNRFAAYEGYLSNGGALGSIDEIEGFVSKITPDARDNQTLSEKATTVEIAINYYKQTLEGRELFEIDTERFIRRVNGVDQLRANTKEIKFYSPLTLEDGSQLTHVLMREPLVRDRIEFSRMKGNDLENEVAMIANLCNMNVAD

SEQ ID NO: 108462 - protein, 147 aa, Glycine max
  Coding DNA Sequence Number=SeqID_16777
  Subcellular localization annotation: CTP_CleavageSite=57; ConfidenceScore=5.49e-01
MVKVGTSYVPINVSFSPSWPRASACTRTGPGIFLRRKVSDITAVLPVQLLKRGGVIRSQFGTQAYRAGSISAGKSNHSHPPRLIALALQGCPFAIQAAQLSGKGPDRCQGLFAINESANAGERGMCCKFAIKLGNASRVYTGLLCWH

SEQ ID NO: 108463 - protein, 121 aa, Glycine max
  Coding DNA Sequence Number=SeqID_16778
  Homolog annotation: Hit_ID=UPI0000ECBAF8; Match level="QueryCoverage =35%, HitCoverage=50%, E-value=1e-17, Identity=100%"; Hit description= UPI0000ECBAF8 related cluster
  Subcellular localization annotation: CTP_CleavageSite=39; ConfidenceScore=5.82e-01
MATPLNSPPPPPKSTTFSSSTSKKRRKATQFRSLTTRLVGAKRPVVHVDPATGKSGRHRGGAPIRPIVSRITIHWPSFYNVVTGKTLALPNLIALQHIPLSPAGVIAKRPAPIALPNSCAA

SEQ ID NO: 108464 - protein, 113 aa, Glycine max
  Coding DNA Sequence Number=SeqID_16779
MEAMKEEMATMMEAMMSMKKIMEVLSVSGLHALTFRGLHALAFRGLHVLAFIGLHVLVFKGLYILAFRGLHVLAFRGLHILPFRGLHVITFRGLHALAFKGLHTLLVLSSTEL

SEQ ID NO: 108465 - protein, 179 aa, Glycine max
  Coding DNA Sequence Number=SeqID_16780
RYPVDPKKSNRVLGFPALITGLCQFYGVPVAPSKVMPSWHRDRARKTPSGPEEVPQGPRVSSSDYGPLSVLRSARRPQQGIVPARHPVDPEKSNMALGFPALVTGLYSPTGCPFPPTRSRHHDIGIALRKTPSGPEEVQQGPRVSSSDYGPLDRARKTPSGPGEVQHGPGISSSGYGPL

SEQ ID NO: 108466 - protein, 161 aa, Glycine max
  Coding DNA Sequence Number=SeqID_16781
  Pfam annotation: Domain name=zf-CCHC; Domain location=39-56; Score =22.6; E_value=0.00058; Accession=PF00098.14; Description=Zinc knuckle
KDQGQGILGVTPSKPKGDKGKTIENQAPKASMQEKTSSIKCFKCLGRGHITSQCPTTKTMIMRSQDIYSSQDEATTHLPLVKEVSVSSKRLAKKETHFTIKTNIKETFPLRQPPHFLFCKKTLASIATPLGLEFIPQVKKLLDEGLVRKILNPCALLVPKI

SEQ ID NO: 108467 - protein, 147 aa, Glycine max
  Coding DNA Sequence Number=SeqID_16782
  Subcellular localization annotation: CTP_CleavageSite=89; ConfidenceScore=5.25e-01
MVTKKVKKYEKMMTHLPSCKKLGQKMDRVTSLLRLLPNTFKTVDVLVTSSFTLTKMSWTMKEHTLRCPYRTRARARVMGEVMEVQKLMKADMEAMKEQMATMMKAMMDMKKIMEANAVAIAATSAVAKVNPMPPSGLNQMNHPTSAM

SEQ ID NO: 108468 - protein, 93 aa, Glycine max
  Coding DNA Sequence Number=SeqID_16783
MRKILYKYVILLDIWEFHGGAGNMEFFHMFVRVFTCKAMKLWKQMNQSSFKNIWDILIRVLDAQAFVGEIRMFKITNHKMLRMLRMLKRIKGL

SEQ ID NO: 108469 - protein, 141 aa, Glycine max
  Coding DNA Sequence Number=SeqID_16784
MHHQKRNTLEEASLLSSESETQHDHRSTLAPYGSHRTGGVAIYHNLPHDGMTKAKRISQSVRLLGRKRVESPPTFIQGKRIRTPLARDKGQQPLIKCAQLEARPGELNLSPKVISSPRRAGCLAMKPFHGPSEPDASMGEL

SEQ ID NO: 108470 - protein, 144 aa, Glycine max
  Coding DNA Sequence Number=SeqID_16785
  Homolog annotation: Hit_ID=Q6WAY6; Match level="QueryCoverage=98%, HitCoverage=25%, E-value=1e-13, Identity=30%"; Hit description =Putative uncharacterized protein
MDQVRRQAFNKAYGKIWYLAMIEVSIEAITSLTQYYDQSLSCFTFGDFQLAPTIEEFEGILGCPLGGRKPYLFAGFYPSMARIAKVVKISEQELDRVKQNRNGVIGIPRKCLEEKAEALENQGGWTSFIDILALLVFGTILFLN

SEQ ID NO: 108471 - protein, 84 aa, Glycine max
  Coding DNA Sequence Number=SeqID_16786
MEDRIATDQAPPLPGAKQAENVAAGQPSSSEQTLTHKEGGDMVNVPLKKMAGLRPMLYSEAMGHATLSPSSCNLCPNMRSPSAR

SEQ ID NO: 108472 - protein, 222 aa, Glycine max
  Coding DNA Sequence Number=SeqID_16787
  Homolog annotation: Hit_ID=A5BSR3; Match level="QueryCoverage=32%, HitCoverage=25%, E-value=8e-09, Identity=48%"; Hit description =Putative uncharacterized protein
MGPVLPDSQRPFFGAICKIIVLFLQDVRKKAQAIQKQNTAPHVFSRGGYDYLEQKLLAEKTKKKLEEAAQPGSVDGVIDPPSSVRRHVKWKMARTKKTGEMTTEAVKEIAEKIGSFVPHGRQDVLTAAIGRPEHPGRVRVAGAGVTIKQYFRSAPRMSHSSSSLPPEELQQLTQQIRDQLEESITEKVTRQLMASFILVQSQMQSQGLALPPEPLVGPSGPQ

SEQ ID NO: 108473 - protein, 53 aa, Glycine max
  Coding DNA Sequence Number=SeqID_16788
GVTNDHVCSGRRKGNGKIPPQANIKKVTKCFFCKKKRLMKKNCHRFQKWLEKK

SEQ ID NO: 108474 - protein, 274 aa, Glycine max
  Coding DNA Sequence Number=SeqID_16789
  Gene Ontology: Mol. function=transferase activity, transferring phosphorus-containing groups; Cellular component=cytoplasm; Biological process=phosphoenolpyruvate-dependent sugar phosphotransferase system
  Homolog annotation: Hit_ID=A4TMG9; Match level="QueryCoverage=75%, HitCoverage=36%, E-value=1e-86, Identity=83%"; Hit description =Phosphoenolpyruvate--protein phosphotransferase
  Pfam annotation: Domain name=PEP-utilisers_N; Domain location=65-190; Score=194.0; E_value=3.7e-55; Accession=PF05524.4; Description=PEP -utilising enzyme, N-terminal
  Pfam annotation: Domain name=PEP-utilizers; Domain location=208-274; Score=83.1; E_value=9e-22; Accession=PF00391.14; Description=PEP -utilising enzyme, mobile domain
  Pfam annotation: Domain name=PTS-HPr; Domain location=1-84; Score =126.3; E_value=9e-35; Accession=PF00381.10; Description=PTS HPr component phosphorylation site
  Pfam module annotation: Pfam domain module=PEP-utilisers_N::PEP -utilizers::PTS-HPr; Domain location=65-190::208-274::1-84
  Subcellular localization annotation: CTP_CleavageSite=64; ConfidenceScore=5.17e-01
MFQQEVTITAPNGLHTRPAAQFVKEAKGFASDITVTSNGKSASAKSLFKLQTLGLTQGTVVTISAEGILVSPGIAFGKALLLKEDDIVINRKKISADQVEQEVSRFLAGRAKASEQLEAIKTKAGETFGEEKEAIFEGHIMLLEDEELEQEIIALIKDDLASADAAAYTVIEGQAKALEELDDEYLKERAADVRDIGKRLLQNILGMPIVDLGSIQDEVILVATDLTPSETAQLNLDKVLGFITDLGGRTSHTSIMARSLELPAIVGTSDVTKQ

SEQ ID NO: 108475 - protein, 175 aa, Glycine max
  Coding DNA Sequence Number=SeqID_16790
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=3e-23, Identity=34%"; Hit description= UPI00006A17C9 related cluster
MRTRSPLKVRACNPLKARMYSPLEVRACSPLKVRACSPLLERTCSPLKVRTCSPLMARACSPLKVRTCGPLKVRACSPTKVRTCSPLKVRVTSTQGRASSPLKARTCSPLEVRACSPLMVRTCSPLKARTCSPLEVRACSPLMVRTWSPLKARTCSPLKVRACSPTLARTCSPLK

SEQ ID NO: 108476 - protein, 37 aa, Glycine max
  Coding DNA Sequence Number=SeqID_16791
MKDDFVGQRRMKDGFVGQKRDGSYSCGHEGCGDDGCG

SEQ ID NO: 108477 - protein, 149 aa, Glycine max
  Coding DNA Sequence Number=SeqID_16792
MATMMEAMMSMKKIMEANAITIAATSTVAKVNPMPPFGLNQMNNPNLDMTLEIPHHNLADFEPCLGYATEGQAVGGIPLQNPLEGPQYHPQLHLLHSTTSKNPHAMEEMGKLDHLEESLRAIEGGKDYAFANLEELFLVPDIITPPMFK

SEQ ID NO: 108478 - protein, 126 aa, Glycine max
  Coding DNA Sequence Number=SeqID_16793
SPHQLDLAPYALRSYSAQWNAPGILHDKHTLRSSRILGKMEVEETLQGLWLPLHYRVDMGASQHRTPELGWVLWFDVGMVYVDNWVVGKEMGCYWLSNDIVGMTKFSSFQTHFDPFADEDHIRKAG

SEQ ID NO: 108479 - protein, 233 aa, Glycine max
  Coding DNA Sequence Number=SeqID_16794
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGKDNIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108480 - protein, 90 aa, Glycine max
  Coding DNA Sequence Number=SeqID_16795
MTPTHDALLYYNGRWNMSRQRDFPSHFEYSEKVIEFEIIELKTDDDVLKVLVHSNYWKQFGLIEILTVFSKLVIKMEDDMSQSQHNSMQN

SEQ ID NO: 108481 - protein, 252 aa, Glycine max
  Coding DNA Sequence Number=SeqID_16796
  Gene Ontology: Mol. function=aspartic-type endopeptidase activity; Cellular component=small subunit processome; Biological process=DNA integration
  Homolog annotation: Hit_ID=A5ARL5; Match level="QueryCoverage=98%, HitCoverage=18%, E-value=3e-25, Identity=27%"; Hit description =Putative uncharacterized protein
  Pfam annotation: Domain name=zf-CCHC; Domain location=129-146; Score =12.0; E_value=0.023; Accession=PF00098.14; Description=Zinc knuckle
AQEIFANDIQSLFDATMKVTALKQTSHDMIAHVDKARTAVEELRKFLVADSLEEVNRKLDKFYMVLILRSLHSDFDHVRDQVLAGDQVPSMDSLITRLLHTPHLLKDENPADGGGRNSRGGRSGRGGRPHCTYCKRMGHTQENCYSLQGFPDKVAQVSRSEKAESRFSDEEYQEYLKLKSEKPSNQAQSSSVPCFSTACISQSIKGPSPWILDSANGSKVASQGSGQEHGTGRLIGEGHESRGLYYLESSPP

SEQ ID NO: 108482 - protein, 114 aa, Glycine max
  Coding DNA Sequence Number=SeqID_16797
MPNEARSSISLRPLRSARLPHSGATAAETIKVTLKVRPDQILSALPPRIPSSSTPVKKQPNQTDIRLIFQDSMERNMSADVGKNETRVQSNNLVTLPDGKTWHEDENAVFRCRA

SEQ ID NO: 108483 - protein, 242 aa, Glycine max
  Coding DNA Sequence Number=SeqID_16798
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
WELLRADQRLISPKVGPGLPGIKQGHQDLFILRSDLPSQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKTVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108484 - protein, 150 aa, Glycine max
  Coding DNA Sequence Number=SeqID_16799
  Homolog annotation: Hit_ID=A7PG34; Match level="QueryCoverage=100%, HitCoverage=29%, E-value=2e-58, Identity=66%"; Hit description =Chromosome chr6 scaffold_15, whole genome shotgun sequence
  Pfam annotation: Domain name=WD40; Domain location=40-76; Score=34.9; E_value=3e-07; Accession=PF00400.23; Description=WD domain, G-beta repeat
MWDMENGLSIASSRPLGCTIGCWAVEDLPHSFEFRATQNQNTEVRLWGHEGPITALALDLTRIYSGSWDTTVRVWDRHSMKCTAVLRHSDWVWALVPHDTTVASTSGSDVYDSGTLVTIVHNAHVGNTYALARSHTGDFLFTGGEDGAIH

SEQ ID NO: 108485 - protein, 167 aa, Glycine max
  Coding DNA Sequence Number=SeqID_16800
  Homolog annotation: Hit_ID=Q2HW90; Match level="QueryCoverage=92%, HitCoverage=28%, E-value=1e-17, Identity=35%"; Hit description =Putative uncharacterized protein
MANQEERVPFMDVLALLIFGVVLFPNVDGLVDLAAIDAFLAYHHSKEILVVAILADLLDTFDRKCEKSSARIICCLPTLSVWLVSHLFQQDIRHPCPLRSHRSCVEKRRVDWDQHLAGIGGRTINWFPRWKEGNEGVLFSCGDYPNIPLIGTRGCINYNPALSIRQL

SEQ ID NO: 108486 - protein, 111 aa, Glycine max
  Coding DNA Sequence Number=SeqID_16801
MWGTPFILEPNQTPTSKILTHHNPYPRKQKRKERKFPIKEWEKAEKKERKFPIKEWEKAKKEKKKVPNQRMGEEKEKEGKKAPDQGSEKQKKCAERSLDRTISEQYRIVTK

SEQ ID NO: 108487 - protein, 206 aa, Glycine max
  Coding DNA Sequence Number=SeqID_16802
MNENAIHGAPKQGREWRIALSNHYAWLQKSGWRMDERKRNSWGSEKGKEWRIELSINYAWLILVGGGCKNKNVIHGAPKKGREWRIALSNHYAWLQLVGGGFMNENAFHGATKKGREWRIALSNHYAWLQTRGCRMHERKRNSWGSENRGREWRIAISNHCVWLQTRGWRMHERKRNSWGSEKKLRMENCTKQSLRMARNSWVEDA

SEQ ID NO: 108488 - protein, 26 aa, Glycine max
  Coding DNA Sequence Number=SeqID_16803
MGTVANVLHMKVFPVPPDPYKKNMPP

SEQ ID NO: 108489 - protein, 118 aa, Glycine max
  Coding DNA Sequence Number=SeqID_16804
MAAQLIHDRVVMECPEVHPEQPARTLQQPVEWILPTPTPYRLVEPVQVIEVSSSKEDLEEYPEELPPEPTMDALDLPEDDEDPLPDVDSLEDIVSASEADSTKESGPGGTAISDDSSS

SEQ ID NO: 108490 - protein, 145 aa, Glycine max
  Coding DNA Sequence Number=SeqID_16805
MQKALRSNATLPYPHLITLFLHHFDVPLDSETFVQVKRSFSIGAGVVTSFGYHKERDGSWVKKDVPTQAAEDRSPSPPPQRDDSSSLMQSVLDRLDGLYTYVCERFDSLERCIDTRFADMDTHIDRLEEDVSFIRQCFDLLPPPS

SEQ ID NO: 108491 - protein, 91 aa, Glycine max
  Coding DNA Sequence Number=SeqID_16806
MVAVGDGEKAWHVGNGFGRKKGEEMTFFQSYLDYKTQNAQVSNALGNGNVTHTPDIFLEIPTVISWKSVLGSCKPNFKKIQRLMKAGKRFY

SEQ ID NO: 108492 - protein, 130 aa, Glycine max
  Coding DNA Sequence Number=SeqID_16807
VVPLDVDFLESECTNHVSGSTYTSDLLYEVQAEEPSSSSPTLVPPTVQPPPTPELKPLPVNLKYAYLEDKEKFLVIIVATYPSAGGRRWAHRCVFQERKMRGVATNVYLRKTSEKPERVFSLLLRIPQLQ

SEQ ID NO: 108493 - protein, 132 aa, Glycine max
  Coding DNA Sequence Number=SeqID_16808
  Gene Ontology: Mol. function=catalytic activity; Biological process =cellular metabolic process
  Homolog annotation: Hit_ID=A7Q5D6; Match level="QueryCoverage=67%, HitCoverage=56%, E-value=9e-25, Identity=65%"; Hit description =Chromosome undetermined scaffold_53, whole genome shotgun sequence
  Pfam annotation: Domain name=RNA_pol_III_C17; Domain location=43-122; Score=28.4; E_value=2.3e-07; Accession=PF09417.1; Description=RNA polymerase III subunit C17
MKLLIFLDVKNHKPKEGKETLSCFVTAFSHTRCLIDENLCHSLEGNAGALTNFEVLHFLRAKGASKDPTRVNAKVAQFEYKVYDYLVDTAASIQTRESINELLTSVKQHDLAKTEVLNILNIGLAADFELYP

SEQ ID NO: 108494 - protein, 98 aa, Glycine max
  Coding DNA Sequence Number=SeqID_16809
MDTIALSSRCGSKLAYDTGIWGESYRLFAAKFISWLVFFGMAFVDNWAVGKEVCYWLSNDIVGFGGKLGRIGMAVTAWVSPSFSPSSFAPVFSVVLVG

SEQ ID NO: 108495 - protein, 39 aa, Glycine max
  Coding DNA Sequence Number=SeqID_16810
MHHLIHRHQGESTTDLPEASVMAEEHQHRGNPWKITPNK

SEQ ID NO: 108496 - protein, 75 aa, Glycine max
  Coding DNA Sequence Number=SeqID_16811
MSHAVKDNRGKWAPNYEGPFVVKRAFSGGALGQDHLELPSGVGTKRGQQKPIKVLRNGCKWGWGHDRLIVALSLR

SEQ ID NO: 108497 - protein, 187 aa, Glycine max
  Coding DNA Sequence Number=SeqID_16812
  Gene Ontology: Mol. function=motor activity; Cellular component=cell projection
  Homolog annotation: Hit_ID=UPI00016621D1; Match level="QueryCoverage =74%, HitCoverage=40%, E-value=4e-19, Identity=45%"; Hit description =UPI00016621D1 related cluster
  Subcellular localization annotation: CTP_CleavageSite=61; ConfidenceScore=5.01e-01
GLHVLTFRGLHVLTFSGLHVLAFRGRHVLTFRGPHVLTFRGLHALAFRGLHVLTFRGLHVLAFRGLHVLAFRGLHVLTFRGLHVLTFRGLHVLTFRGLHVLTFSGLHVLAFRGRHALTFRGPHVLTFRGLHALAFRGLHVLTFRGLHGCDPRLTTSRYLAPIVRQFVKFRDMSEVKRKHCCTTREVP

SEQ ID NO: 108498 - protein, 128 aa, Glycine max
  Coding DNA Sequence Number=SeqID_16813
MLVVGCGGGDEGDVIGSDATVTLVGGGGGGGVGGNNDGVMLVVVVTIFVVVVVAASYDNDNDSIGGSGDNDEGGIGGSGDGDAMLVMVLKYDFILRGIPFSRTYVDPMGWSILARLGNPSAPLAISSW

SEQ ID NO: 108499 - protein, 68 aa, Glycine max
  Coding DNA Sequence Number=SeqID_16814
MGTTKGTYNELKSSISGTYRLKTEERTTNDEERLKIFAKSPMETLRKRYGSTSAWIFFTETIFLTNFK

SEQ ID NO: 108500 - protein, 135 aa, Glycine max
  Coding DNA Sequence Number=SeqID_16815
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
MECSGMEWKGMERKGIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 108501 - protein, 47 aa, Glycine max
  Coding DNA Sequence Number=SeqID_16816
MEVGSWKLEVGSWNENYWKLKVENGGWKLEVGRGSGCHHQKGGECKS

SEQ ID NO: 108502 - protein, 189 aa, Glycine max
  Coding DNA Sequence Number=SeqID_16817
  Pfam annotation: Domain name=DUF1723; Domain location=90-141; Score =11.4; E_value=0.024; Accession=PF08330.1; Description=Protein of unknown function (DUF1723)
VLVTEANGASVEVDVYADKPMAGGDVRDTRADTPANTDAQAVEDEPKGFPGDPSDPSVLTEYADHVAGSVWTGEERPELKLSSHGRKVHSLGRPVPAIEGLRWHRETSSFHLPMREVTITLDDAVQMLVELLMVTAEAARAETGQCRGPYVRLQWIRDIYQRRCQARHWTAAARTPFVTSVRLGGTPGE

SEQ ID NO: 108503 - protein, 127 aa, Glycine max
  Coding DNA Sequence Number=SeqID_16818
MAPRKLASKRSRKDKAAEGTSSAPEYDSHRFRSAEHQQRFEAIKGWSFLRERRVQLRDDEYTDFQEEIVRRRWASLVTPMAKFDPDIVLEFYANAWPTVEGVRDMRSWVRVLEEGQKCEYGPEEEPG

SEQ ID NO: 108504 - protein, 227 aa, Glycine max
  Coding DNA Sequence Number=SeqID_16819
  Homolog annotation: Hit_ID=Q6WAY4; Match level="QueryCoverage=91%, HitCoverage=36%, E-value=2e-25, Identity=36%"; Hit description =Putative uncharacterized protein
MGTNQTGKRFYQVKIKGLDVTSLKELGRLMRSLQMQAFRKAYGKILDLTIAEIFTEAIVSLTQYYDQPLRCFTFGDFQLVPTVEEFEEILGCPLGGRKPYLFSGFLPSLSKIAIVVGDSARELDRVKQTRNGVVGLPWKYLEGKARDMANQEEWVPFMDVLALPIFGVVLFPNMDGLVDQAAINAFLAYHHSKESPVVAILADLFDTFDRKCEKSSARIICCSPALC

SEQ ID NO: 108505 - protein, 195 aa, Glycine max
  Coding DNA Sequence Number=SeqID_16820
  Homolog annotation: Hit_ID=UPI00006A2939; Match level="QueryCoverage =76%, HitCoverage=72%, E-value=1e-07, Identity=28%"; Hit description =UPI00006A2939 related cluster
MTDPLNESISSFLIRVDPWVHAPPSEGYTPLPSEGYMPSASEDYTSSPSEDYTSSPLEGCMPSPLEGYMSSPLEHCMPSPSEDYIGLHILAIIGLHALTFRGLHVLAFRGLHALAFRGLHILTVIGLHDLTFRRLHALTFKRLHVLTFRWLHALAVIGLHTRTFRGLHALTFRGLHVLAIRGLHALAFRGLHALA

SEQ ID NO: 108506 - protein, 249 aa, Glycine max
  Coding DNA Sequence Number=SeqID_16821
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFEHWLKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108507 - protein, 89 aa, Glycine max
  Coding DNA Sequence Number=SeqID_16822
MRDQLVPAIVIGPGASGLTKGMQKTTDIKGKFKRITLGYLCMSHDSSVSMTRNCLPEDDVNLRVSRACARLTKGAEKDVSLCVLSCFES

SEQ ID NO: 108508 - protein, 283 aa, Glycine max
  Coding DNA Sequence Number=SeqID_16823
  Homolog annotation: Hit_ID=Q6WAY6; Match level="QueryCoverage=30%, HitCoverage=14%, E-value=6e-08, Identity=37%"; Hit description =Putative uncharacterized protein
LKELGRLMGPLQRQAFLKVYRKILDLTAAKVFTEAVVSLAQYYDQPLSKIAAVVGDSAKEMDRMKQTRNDVVGLPRKYLEGKARDMASQEKWDPFADILALLIFGVILFPNVDGLVDLAAIDAFLAYHHSKESPVVAILADLFDTFDRRGYINYNPALAIRQLGYPMRGAPTEESLSPFLVRDFGAPSLKVIQRVHKVWRSLLRKDKELRGIRNGVIGGYHGWLRVHTRGLDWLSKMKFINEENFEALEEDEEVQALKLELGKARLTEEKFKLAATNIRKECT

SEQ ID NO: 108509 - protein, 92 aa, Glycine max
  Coding DNA Sequence Number=SeqID_16824
MENWRTALRNNFAGLQTRWWRMHEQRQAMTFMGLRKKVENGELTRWWRMHEQRQAMTFMGLRKKVENGEWRTALRNNFAGLQTRWWRMHEQR

SEQ ID NO: 108510 - protein, 126 aa, Glycine max
  Coding DNA Sequence Number=SeqID_16825
MSEIEEVQEQMKADMEAMKDQMTTMMEAMMSMRKMMEVNTAAVAATSAATKGGKALGSTDGPHFVQVQSKHPLPPYGLPSNYTLPNVEHAPDENVHNSTPIPIEIQQPQFGHAHVPQPIGETHEVP

SEQ ID NO: 108511 - protein, 520 aa, Glycine max
  Coding DNA Sequence Number=SeqID_16826
  Gene Ontology: Mol. function=DNA-(apurinic or apyrimidinic site) lyase activity; Cellular component=intracellular; Biological process= response to DNA damage stimulus
  Homolog annotation: Hit_ID=P45951; Match level="QueryCoverage=90%, HitCoverage=84%, E-value=1e-140, Identity=55%"; Hit description =Apurinic endonuclease-redox protein (DNA-(apurinic or apyrimidinic site) lyase)
  Pfam annotation: Domain name=Exo_endo_phos; Domain location=247-518; Score=159.4; E_value=9.7e-45; Accession=PF03372.14; Description =EndonucleaseExonucleasephosphatase family
  Pfam annotation: Domain name=SAP; Domain location=62-96; Score=30.6; E_value=5.7e-06; Accession=PF02037.18; Description=SAP domain
  Pfam module annotation: Pfam domain module=Exo_endo_phos::SAP; Domain location=247-518::62-96
MGSKRPFSNSSKPLSPFVEDTKNVKLKGLEASPGSKKLVVEENDVNSYSIEIQRLRNDPTIVDTMTVHELRKTLKRFKVPAKGRKDDLLSALKSFMDNNMCEQDSHLQEKQGLLISSENASVEVKAKTVLDEDHIENVNETPEISELNQGKRRLNQSESERKTIKVTTKKKVSLKSDEDSDFKPSRAKKKVSSDFASIVVQSEEISTATIQTEPWTVLAHKKPQKGWIAYNPRTMRPPSLAQDTKFVKLLSWNVNGLRALLKLEGFSALQLAQREDFDVLCLQETKLQRIAKNVYLKIVKDVNHEKLFLTAIVAAFYYLSTMMKMFLVCMKIHGAHVLIKPLSVRYGLGIPDHDSEGRLVTAEFDTFYLICGYVPNSGDGLKRLSYRVTEWDPSLSNYLKELEKSKPVILTGDLNCAHEEIDIYNPAGNKRSAGFTDEERKSFAKNFLSRGFVDTFRRQHPGVIGYTYWGYRHGGRKFNRGWRLDYFLVSESIADKVHDSYILPDVTGSDHCPIGLVVKL

SEQ ID NO: 108512 - protein, 103 aa, Glycine max
  Coding DNA Sequence Number=SeqID_16827
KRSFSIGENVVSSFGYRKERDVSWVKKDASVQVVEDRSPSPPPHNILDRLDGLHTFVCECFDSLDSRIDVMDAWFAGMDTRITKLEEDVSYVRQCFDLPPPSS

SEQ ID NO: 108513 - protein, 110 aa, Glycine max
  Coding DNA Sequence Number=SeqID_16828
MVKVGTSYVPINVSFSPKVGPGLPGINRDTQDLFILRSDLPSPAVPPVQLLTGVVRNGKSTAGHQRWQAAQLLGRAIGAGLFAITPAGERGMCCKAIKLGNARVFPVTTL

SEQ ID NO: 108514 - protein, 132 aa, Glycine max
  Coding DNA Sequence Number=SeqID_16829
MVAWPGTQPSLHREDEGPIAQVPQHVEDESSEDTIPEPFDIGEEANETQVRQVATATPKRSLEATSEPFAPMVNLPSPQPAADPSTPLLQMPEDPTTPILAMDTSPPTTPVLQLTDEENGQTQDTQDQSQEF

SEQ ID NO: 108515 - protein, 134 aa, Glycine max
  Coding DNA Sequence Number=SeqID_16830
MAKFDPDIVLEFYANAWSTEEGVRDMRSWVRGQWIPFDVDALSQFLGDPLVLEEGQECEFSMPPTRHPLDPDKSKRALGFPALITGLCQSFGVPVTPSKVIRPPITRAFIEKYCMPRQAQGDAPQAADAPTPPH

SEQ ID NO: 108516 - protein, 53 aa, Glycine max
  Coding DNA Sequence Number=SeqID_16831
MTMTQDHEKLDSDLIATCVVDPMTWKQISGTTAHHATLLTTQMGGNNDITVVV

SEQ ID NO: 108517 - protein, 244 aa, Glycine max
  Coding DNA Sequence Number=SeqID_16832
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q6EM64; Match level="QueryCoverage=56%, HitCoverage=34%, E-value=9e-71, Identity=96%"; Hit description=NADH dehydrogenase subunit B
  Pfam annotation: Domain name=Oxidored_q1; Domain location=23-194; Score=-26.9; E_value=8.9e-06; Accession=PF00361.11; Description=NADH- Ubiquinoneplastoquinone (complex I)
MAITEFLLFILTATLGGMFLCGANDLITIFVALECFSLCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGVRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASAD

SEQ ID NO: 108518 - protein, 104 aa, Glycine max
  Coding DNA Sequence Number=SeqID_16833
  Subcellular localization annotation: CTP_CleavageSite=76; ConfidenceScore=5.07e-01
MSACGVALEPSLVVSFLDLFAGSFIRAISGSFNPDSARILKEGTSTSNGSTTSIPYTNKNGVAPIDVRTEVGGIVRDNLPGQPIPADYLLLDESNHHAPRHIVV

SEQ ID NO: 108519 - protein, 120 aa, Glycine max
  Coding DNA Sequence Number=SeqID_16834
AQLPTNVSNLHGDDDDDDYLVSNSYVEESLDEDDSVDDISDTDDEVADMIQPVRIVHLAEGVQGIENPFWNDALHYNNINWSHPDEEDICGLEMPSSFNVGKELYVGMDFDTKDAIKKMH

SEQ ID NO: 108520 - protein, 98 aa, Glycine max
  Coding DNA Sequence Number=SeqID_16835
  Subcellular localization annotation: CTP_CleavageSite=52; ConfidenceScore=5.26e-01
MTCLPEFHKSPNDGCSTSQGPKKGLLSSSKGPRETKKGMTPNFAPLALTRVRGDHEISASRMLYNHFGYFRLSSGPPPLDDKKGANNHKVSPRIMGAE

SEQ ID NO: 108521 - protein, 93 aa, Glycine max
  Coding DNA Sequence Number=SeqID_16836
  Subcellular localization annotation: CTP_CleavageSite=75; ConfidenceScore=5.03e-01
MMAHQLSYPNFVRGPLFGGTQPLLDRFKESTQKAKWGVFSKKRCANSNQAHLGLLGGSNRWRCLLVEATQLAWVSWATTTSLFFPINRGKWAE

SEQ ID NO: 108522 - protein, 74 aa, Glycine max
  Coding DNA Sequence Number=SeqID_16837
MIMLPRGNSTQWSMSEYNYYTIVDYGFNDNHGSKSKAIVRWIPVKCNKKKGSTEFDYYALHWMSTIVLGGFKDN

SEQ ID NO: 108523 - protein, 137 aa, Glycine max
  Coding DNA Sequence Number=SeqID_16838
MSVKQFIEKVAWPGARPSFVGDNEIFTAQAPQQHEPEPENDHSSEATIPGAVDFAKIRLEMRSNEAAHPGPVPALADAPFPGVDPSSAQHAADSSTPVLEIHEGQTIPVLTLDTSPPATSVWHLTDEEDVKIQDNQD

SEQ ID NO: 108524 - protein, 118 aa, Glycine max
  Coding DNA Sequence Number=SeqID_16839
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=44%, HitCoverage=50%, E-value=4e-24, Identity=100%"; Hit description=LacZ protein
MGGCVEVGCDGHGGLGERHLGPGDPLVLERPPPRWSSNSPYSESYYNSLAVVLQRRDWENPGVTQLNRLAAHPPFASWRNSEEARTDRPSQQLRSLNGEWDAPCSGALSAAVWWLRAA

SEQ ID NO: 108525 - protein, 151 aa, Glycine max
  Coding DNA Sequence Number=SeqID_16840
AHREAHDRNKFRGALWGSNSELKIQRKERDQSQVDSLILKYELKVCSRSKRNLSQRLCETKTNMLAIISKYQEELNLATAHEHRVADEYAHMYAEKEARGRVIDSLHQEATMWMEAMKEKMTTRMEAMVSMKKINGGQRFGKYERPHDVQI

SEQ ID NO: 108526 - protein, 278 aa, Glycine max
  Coding DNA Sequence Number=SeqID_16841
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRLTGLIVAEDLKQLIKKMKLEGTRYPPLDSGLPPLLGVVTRHPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108527 - protein, 26 aa, Glycine max
  Coding DNA Sequence Number=SeqID_16842
KLNSCSSLPIQQQLSSGSTHEPADCT

SEQ ID NO: 108528 - protein, 236 aa, Glycine max
  Coding DNA Sequence Number=SeqID_16843
  Homolog annotation: Hit_ID=Q2HW90; Match level="QueryCoverage=77%, HitCoverage=39%, E-value=1e-22, Identity=38%"; Hit description =Putative uncharacterized protein
MARIEKVIKISKQDLDRLKQNRNRVVGIPRKRLEAKAKALANQGEWTSFIDILALLVFGTILFPNLDGLVDLAAIDAFLAYHHSKQSPVIVVLADAYDTFDLRCEKSSARIVYCTPALYVWLVSHVFLHAGMVGLSISWFPRLKEGGAGVLCSCEGFPNVPMMGTRGCINYNPMLAIRQLGYPMRDAPSEEIITPFVARGFNEANAKIIQRILRVWNTVERKDKELRGNSKGVINC

SEQ ID NO: 108529 - protein, 42 aa, Glycine max
  Coding DNA Sequence Number=SeqID_16844
MVFLVKGGCFMVIVVEVVVVVVDTTVVEMIIVFVETVVVVEE

SEQ ID NO: 108530 - protein, 133 aa, Glycine max
  Coding DNA Sequence Number=SeqID_16845
MLMWNEQYSHAGPIQLLYIINRTPGGILNLLRSTITPTHDAMLYYNSKSWVGKSRLLNVTYKWCNLKNKSQTRTRVDWDFLGESVYIGKNPGMESAQQKEGDDGMDIKKGRMEWRKRKEAFQGEVTSYHFSNI

SEQ ID NO: 108531 - protein, 71 aa, Glycine max
  Coding DNA Sequence Number=SeqID_16846
MTVKKRLSHEVLKRASTAKRSFSVLSATEESGRASISWPRAKREISALSVTVVFSQAQRTTGAKLKSTYSR

SEQ ID NO: 108532 - protein, 75 aa, Glycine max
  Coding DNA Sequence Number=SeqID_16847
MPFWWASEARLTGALSKGGKMCGVATNVYLWKTSEKPKETDQNENSKFGSCRQKQGLLLLRTLHRRGNQTYVVLS

SEQ ID NO: 108533 - protein, 110 aa, Glycine max
  Coding DNA Sequence Number=SeqID_16848
MTRGNPSDLQPFDPEIDRTFHRLVRHHFIPFDHSEHSITGESVHSVIGDLEHPDLEHYNFEHSDSEHSDFAHSENMAQPPPRERTLREMAAPDFTYESLCIQYPDEDVPY

SEQ ID NO: 108534 - protein, 75 aa, Glycine max
  Coding DNA Sequence Number=SeqID_16849
LHPLESRMPAEMELGANLYFPGACLAPTSKSNAGAEKEPAQPLPESFACASESADEPHAGKLARVVLAGDPGILY

SEQ ID NO: 108535 - protein, 136 aa, Glycine max
  Coding DNA Sequence Number=SeqID_16850
MARIAKVVKISVQELDRVKQNRNGVVGIPRRYLEEKAKALADQGEWVSFIDVLALLILGVILFQNVDGLGNLVAIDAFLAYHHSKESLVVAILADACDTFGRRCKKSSGHPLIGSPDGRKEEPRFYPYVRGSQTSP

SEQ ID NO: 108536 - protein, 110 aa, Glycine max
  Coding DNA Sequence Number=SeqID_16851
  Homolog annotation: Hit_ID=A7QL08; Match level="QueryCoverage=33%, HitCoverage=50%, E-value=2e-10, Identity=91%"; Hit description =Chromosome undetermined scaffold_116, whole genome shotgun sequence
MVGAGLKKDLRVSRVVPGGSLNAFLFLLIGVISQRLAMESIDSLPIGWTVGAMIYFTGEVSVGRAPLLQLGRCDYGNGKEDRNMPLKDSTETKTGCQERRGGRMGQLGQI

SEQ ID NO: 108537 - protein, 148 aa, Glycine max
  Coding DNA Sequence Number=SeqID_16852
  Gene Ontology: Biological process=transposition, DNA-mediated
  Homolog annotation: Hit_ID=Q1J7G7; Match level="QueryCoverage=25%, HitCoverage=67%, E-value=7e-11, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPDYKASPSEGYTSSPKEDYTSSPLESYMPLAFRGLHVLAFRGLHVLTFRGLHILPFRGLHALTIR

SEQ ID NO: 108538 - protein, 72 aa, Glycine max
  Coding DNA Sequence Number=SeqID_16853
MRDDKRSSYVIGSGVNYGIGLRGKFLIALETTPKWALPVGQVMVGAGAWGASLWMGAGALGRTGAELEEFLA

SEQ ID NO: 108539 - protein, 48 aa, Glycine max
  Coding DNA Sequence Number=SeqID_16854
MSVEIKSESTDNSVKVNGHRLKPFLTNPSLVDVVVEETSLLHLTFLQP

SEQ ID NO: 108540 - protein, 129 aa, Glycine max
  Coding DNA Sequence Number=SeqID_16855
QSRVNEQPKAYAANIYNRPPQQQNQQQQNNYDLSRNRYNPGWRNHPNLRWASPPQQQQHVPHFQNAVGPSKPYVQQSQQRQQATEAPPQPSLVELVRQMTIQNMQFQQETRASIQSLTNQMGQMDTQLN

SEQ ID NO: 108541 - protein, 149 aa, Glycine max
  Coding DNA Sequence Number=SeqID_16856
MVISHPFCHPEGGGPDDKQRPKFGHSAPMIRGDTLWLFAPFVIQRQAGPMTSRDQVWSFCTHPKAAGLMIRGDTLRLFAPFCHPEAAGPMTSRDQVWSFCTLVSSRGGGPDDTRRYLMVIRTLLSSRGGGPDDKQRPSLVILHPHPRAR

SEQ ID NO: 108542 - protein, 157 aa, Glycine max
  Coding DNA Sequence Number=SeqID_16857
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=5e-24, Identity=100%"; Hit description=LacZ protein
  Subcellular localization annotation: CTP_CleavageSite=51; ConfidenceScore=5.06e-01
MTLGLITYCDHKTNDHKMQHLINTPSKKSHVAPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 108543 - protein, 87 aa, Glycine max
  Coding DNA Sequence Number=SeqID_16858
MYKDNWTQPWPMGSEIYPKVHENPRAFFSSSSSIFLEPLAHGSSDWSLPREDCITIGLGSWKKLIMKIEMSFCPHNIIQFQCFEDFL

SEQ ID NO: 108544 - protein, 56 aa, Glycine max
  Coding DNA Sequence Number=SeqID_16859
MGLRSRIVLGDGQIPGQIQRRRQIEGWTRVEARPMIDGSSSHAQIRTSGKCSWEAA

SEQ ID NO: 108545 - protein, 64 aa, Glycine max
  Coding DNA Sequence Number=SeqID_16860
FAKRNLQWLRTRKNPEEDELSSSLSAPLQICAKCTSMNKATYLSMKSDLQRDFGTFLEKIYMQE

SEQ ID NO: 108546 - protein, 351 aa, Glycine max
  Coding DNA Sequence Number=SeqID_16861
MTMITNSSSVLMSCRTGVQSNYLGLVGYQPNLVSRQFGLSQIRPKSLFEDPQDVIRGANLSEKTFKKFLKISLDENYNLHPFEFNHSHFCTMGFVTWWERYYSTRSVGDTTNMISRLESGFVQPTVENIRSSLQARGKAPMTKRSAETPRADMRPKKPTGVKSKKGNKKRRVKRKMIALRLPRPQNARSVWSSNSTKKKMQEEEERPLIRKRKSPETSTKPADQTEAGNSQAQMPKKKKKVKQVEPEPSVTVEGGEPARKKKKKTKPSKEQGENQPVDVQPPSTDVDGTEVETTPSIAEMGNPVEQPDLPQEQPTVEVQQNVSVEEIPSCARTSPAPETDAVNVEEQGEGQ

SEQ ID NO: 108547 - protein, 118 aa, Glycine max
  Coding DNA Sequence Number=SeqID_16862
  Homolog annotation: Hit_ID=Q2HU84; Match level="QueryCoverage=43%, HitCoverage=23%, E-value=2e-10, Identity=66%"; Hit description =Probable retroelement pol polyprotein-, putative
MWTTTGEMLAAQLAQASQELSIGAAQRQTPAPLTALNAQARPNSNDKSRHGQNPAQSTQRTGTRKPFLGCCQWCNIKGHVLSQCKTFQQQHPSVPPPPRNSLAHTGQVQVNTATAGPS

SEQ ID NO: 108548 - protein, 152 aa, Glycine max
  Coding DNA Sequence Number=SeqID_16863
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MSSRRSRQHSGSTRISDDQIIELVSKLRQLVPEIRNRRSDKRPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 108549 - protein, 140 aa, Glycine max
  Coding DNA Sequence Number=SeqID_16864
  Homolog annotation: Hit_ID=O52175; Match level="QueryCoverage=58%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQNHHWQQPLVIDLEELVLKSCAG

SEQ ID NO: 108550 - protein, 191 aa, Glycine max
  Coding DNA Sequence Number=SeqID_16865
  Pfam annotation: Domain name=MAP7; Domain location=5-167; Score= -84.2; E_value=0.097; Accession=PF05672.2; Description=MAP7 (E-MAP -115) family
MSHHSSSVNGEGTSHKDPLSRILDELSSLKLWKEEKERKEKGKKRVEEISQDERKKIREEERRKIMKEMKREKHCSYSSHNSCKSLSEELRDYYERRHRSHLRPHSHKREKERNPQEANINLTYFHKKDNVEANLDWEIRIEQQLKKKSTSKSYGSHSYPKKDQGQDILGVTPSKPKDDKEKTIEKQLLKA

SEQ ID NO: 108551 - protein, 88 aa, Glycine max
  Coding DNA Sequence Number=SeqID_16866
MECFYMISHAFMTPTQLGDPPKVPPVQYYDTFVEPDMHQQSVAAAAPDDADVDVHRLGHVVDGYVAIADKLEKLLNLRILTEGIEAYT

SEQ ID NO: 108552 - protein, 49 aa, Glycine max
  Coding DNA Sequence Number=SeqID_16867
MEKVLGTLEMVFFLSYTKAKAENAQVRNALGNGSFAPTLDIFSKILTVR

SEQ ID NO: 108553 - protein, 262 aa, Glycine max
  Coding DNA Sequence Number=SeqID_16868
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=72%, E-value=2e-24, Identity=68%"; Hit description=LacZ protein
MEKRLCRGPLTFPVKYLPGIFQEISAPFPFFSCHMKHFTDTLISANIGTKAGTGPPLEVDGIDKLDVVLIPKSLPLDGAAPLLCAGITVYSPMKYYGLAQPGLHLGVVGLGGLGHVAVKFAKAFGMHSGPATIAGNLTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 108554 - protein, 63 aa, Glycine max
  Coding DNA Sequence Number=SeqID_16869
MVPKTCSNPASAPDCASSIKRLILIKHHPQIPLVGLNSNRIALRQTYKQLGYRTPIPHDNTIN

SEQ ID NO: 108555 - protein, 73 aa, Glycine max
  Coding DNA Sequence Number=SeqID_16870
MSLEQTNQWLAPENPDESLETSNNSFQNCPIQPASIRPYTLRLRVIQCSMECPRALHDMHMLRSSHILRKMGV

SEQ ID NO: 108556 - protein, 49 aa, Glycine max
  Coding DNA Sequence Number=SeqID_16871
MGAKYLEAVKQRLHAIKQWSPDEIRFLHISKPGTYMPNQKVSKNQLRKS

SEQ ID NO: 108557 - protein, 136 aa, Glycine max
  Coding DNA Sequence Number=SeqID_16872
  Subcellular localization annotation: CTP_CleavageSite=64; ConfidenceScore=5.12e-01
MPTQIHYAHTSHASVLQGQWRNHPGNQFNRDQGGPSTRPQQQGPSLYDRTTKLEETLAQFMQVSMSHQKSTESAIKNLEVQLGQLAKQLANKSSSSFTSNTEKNPKEECKAVMTRSRMAIQGNDSEAGKKMEEHKQ

SEQ ID NO: 108558 - protein, 15 aa, Glycine max
  Coding DNA Sequence Number=SeqID_16873
VNAVKIFPNAQNGLR

SEQ ID NO: 108559 - protein, 141 aa, Glycine max
  Coding DNA Sequence Number=SeqID_16874
MTLLLSNILPSDRNANLPLQKYQLVCVVPTWGSHPQRHLVDLKKSNRALGFPALVTGLCRPYRAPVPPNKFMSSWHTDCARKTPSGPEEGQQGLGVASSKYGSLSVLQSARRPNKVIRPHINQAFIKKYCAPKRAQGETPQ

SEQ ID NO: 108560 - protein, 317 aa, Glycine max
  Coding DNA Sequence Number=SeqID_16875
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=A6V332; Match level="QueryCoverage=52%, HitCoverage=25%, E-value=4e-21, Identity=36%"; Hit description =Virulence sensor protein BvgS
  Pfam annotation: Domain name=Hpt; Domain location=156-231; Score =21.9; E_value=0.0023; Accession=PF01627.14; Description=Hpt domain
  Pfam annotation: Domain name=Response_reg; Domain location=18-130; Score=61.1; E_value=3.7e-15; Accession=PF00072.15; Description =Response regulator receiver domain
  Pfam module annotation: Pfam domain module=Hpt::Response_reg; Domain location=156-231::18-130
TPGEGSVFSFYFRAPAGETARSNPTASVTAAGHRQAVVVSESAVEALKLWQQDPLRFDLIITDCNMPGMNGFEFAQALRQHERHHHLPPITLYGLTASAEQHIMQRCLQAGMNDCLFKPLNLDTLLAQITHCSRRTPNARDSEAAVTGQPAADTAAAALPALRRHDELLAALQQTTDAHALSQLGHKLKGGASILNASALMELGRKLEKHQQEGHDVAQLIAAIAHNVRQRHHIGVVKGRSMFNAKILIVDEHRLVAAGHIDILILDPDFKEKNGIAFLRDIGANGFVSKYDPIQTLNAANFQPALFPLEFTHPTTH

SEQ ID NO: 108561 - protein, 272 aa, Glycine max
  Coding DNA Sequence Number=SeqID_16876
  Homolog annotation: Hit_ID=A6WVW5; Match level="QueryCoverage=78%, HitCoverage=59%, E-value=1e-103, Identity=87%"; Hit description=O -antigen polymerase
  Pfam annotation: Domain name=Wzy_C; Domain location=128-198; Score =53.8; E_value=6.1e-13; Accession=PF04932.6; Description=O-Antigen Polymerase
MPQRAIHQGTEVLEPMLAGAWRGHYPHKNAAAASLVLMSFLGLYIRKRGLPITGLLIVALCVFFVLHTGGKTSTAMLPFIVVMSLVFVRWKWTRVFIAVGGIAAFNIVAVGAAVFDPLRELVESLGVDASFTNRSDIWKLAFSAISAKPIFGYGLDSFWKTPEMVYAGGGGASWAVAAFNAHNSFLDMMINAGIIGLILTLIWVMILPLRYIREAESTDNDPILTLLYIRLWLYGLYMSCMESTFFQNGGALWFCIMVAVFGLRLQAKARLV

SEQ ID NO: 108562 - protein, 229 aa, Glycine max
  Coding DNA Sequence Number=SeqID_16877
  Homolog annotation: Hit_ID=A2Q4S5; Match level="QueryCoverage=57%, HitCoverage=20%, E-value=4e-16, Identity=36%"; Hit description=IMP dehydrogenase/GMP reductase, putative
CWIYEHFPSVHQCVTDDTYQETSPRASRWLTSKAHMKGITGAPYRARCDGLTVTDVSWLPYTEHRGVRAFQEISSFQGQLRWGPMIVAVRPERVVRQFGYIQSIPPPPVSARLSQEQIDDRWMEFADHLLPAGQPCLVPGQVSADYIEWFFRISHPFMTPTQAADQQRDAPAADPEDYIQPPSPQVPVAFDPPPYVDDYEGYEGDCTEGDPVLMGRSGLVRDAARTIDH

SEQ ID NO: 108563 - protein, 229 aa, Glycine max
  Coding DNA Sequence Number=SeqID_16878
METCLEVEELLQRMIDQGRLEVGDEGREEQQICMQSVDERCFGRPKPLVIYFTKGAASQKPRHPSTPKPVPFPYQNSHAVPWRYTPPNKEEEEATDISSLSAKVTNITGLSGVTHSGRVFVPPDLPIHPTNIKGKAKVVEEQDDKMPLTPIEDIPAKGLLEKRDGYGKKEVSLEEANEFLCIIQQSEFKGLAVGITHELGTSSGFANKGFERGPRGPRYLCGGLRRACQ

SEQ ID NO: 108564 - protein, 212 aa, Glycine max
  Coding DNA Sequence Number=SeqID_16879
MKHILKRLSEHVESIQLGVIHPPPELHPYNQYEEKRLSHMENVLMQFMEISQASFKANQNSIQNLEIQVGESYSMENCWWEQELQPYNQYEEERFSNLENVLIQFMETSETNFKANQHAIQNLEIQVFPGYMSFMESLAKREKCKEDVFYEVKKTVGMSCMSEVIRSNQMPVQVAWPGVQFPSVRGDTFGIGNDDVDNATAQEALDPGPTQD

SEQ ID NO: 108565 - protein, 386 aa, Glycine max
  Coding DNA Sequence Number=SeqID_16880
  Gene Ontology: Mol. function=DNA binding; Cellular component=integral to membrane; Biological process=regulation of transcription
  Homolog annotation: Hit_ID=A7QEB8; Match level="QueryCoverage=39%, HitCoverage=35%, E-value=9e-30, Identity=49%"; Hit description =Chromosome chr1 scaffold_84, whole genome shotgun sequence
MQLKKVTNRDKKIQERQATLGDMTLEDFLVKAGVVAEALPKREYMKNDTAELKMEATVSKLVLEDAETKLRIYRNKSAMIARLFPGTTDNAVKNHYHVKMARKYRGQSSAYRRRRMSQSVYKRVDQNPTFVCSSRDNNASTTEPEPESLLSYYPNLNDLAADTTGGDVDFGSNVSPLNMTRGREVMSNTTHVGLCAEAQQQAPFDFFSGYKGHKYLSKGESRIGRGKQKLDGNKNACIETMSKPKHVYGIKVKQVQWLLRCSLCNEECYLIASNDFAIWGCILLVFLMLWPTTQKVAQEIGQNNGQRGILLLEFQQAKIAMEELKVELERMVGYDAQYEIQAKVDNLKHCFGLLRCGVETITRQLDDFFDEIVEGRKMLLNMCSHK

SEQ ID NO: 108566 - protein, 108 aa, Glycine max
  Coding DNA Sequence Number=SeqID_16881
MENASNAAFVRFLAFCWPFAHMFFPALSPDSVDNRITAFDWHDRFPDWKAGSERNAINHTPSRGYLEGVPGWVKVHALMQVRQKINTDWRWNPKPKYWKLRKACWPCS

SEQ ID NO: 108567 - protein, 150 aa, Glycine max
  Coding DNA Sequence Number=SeqID_16882
CGQTNHNIRSCKNIGVPVRPKKYVAPSTSNEDNHLLSQDEQALNEAEEAAAHVQQDSVEINLSQPHLSQDSDMELMVPATIVPPIARNKLTITRAKQRKVADKDDVDEFEVRIVARLPWWHCRMKLPENAQQLPLADMEKSSEQAAATEP

SEQ ID NO: 108568 - protein, 125 aa, Glycine max
  Coding DNA Sequence Number=SeqID_16883
MALVDIVAISYGCGDDMKFPNIRGCTLKARAKSLVEEGQWVSMMHKDYTHSVAGHIRLGDKSVKKGFKELIHGGLEVLYSAIRIWWNPWSKSSFKNQEVVPSLSNSSSIIDIGKQSLIVIASSAL

SEQ ID NO: 108569 - protein, 122 aa, Glycine max
  Coding DNA Sequence Number=SeqID_16884
MAWGNGSIEWLGRGVKSSIFIFNYQQKEVGLASVMEGVEKKEVRVVVVAVVLCLKLLGEHDSSCDDPPVYSLGALPMISPKAPFGSSKRTEIREPAEVMAEACVVFGVAGPEVVLEWHPARG

SEQ ID NO: 108570 - protein, 90 aa, Glycine max
  Coding DNA Sequence Number=SeqID_16885
  Gene Ontology: Mol. function=cysteine-type endopeptidase activity; Cellular component=vacuole; Biological process=proteolysis
  Homolog annotation: Hit_ID=Q9AUD9; Match level="QueryCoverage=80%, HitCoverage=14%, E-value=2e-32, Identity=88%"; Hit description =Asparaginyl endopeptidase
  Pfam annotation: Domain name=Peptidase_C13; Domain location=1-90; Score=-86.1; E_value=1.4e-05; Accession=PF01650.9; Description =Peptidase C13 family
MEETEDRDIILLAILLVFYLEACEFGSIFEGLIPEDINIYATTTSNAEESSWGTYCPGEYPSPPLEYSTCLGNLYSVAWMEDKYVHNKES

SEQ ID NO: 108571 - protein, 132 aa, Glycine max
  Coding DNA Sequence Number=SeqID_16886
RTKHIDIKLHFVKEVIGQGSVIVKKISTDHNPSDMITKKNKKETKGNGGARKRSIERGVAWLVHFVEHLECVKEMARVRSVGGCEGGRSIRVGMETDFEEMGMEGLGVGRGTEVGACFEESGECEGVKGGGR

SEQ ID NO: 108572 - protein, 92 aa, Glycine max
  Coding DNA Sequence Number=SeqID_16887
MVWIGVAQLGSWWGELREGIWRKSMRLEKEEGRAEGKVKEFDPSPQQSYNEEECMESDVIFRESHVSILLTPTSFVSQDLEAIILSIGSIRC

SEQ ID NO: 108573 - protein, 115 aa, Glycine max
  Coding DNA Sequence Number=SeqID_16888
MHLTVEASFMMMNQVDSSSFDDNKDDDKKLKRMISRLSQQGTSFVVQVKDTSTWIVVTENKRGYISCGSVQVEDTSTWLFKENNEGYIPCGSLLVKVFTRLKRNLKDRRSLGDWM

SEQ ID NO: 108574 - protein, 285 aa, Glycine max
  Coding DNA Sequence Number=SeqID_16889
  Gene Ontology: Mol. function=calcium ion binding; Cellular component =mitochondrial inner membrane; Biological process=mRNA modification
  Homolog annotation: Hit_ID=A7Q2T3; Match level="QueryCoverage=65%, HitCoverage=44%, E-value=2e-56, Identity=43%"; Hit description =Chromosome chr1 scaffold_46, whole genome shotgun sequence
  Pfam annotation: Domain name=PPR; Domain location=169-202; Score=8.0; E_value=0.87; Accession=PF01535.11; Description=PPR repeat
  Pfam annotation: Domain name=PPR; Domain location=31-65; Score=33.8; E_value=6.4e-07; Accession=PF01535.11; Description=PPR repeat
  Pfam annotation: Domain name=PPR; Domain location=66-100; Score=37.7; E_value=4.3e-08; Accession=PF01535.11; Description=PPR repeat
  Pfam module annotation: Pfam domain module=PPR::PPR::PPR; Domain location=169-202::31-65::66-100
MNQHTTYSKCGFWHFAFEVFKGVEGNRRNLITWNSMIARMMLNKESERAVDMFQRLESEGLKPDSATWNSMISGFAQLGVCGEAFKYFREMQYVGVAPCLKIVTSLLSASANSSMLRRGKEIHGFALRTDINRDDLLATALVDIYMKSGHPSWARGVFDQFDAKPDDPAFWNAMIGGYGRNRDYESASEIFLMKCWKKWFNQTWQHLLVIYLLAATWVRCYLDSNLGEEMAKKLLDIEPENPAPLVVLSNIYVGLGRWKEVERIRGMITDKGLDKLSGFSMIELA

SEQ ID NO: 108575 - protein, 87 aa, Glycine max
  Coding DNA Sequence Number=SeqID_16890
MACLIQRKQAVGLTEKKRSSSEEEKQQRRREARREEEKQQQRSECNIVGCTLHIPLISSFFLGVQSSDKPNLTKGLFFPELPFYLPE

SEQ ID NO: 108576 - protein, 160 aa, Glycine max
  Coding DNA Sequence Number=SeqID_16891
  Gene Ontology: Mol. function=nucleic acid binding
  Homolog annotation: Hit_ID=A5AT22; Match level="QueryCoverage=69%, HitCoverage=33%, E-value=3e-18, Identity=40%"; Hit description =Putative uncharacterized protein
MGESALLTTACGKNKATKSQANQKGNDKVSPQADIKKVSEGWGTNTLDFTDFKTCMDCIKGKQTNMSKKGVNKSSSIYTKNEQAPGPFAKFLQEHEIVAQYTMSGSPNQNAGNDPKTFDQAMSYKESNLWHDAMKDEMNSMQSYRVWNLVELPDGAKAID

SEQ ID NO: 108577 - protein, 332 aa, Glycine max
  Coding DNA Sequence Number=SeqID_16892
  Gene Ontology: Mol. function=peptidase activity; Cellular component =membrane
  Homolog annotation: Hit_ID=Q5KSB6; Match level="QueryCoverage=86%, HitCoverage=100%, E-value=1e-135, Identity=85%"; Hit description =Hypersensitive-induced response protein
  Pfam annotation: Domain name=Band_7; Domain location=54-228; Score =163.1; E_value=7.4e-46; Accession=PF01145.16; Description=SPFH domain  Band 7 family
MEPELMISGKHVVMWSHKTREGFFVDCLSLRPSAPEKKIGLAKMGQMFSMFGFVQVEQSSVAIKEVFGKYNDVLDPGCHCVPWYFGNRVAGALSLRIQQLDVRCETKTKDNVFVTVVASIQYRALAEKASDAYYKLSNTRAQIQSYVFDVIRASVPKMELDATFEQKTDIAKTVEEELEKAMSAYGYEIVQTLIVDIEPDERVKRAMNEINAAARLRVASNEKAEAEKIVQIKRAEGDAESKYLAGLGVARQRQAIVDGLRDSVLAFSENVPGTTSKDIMDMVLMTQYFDTMKDIGASSKSNAVFIPHGPGSVHDVASQIRDGLQQGNATKS

SEQ ID NO: 108578 - protein, 445 aa, Glycine max
  Coding DNA Sequence Number=SeqID_16893
  Homolog annotation: Hit_ID=A5AMM4; Match level="QueryCoverage=60%, HitCoverage=12%, E-value=3e-11, Identity=24%"; Hit description =Putative uncharacterized protein
ANITYPHSFIQLIQGYLFHGLPNEDPYAHLATYIEICNIVKISRVLKDVIRLKPQPVFFLLGRCITSLEQALSQANRNPHKTLNKLPQQLHVVQPTHSSAMQIGGCNIYGGAHESSMCMAYDNASKEAKVEDPIVGITSTKIKAVSLSNHKSTESVIKNLEVQVSQLAKQLAKKSTSNFVTNTGNNPKEECKTIFTRSKRRESAEKRAEGVLKDVLTTKTKSQLVWEARKEIPSVLVKEIPYPLDMPLYTKFLKDFLTKKGKYINNESIMVEGNYSKALIDLGESIYLMPLSMCQIIENLKLALTRMTLQLADHSIIKPYGVVEDVLAIKHPNTCFKVEAIEQETDLVERHLKNVLPKEDEAKLVVNPVDPSIVFTGHFFYKRQAFSLFFLVEAAFPHATKPSPWIVPFDAEPLGGDTSGIGNDDAPEIEVDANYVADITAAQGA

SEQ ID NO: 108579 - protein, 562 aa, Glycine max
  Coding DNA Sequence Number=SeqID_16894
  Gene Ontology: Mol. function=protein serine/threonine kinase activity; Cellular component=plasma membrane; Biological process=two- component signal transduction system (phosphorelay)
  Homolog annotation: Hit_ID=A7Q2R5; Match level="QueryCoverage=61%, HitCoverage=91%, E-value=1e-100, Identity=50%"; Hit description =Chromosome chr1 scaffold_46, whole genome shotgun sequence
  Pfam annotation: Domain name=PAS; Domain location=34-139; Score=9.0; E_value=0.059; Accession=PF00989.15; Description=PAS domain
  Pfam annotation: Domain name=PAS_3; Domain location=266-357; Score =13.5; E_value=0.0053; Accession=PF08447.2; Description=PAS fold
  Pfam annotation: Domain name=PAS_3; Domain location=53-146; Score =14.2; E_value=0.0045; Accession=PF08447.2; Description=PAS fold
  Pfam annotation: Domain name=PAS_4; Domain location=34-147; Score =5.6; E_value=0.059; Accession=PF08448.1; Description=PAS fold
  Pfam module annotation: Pfam domain module=PAS::PAS_3::PAS_3::PAS_4; Domain location=34-139::266-357::53-146::34-147
MGLGTTAARSRRRIVIEEGSIRTTHTATATNADADGAGASFTITDPSIPGHPIVFASPGFLKLTGYAAREVLGRPAAIFQGPRTSRKSVIEIREAVREERNAQVVLLNYRKDGTPFWMLFRVCPVFSSDGGAVVHFVAVQVPLQKKEGSGVRDFGFGCCRKEVCADSLAEIGRVCSLEQVLEPDVRELEREEPCEASDEEKRSAVNAMDNIFSVLTHYSEATGRLVCQKRCSIPDVGLLSTSLIISLGRIKQSFVLTNPRLSDMPIVYASDAFLKLTGSKTVTFLRLMGMDHLVMPSLIAYVQIRESIKTEQPCTVRILNYRKDKSSFWNFLHISPVRDASGKVAYFVGVQIEDSNKNDDSHCLSPEKRQLNVVGVVKVAVRSLSMTLTQTLSPPEPPQYPTPIASGSPCTIRKQNHIRHNPRNRHNFHNPCRILIRHGMRVAEDSVFGVVEEDGVAVGEDEEVAVGEEVQERVKIVLLAAVGVAGVPAVAGIEAAAVAREGDVGGAEVGAVEDHYLLVVHYLHVHGGDAYAALQLNPVATGGACCSLLKCHGELEKKKEER

SEQ ID NO: 108580 - protein, 212 aa, Glycine max
  Coding DNA Sequence Number=SeqID_16895
MATRRLIVWRKVYPKVLVKCKVPPRIWVLNVEADMGVGESSKSVGKSLDDLVTNNYGSRFYVFNYAHEENNRSTCGVEERESNKKAFDISSLEFNKKASGTSLFSWAKHSSNNKAKAVSKPLLSKPDSGSSKNRRVAKRVVYGVYGTLHVGAELAYDMDKAWAIVGDFNFILHAHEKIRGANSPNLRGIIGFSQMMEVYEFIDVGLQGYLFT

SEQ ID NO: 108581 - protein, 337 aa, Glycine max
  Coding DNA Sequence Number=SeqID_16896
  Gene Ontology: Mol. function=ARF guanyl-nucleotide exchange factor activity; Cellular component=Golgi apparatus; Biological process =protein modification process
  Homolog annotation: Hit_ID=A7Q2Q7; Match level="QueryCoverage=96%, HitCoverage=78%, E-value=2e-98, Identity=51%"; Hit description =Chromosome chr1 scaffold_46, whole genome shotgun sequence
  Pfam annotation: Domain name=RCC1; Domain location=122-171; Score =17.0; E_value=0.011; Accession=PF00415.9; Description=Regulator of chromosome condensation (RCC1)
  Pfam annotation: Domain name=RCC1; Domain location=17-66; Score=22.9; E_value=0.0012; Accession=PF00415.9; Description=Regulator of chromosome condensation (RCC1)
  Pfam annotation: Domain name=RCC1; Domain location=179-228; Score =5.0; E_value=0.21; Accession=PF00415.9; Description=Regulator of chromosome condensation (RCC1)
  Pfam annotation: Domain name=RCC1; Domain location=231-272; Score =14.8; E_value=0.018; Accession=PF00415.9; Description=Regulator of chromosome condensation (RCC1)
  Pfam annotation: Domain name=RCC1; Domain location=69-119; Score =14.6; E_value=0.019; Accession=PF00415.9; Description=Regulator of chromosome condensation (RCC1)
  Pfam module annotation: Pfam domain module=RCC1::RCC1::RCC1::RCC1::RCC 1; Domain location=122-171::17-66::179-228::231-272::69-119
MEEPKKTENEDDKDESEQRVWSWGAGTEGQLGTKILQDEHFPQLLHQPSLSSISSLACGGAHVIALTSAGKVLSWGRGNSGQLGHGLVVSNSLYPKAVTSLDGYFITHVSAGWGHSGFVSDNGCVFTCGDGSFGQLGHGDHASHCSPVKVSCFVDQHVEQVACGMRHSLVLLKDCTGNQVYGFGSGKRGQLGVSNDRVKSVNVPKVVSGFEGVEIAGIAANGDHSAAVSVDGHVYTWGRGFKGFEDARVPQCLNSSLNFTKVALGWNHALAMSGEGEVCMLGGNHLGVLSDLQNISPAKHLPHLREVNLEKVPGLDGTKITDIATGAEHSVIVTGKM

SEQ ID NO: 108582 - protein, 37 aa, Glycine max
  Coding DNA Sequence Number=SeqID_16897
MEENKEGGKGMDPSPYAKKARASINALTFDAPDENNV

SEQ ID NO: 108583 - protein, 74 aa, Glycine max
  Coding DNA Sequence Number=SeqID_16898
MGVSRVEASFMMMNQVDSSSFDDDKDDDKNPKRMISRWSQQVQDQDKIKINFKFQEMTSRRIKIQEKMTSQGKY

SEQ ID NO: 108584 - protein, 321 aa, Glycine max
  Coding DNA Sequence Number=SeqID_16899
  Homolog annotation: Hit_ID=A7Q2Q9; Match level="QueryCoverage=85%, HitCoverage=85%, E-value=3e-93, Identity=64%"; Hit description =Chromosome chr1 scaffold_46, whole genome shotgun sequence
  Pfam annotation: Domain name=Sm_multidrug_ex; Domain location=159 -280; Score=201.8; E_value=1.7e-57; Accession=PF06695.2; Description =Putative small multi-drug export prot
  Subcellular localization annotation: CTP_CleavageSite=69; ConfidenceScore=5.55e-01
MAASALSLTSPFHFRKPHNRVSPLNAHPLILIQKGKQSLKSNFSFSTLNASPHFRPPIAIAPSTLTLTRASSSDECFDPAGEAQRLLLSEEKPVNFAFWVIFWASLSLAWFAVSRDANAAVESSIKASGFGFNIANSLRKLGWPDWVVVFTLATLPVLELRGAIPVGYWMQLNPVTLTVLSILGNMVPVPFIVLYLKKIASFVAARSPSASRFLDMLFENAKEKAGPVEEFQWLGLMLFVAVPFPGTGAWTGAFIASILDMPFWAAVSANFFGVVFAGLLVNLLVNLGLKYAIITGVILFFVSTFMWSVLRNLKKGLSSSN

SEQ ID NO: 108585 - protein, 103 aa, Glycine max
  Coding DNA Sequence Number=SeqID_16900
MVFKCYHTLLIRKFEDKSIDHVASLFDKEVVKILLMSHLGILTETKASIAANASVRSWVFAHLSTIGYLESGDYVVEDLVATRWKSLRGTGCVLPVRERLDKL

SEQ ID NO: 108586 - protein, 432 aa, Glycine max
  Coding DNA Sequence Number=SeqID_16901
  Homolog annotation: Hit_ID=A5B8Q0; Match level="QueryCoverage=26%, HitCoverage=14%, E-value=2e-09, Identity=34%"; Hit description =Putative uncharacterized protein
MVNKIKIEKFTGKNKFDLRHIKMRALLKEQGIWAPFFGQLLKIDKSTLGLQEEEANSLILLSLSDEEGTPLKEHLHELNFVLMELRNIDVKIEDEDLTTILLVSLPPFYENFVSSFSIELRLKAFRNGDEAFTFELLVTNSSKGQKEKKDKCGKKSKAYPKDICNYCKESAIWFWLLVNNYNNILNNGYWTQQSVELSPNQYDEFYDELKRRQVKGKLIKFDAQTLNAFLETPIIIPKGEQLASYAQYLHTYLDHHTITVMLCTLGGNVFSYFNLAPTSHTSDLNVDCARLIYGLVMKMDLDLGSLISFQITQIAQPSLLQLGFPVLIITLCDAKAVTFDSLTFDSLSPVINLAYIRKNNWNLQILPSSSPGQGSSHSRCSTSRSSTCGPYSSRLSSTRRPTFSPFFSARPAPPYAAESPTSISVSFLLSDS

SEQ ID NO: 108587 - protein, 452 aa, Glycine max
  Coding DNA Sequence Number=SeqID_16902
  Homolog annotation: Hit_ID=Q9SLT5; Match level="QueryCoverage=96%, HitCoverage=89%, E-value=1e-162, Identity=64%"; Hit description=CW14 protein
  Pfam annotation: Domain name=DUF1336; Domain location=208-438; Score =434.5; E_value=1.5e-127; Accession=PF07059.3; Description=Protein of unknown function (DUF1336)
MSMRERLIMSTIVVGSIEEAWFDSVAVFDSDCDDDYQSVPDDVVSLSGIEGGSVSSFPSSGDANHGVSTDHVQKQKELLAGSEAARSSDVQYFVVDAIDSQHEPVFLDEISSVDANSNKDDGLLDNCGILPNNCLPCLVSTIPSVEKRRSTSSSPPNARKKPTTKLSFKWKEGHGNATLFSSKMLLQRPIAGSQVPFCPIEKKMLDCWSQIDASTFKVRGVNYFKDKKKDFAPNYPAYYPFGVDVFLSPRKVDHIARFVELPVMSSSAKFPPILVVNVQVPLYPATLFQGETDGEGMSIVLYFKLSESYSKELPQTFQESIRRLMDDEVEKVKGFPVDTIAPFRERLKILGRVINLEDLHLSAAERKLMQAYNEKPVLSRPQHEFYMGENYFEIDLDMHRFSYISRKGFEAFLDRLKGNKQEELPEHVLCCIRLNGIDYMNYQQLGLTQDPL

SEQ ID NO: 108588 - protein, 95 aa, Glycine max
  Coding DNA Sequence Number=SeqID_16903
MAISQPKLQLIPELREAHAQEKQLSLITQLWLQNKPPNPSYSFSNKLLYWKGRLVLPRGHEVQDIKEFVQSCLICQQTKHDTALPSGLLEPLPIP

SEQ ID NO: 108589 - protein, 108 aa, Glycine max
  Coding DNA Sequence Number=SeqID_16904
MQLSNSRIISLTRASSLSLGGNPKPQSECFSHHHFQEAQQDARLDHRHQSPLAYSQQWMQRQKRPSVMVMVALRKSEEKLAEGGVELVELRRSWSLRIGSWYFCVPLQ

SEQ ID NO: 108590 - protein, 347 aa, Glycine max
  Coding DNA Sequence Number=SeqID_16905
  Homolog annotation: Hit_ID=Q1SN17; Match level="QueryCoverage=44%, HitCoverage=39%, E-value=7e-12, Identity=25%"; Hit description =Transposase, putative
MNEEELGVNEKNGEEASAHQHIDCSDAFNTSQVSATSDYVLHWAQSAAYDIGFVAVIMRKKDLVQTVIGSRKCRCPFKLRVKPVVQGERWMMKLICGSHNHELPKSLVGHPYEHNANNYTTIKKIYNARNAHLSSIRDNNTEMQQLMKLVERDQYIHWHRFKDEDVGEHLNDVVWALECFRDNFLKCDALPRVIVTNRDLTLMNGSLVDCPFEQEFDECLMKFEMACSPWPMFVDYVKYALNQIAVEFTRVSYADIDSFCCGCVMRTTHGLPCACELASTIEGMETISKRFEELDVCGKVTLKSKLRKIVYPDLNSMCAPSEKVKTKGAQKKPMTKHQRSTKCDSSY

SEQ ID NO: 108591 - protein, 121 aa, Glycine max
  Coding DNA Sequence Number=SeqID_16906
MEKVKSVMDAKHANMSRKQLNSLSFSWDRNEEFELQENVGEILEALQPDTQQLQSLIIEVEGLQEAFQHMIVEAKLHDESRLIQRCFDDNKGDDKKLKGQSKNEFKMFKIESRTLQDSIKN

SEQ ID NO: 108592 - protein, 74 aa, Glycine max
  Coding DNA Sequence Number=SeqID_16907
MEGVVAQSMTSRYVVEVMCIGVWMCWVLVMAIGSIDEDDGDVVGGIRSKKGRYRRNCKEYKLRPEPVTYHPMMA

SEQ ID NO: 108593 - protein, 605 aa, Glycine max
  Coding DNA Sequence Number=SeqID_16908
  Homolog annotation: Hit_ID=A9PF52; Match level="QueryCoverage=86%, HitCoverage=85%, E-value=1e-174, Identity=56%"; Hit description =Putative uncharacterized protein
  Pfam annotation: Domain name=DUF23; Domain location=316-575; Score =166.1; E_value=9.6e-47; Accession=PF01697.18; Description=Domain of unknown function
  Subcellular localization annotation: CTP_CleavageSite=11; ConfidenceScore=5.22e-01
MDPEQRRKRKRVVAARHLHISSRSLFLCFSFLIFLLFLSSHHHFFFFTPSTFRPSLTASTLSLLYSSASNSILDPLIPTTPSYTLQHRILFPDHHLLILTNPQQQQQKLHELECVYYTLHPNASSSGSPEPVLEVQVRPVLSTDRYDESRSIVRCPLPQTNSSAGGGPKAVDLRRRGEVGRRSLGILMNQTAQSWDRVAYEATLDGDTVVVFVKGLNLRPHKISDPTRIRCHFGLKSFHKDNAFLLTTRAVSVAQEVVRCMLPQSIRNDPDKARGIRVTVSYLGGNVRHPVRVLVPSVARVSSPGGGGRVQKRNRKKHELCACTMVWNQASALREWVTYHAWLGVERWFIYDNNSDDDIENVVQDLDLQGFNVSRKSWPWIKTQEAGFSHCALRAREECKWVGFFDVDEFFYFPSEFQQPLGEGVPGENYLRSVVANFSYSKSIAEIRTACHSFGPSGLKSPPKQGVTLGYTCRLQSPERHKSIVRPDLLDISLLNVVHHFQLRVGFRYHNMPEGTAIVNHYKYQVWETFKAKFFRRVATYVVDWQEDQNKGSKDRAPGLGTEAIEPPNWRRQFCEVWDTGLKDFLVSYFAEPATGLMPWEKSSL

SEQ ID NO: 108594 - protein, 1260 aa, Glycine max
  Coding DNA Sequence Number=SeqID_16909
  Gene Ontology: Mol. function=transcription repressor activity; Cellular component=nucleus; Biological process=regulation of transcription, DNA-dependent
  Homolog annotation: Hit_ID=A7Q2L0; Match level="QueryCoverage=100%, HitCoverage=79%, E-value=0.0, Identity=64%"; Hit description =Chromosome chr1 scaffold_46, whole genome shotgun sequence
  Pfam annotation: Domain name=HDAC_interact; Domain location=523-623; Score=221.9; E_value=1.4e-63; Accession=PF08295.3; Description =Histone deacetylase (HDAC) interactin
  Pfam annotation: Domain name=PAH; Domain location=146-192; Score =70.9; E_value=4.2e-18; Accession=PF02671.12; Description=Paired amphipathic helix repeat
  Pfam annotation: Domain name=PAH; Domain location=380-426; Score =58.2; E_value=2.8e-14; Accession=PF02671.12; Description=Paired amphipathic helix repeat
  Pfam annotation: Domain name=PAH; Domain location=60-106; Score=71.8; E_value=2.3e-18; Accession=PF02671.12; Description=Paired amphipathic helix repeat
  Pfam module annotation: Pfam domain module=HDAC_interact::PAH::PAH::PA H; Domain location=523-623::146-192::380-426::60-106
MKRSRDEVLTSCSQLKRPVLSSRGEASGQPQMMNGGAQKLTTNDALAYLKAVKDIFQDKRDKYDDFLEVMKDFKAQRIDTVGVIARVKELFKGHRDLILGFNTFLPKGYEITLPSEDDQPAPKKPVEFEEAINFVNKIKTRFQGDDHVYKSFLDILNMYRKEDKSITEVYQEVAAIFQDHPDLLDEFTHFLPDASAAASTHYASARNSMLRDRSSAMPTIRQLHVEKCCPFSEVLASSTVMVPLTFYSSACQRERTIVSHGDHDPSVDRPDPDHDRGLLRIEKERRRVEKEKERREDRDKRERERDDRDYEHDGARDRERFSHKRNRKAEDSGAEPLLDADENFGVRPMSSTCDDKNSLKSMYSQEFAFCEKVKEKLRNPDDYQEFLKCLHIYSREIITRHELQSLVGDLLGKYPDLMEGFNEFLLQSEKNDGGFLAGVMNKKSLWNDGHGLKQIKVEDKDRDQDRDRDRYRDDGMKERDREFRERDKSTAIANKDVLGSKMSLYPSKEKYLSKPINELDLSNCDQCTPSYRLLPKNYPIPVASQKTELGAEVLNDYWVSVTSGSEDYSFKHMRKNQYEESLFRCEDDRFELDMLLESVNVTTKRVEELLDKINSNIIKGDSPIRIEEHLTAINLRCIERLYGDHGLDVMEVLRKNAPLALPVILTRLKQKQEEWARCRADFSKVWGEIYAKNYHKSLDHRSFYFKQQDTKSLSTKELSIARCSAFALWLWATLLKPIMSLLGVVPGVAQIMAILMAICGISKHNAIFAYVGDHDAIILSIFLTLTPFFYETFTALLAEIKEICEKKRKDDVLLAIAAGNRRPILPNLEFKYSDPDIHEDLYQLIKYSCGEICTTEHVDKVMKVWTTFLEPMLCIPSRPQCAEDTEDVVKVKNNCVLNDTATVAESDCSPVVGATIMNPKHINVSRNGDECMPLDQSTSSKAWQSNGDSGVREDRYLDDHALRKTETLGSNTQHGKMNSIAFTPDEPSGFNNKQDQSSERLVNANVSPASGMEQSNGRTNIDNLSGLTATPTRPGNASVEGGLDIPSSEGGDSTRLGTSTNGAITGGTKVHRYQEESVRPFKNEREEGELSPNGDFEEDNFAFYGGNGLDAVHKGKDGGVSRQYQNRHGEEVCGETRGENDADADDEGEESHHRSSEDSENASENVDVSGSESADGEECSREEHEDGEHDNKAESEGEAEGIADAHDVEGDGMSLPYSERFLLTVKPLAKHVPPMLHEKDRNSRVFYGNDSFYVLLRLHQ

SEQ ID NO: 108595 - protein, 494 aa, Glycine max
  Coding DNA Sequence Number=SeqID_16910
  Homolog annotation: Hit_ID=A7Q2K5; Match level="QueryCoverage=95%, HitCoverage=98%, E-value=5e-88, Identity=42%"; Hit description =Chromosome chr1 scaffold_46, whole genome shotgun sequence
  Pfam annotation: Domain name=TPX2; Domain location=416-471; Score =17.9; E_value=0.009; Accession=PF06886.2; Description=Targeting protein for Xklp2 (TPX2)
MGEFLVDATVFEDKKMGEGAAASNPALQVSVSFGRFENDSLSWERWSSFSPNKYLEEVEKCATPGSVAQKKAYFEAHYKKVAARKAELLAQEKQREKDSFGSEEHSGIDLSGNTDAEHDISNNTQGSSEGVEHETSSAGEIHKTHVNESEEEFAVSRDYQSSSVQVENKELESRSHSSYQIDEPENVCKKQVESPNNNIEAEDVKEISHVVYKETGKASEGEVKDVKLNHPKESKVKSVSKGSNAARTKKKSMLPTSKASPISTPKSSKPASTTPTKTVTPASSTRKGSSPSLTRRQITSSGESRKFANKPLHMSLSLAPSNPDPAPQSTMRRSLIMENMGDKDIVKRAFKTFQNSFNQPKTSVEDKSLIKKQVPSRGTVSKVPTSTTLRKENGRPTKVENLYQSGNAVRTTLGPKRDIRAEKGKESSRKIEEKSNTKGVERTRLQSKVKEEKEAEMKRLKHNVKGTSSPAFNRGQKVVKSRPEKLTTSLHLML

SEQ ID NO: 108596 - protein, 365 aa, Glycine max
  Coding DNA Sequence Number=SeqID_16911
  Gene Ontology: Mol. function=oxidoreductase activity, acting on the aldehyde or oxo group of donors, disulfide as acceptor; Cellular component=mitochondrial matrix; Biological process=metabolic process
  Homolog annotation: Hit_ID=Q4JIY3; Match level="QueryCoverage=97%, HitCoverage=53%, E-value=9e-59, Identity=88%"; Hit description =Pyruvate dehydrogenase
  Pfam annotation: Domain name=E1_dh; Domain location=100-337; Score =67.0; E_value=6.4e-17; Accession=PF00676.11; Description =Dehydrogenase E1 component
MGLLGCGLAFAQKYSKDESVTFAMYGDGAANQGQLFEALSIAALWDLPAILVCENNHYGMGTAEWRAAKSPAYYKRGDYVPGLKVSLVNVFFDALVVMVYLLMGGFNVFLQRNLQILIIGNEEIQGYIHGYEAQTRIITGLYEKRIGIIHGTHGTEKGEEKLEGNQRKQKKCISADTILTESCVQQRNLQILIIGNEEIQGMYAFPVLALYVDASVDSPFLASSLGFIPVDGMDVLAVKQACKFAKEHALKNGLLILEMDTYRYHGHSMSDHGSTYRTRDEISGVRQERDPIERVRKLLLSHDIAAEKELKDIEKEVRKEVDEAIAKAKENPMPDPSDLFTNVYIKGYGVEILISSNKLYVLQNL

SEQ ID NO: 108597 - protein, 244 aa, Glycine max
  Coding DNA Sequence Number=SeqID_16912
  Gene Ontology: Mol. function=two-component response regulator activity; Cellular component=nucleus; Biological process=two -component signal transduction system (phosphorelay)
  Homolog annotation: Hit_ID=A7Q2K3; Match level="QueryCoverage=62%, HitCoverage=66%, E-value=5e-55, Identity=75%"; Hit description =Chromosome chr1 scaffold_46, whole genome shotgun sequence
  Pfam annotation: Domain name=Response_reg; Domain location=20-148; Score=82.7; E_value=1.2e-21; Accession=PF00072.15; Description =Response regulator receiver domain
MDTDGVVSFNHVSPEDSHEVHVLAVDDSLVDRKVIERLLKISACKVTAVDSGIRALQFLGLDEQRRTSESDGFVPDLKVDLIITDYCMPEMTGYELLKKIKESTMFREIPVVIMSSENILPRIDRCLEEGAEDFIVKPVKLSDVKRLKGYLTPKEVIKVDRRSDGYVNGGCKGGDGGGGGGVEINNNKRKLEEQDTSDVSTSPPSTSTLSSSPSVSSPSPSSSPTSSPSVLASPIRRLKMTSTD

SEQ ID NO: 108598 - protein, 483 aa, Glycine max
  Coding DNA Sequence Number=SeqID_16913
  Gene Ontology: Mol. function=metalloendopeptidase activity; Cellular component=proteinaceous extracellular matrix; Biological process =metabolic process
  Homolog annotation: Hit_ID=A7Q2J9; Match level="QueryCoverage=69%, HitCoverage=90%, E-value=1e-101, Identity=55%"; Hit description =Chromosome chr1 scaffold_46, whole genome shotgun sequence
  Pfam annotation: Domain name=PG_binding_1; Domain location=171-237; Score=46.3; E_value=1.1e-10; Accession=PF01471.9; Description =Putative peptidoglycan binding domain
  Pfam annotation: Domain name=Peptidase_M10; Domain location=277-437; Score=272.6; E_value=8.4e-79; Accession=PF00413.15; Description =Matrixin
  Pfam module annotation: Pfam domain module=PG_binding_1::Peptidase _M10; Domain location=171-237::277-437
MHQLLHQQVIDDMRVSSLQPQLPNITIKRNYMEPATFLQQYTNHDEVEEVRSMSKKGASMKEGVGLQCQRVEVNVKERSKVKGLGFKARRNEGAWCKVNKHARVQTKEQAERSRLGFKARRKVAESFNTTPVSARLFPNVSSIPRWNTSHAPPDSAWNAYRNFTGCRPGKTYNGLSNLKNYFHYFGYISNVSSKSSNFSDDFDDALEAAVRAYQKNFNLNITGELDDPTMNQIVKPRCGVADIINGTTTMNSGKTNTTDSPTFHTVAHYSFFDGQPRWPVGTQELTYAFDPDNALDDVIKTVFGNAFSRWSEVTTISFRETASYVAADIRIGFYGGDHGDGEPFDGVLGTLAHAFSPTNGMFHLDSAEDWVASGDVTKASLSNAVDLESVAVHEIGHLLGLGHSSVEDAIMYPTITARTRKVELNEDDIQGIQVLYGSNPNFTGTPATSSRESDTSDGGVRHVGATCGVFFSLLFFVVFGLHV

SEQ ID NO: 108599 - protein, 420 aa, Glycine max
  Coding DNA Sequence Number=SeqID_16914
  Homolog annotation: Hit_ID=A9PGP1; Match level="QueryCoverage=61%, HitCoverage=79%, E-value=2e-48, Identity=44%"; Hit description =Putative uncharacterized protein
  Subcellular localization annotation: CTP_CleavageSite=92; ConfidenceScore=5.43e-01
MCCNLKDSTKLNTKRSPQDYPSWTFKQGCLQSVHLNPNSNRGGDVFFSASASSRGNGIRVTVTVRVSVIVMSDPSRGRVTITLGRSGHVVKRDASAVDVSSFSSIHSAGTKRSVRDRIGSNADSSGWHGNGHSGNKRHRGDVSMQNGLDGNDLRLKLMRKSALGQADSNGSKRHMDLREKLSKASHPLANTYNSKQHGPDSRETSLRQIPSARSSDKLLRMESMRSSYSPWTLDHIRRRSPDGFPSTSRGISPQRDVQDLHRRPVSRTYDGVRSVSYVGRDVLETSRPPISTPQSFMSRSTMSTLPPVTVKPVASHPGQLPPSGSVAQRPSYVPPSPHPIISPFKSCRTDAEQRLSSNSAGCQGCPAMVQVVEPIRQQRRGVAANGNDGHEISHDKWCYSCNSTGSVMASRTAGRGAVIS

SEQ ID NO: 108600 - protein, 121 aa, Glycine max
  Coding DNA Sequence Number=SeqID_16915
FPEDVFRKTFGYFRKNTSSGNFPEKVLPELPEEPLTGLPEDFSVSLFRHFFRRTLVFSPLVFYPKVTTLSKSNGELGRLTSKAVRGEDGEEEEAWLVVSGRRRKLGSRCHGGSTGMEEEKK

SEQ ID NO: 108601 - protein, 128 aa, Glycine max
  Coding DNA Sequence Number=SeqID_16916
  Gene Ontology: Mol. function=protein binding; Cellular component =chloroplast envelope; Biological process=carbohydrate metabolic process
  Homolog annotation: Hit_ID=Q93ZV8; Match level="QueryCoverage=77%, HitCoverage=15%, E-value=4e-26, Identity=60%"; Hit description =Putative uncharacterized protein At1g10510
MWFTSALRLTERVVVFARVIWKLVEKLLVPTPKQLKYSTGESQSPSQGLKWSFAAGTNLLSQLGEKIERQSRQKLNEFARELRSFPSIDMSGRNFGDEGLFFLAESLAFNQLLVMKCKYGYVEHNNLL

SEQ ID NO: 108602 - protein, 156 aa, Glycine max
  Coding DNA Sequence Number=SeqID_16917
  Gene Ontology: Mol. function=nucleotide binding; Cellular component =intrinsic to membrane; Biological process=defense response
  Homolog annotation: Hit_ID=Q7XA40; Match level="QueryCoverage=99%, HitCoverage=32%, E-value=2e-15, Identity=37%"; Hit description =Putative disease resistance protein RGA3
MAEAVFKVVLENLSSLAATELGTLLGFNGEKKKLHNMFTAIKAKFQDAEEKQFSNEAIKDWLGKLTDASYELDDVLEECAYEELWKKYLLVLDDVWEDKPYNWERLKFVLACGAKGSSILVTTHLSEVATIMRTIMHPPHELTKLSNKDYWELLKD

SEQ ID NO: 108603 - protein, 128 aa, Glycine max
  Coding DNA Sequence Number=SeqID_16918
  Subcellular localization annotation: CTP_CleavageSite=79; ConfidenceScore=5.09e-01
MAPMLHTKSSSCLGETILQQSYKSSITSFMTSWKSVALKHWRWNIKESNVGIGFCSSSIRKFFSLYKSGTGLALCQGKQAMEFTAWEFSHACLEIKLFELTKKIETMFCHLYIIVQGQGKCQGQHTEF

SEQ ID NO: 108604 - protein, 165 aa, Glycine max
  Coding DNA Sequence Number=SeqID_16919
AECLWGGRAFHGVEAYLGNEGMIRVVVGEGVRGEDVFVHDEHGKKGRGFRDEGTRGGWGGERRGGVWGWWVRRRPGTAAAVQHFVFLEAGKFDGLRERDRPQCLYFAAELQDQARDETTQQGGWGNSDGAVGQALKSNEKEGAKRDSKAYNIAGHEEKNPFRCIH

SEQ ID NO: 108605 - protein, 464 aa, Glycine max
  Coding DNA Sequence Number=SeqID_16920
  Homolog annotation: Hit_ID=A7Q2I2; Match level="QueryCoverage=50%, HitCoverage=63%, E-value=1e-48, Identity=44%"; Hit description =Chromosome chr1 scaffold_46, whole genome shotgun sequence
  Subcellular localization annotation: CTP_CleavageSite=61; ConfidenceScore=5.61e-01
MLRSTPIPAPYNSVPVLSRARTCHSLAPARAVHSHSSFVSRLVFPQFRQYIVNVPGRVFVAAAAKKQRRGGAELAVTDDGFDDDEEYDDDDFYDEYDDDDDDEEEEFDDDEDDEGMLSLEKMNKWFEKKPRGFGEGKVYDTSVEDKLLEEMRQSRIAQAENLKKLMSNPVKHASNESVQKKKAGDDLILERKFLFSPERVKNAELVPIGGRVCLVNLPKKKNIHKDLKSALQGIPGIINIVPAVTGNKKTRDPICKGFAYVDFKREEDAVRFVELYTGQTITFGKIQKQIKCELLNVQSSSSLKLSKNLSAAPQLVAAAFEEDSNEDSNLDGSARSSWDETNSSDDLDDLDYQMNGEEQEDDEDNQESVTALGVDHDDNVEMRIDPENISLPSEQVDRNPAAVQKSSAKVKQENARKKKPISKEKTKKVLDVPGSSRRLKIREKAVLSEVFSKGSMSKVFKFDL

SEQ ID NO: 108606 - protein, 17 aa, Glycine max
  Coding DNA Sequence Number=SeqID_16921
GATRRVLETIRPMRPLP

SEQ ID NO: 108607 - protein, 201 aa, Glycine max
  Coding DNA Sequence Number=SeqID_16922
MDFRNNASDNILSQNPCQNGFSKEAQNIQWWFQSQKRCKDKLKLTRNKHRITVTSRKTTKGSSRCGVSTENNDGLWWLLVAVGDGGKNLGRWKWFLKKEGEGNGVFPRLHEKQRLKHSSASAHGKGSVPHTLDAVSKITTWRLQSPFLLLHSAIIDFQEANDFIDEEDPRPTSSTWSYIKKQMTPLMKKIQGLQALHGATS

SEQ ID NO: 108608 - protein, 67 aa, Glycine max
  Coding DNA Sequence Number=SeqID_16923
MGGGHMNENAIHGALKKIGGVGYRQSRTTLNGNLKGRDTKNGFSFAGSHLPCRKFIWSEDLPFPLSH

SEQ ID NO: 108609 - protein, 103 aa, Glycine max
  Coding DNA Sequence Number=SeqID_16924
MIDQWNNRHAFRVDAYPRQEGLLSFNSDYMVWVKLRRHYNTWCLLKGGIHAHLMISCLMWKKLQFYPKSKRESLSQCHMVPHQSVNFLHNSFTCFSQVLKLRG

SEQ ID NO: 108610 - protein, 284 aa, Glycine max
  Coding DNA Sequence Number=SeqID_16925
  Gene Ontology: Mol. function=motor activity; Cellular component=cell projection
  Homolog annotation: Hit_ID=UPI00006A2D9E; Match level="QueryCoverage =59%, HitCoverage=85%, E-value=1e-17, Identity=17%"; Hit description =UPI00006A2D9E related cluster
MPSLSEDYMSSPSKDYAPSLSWGYTRAPSEDYTSLPLDGYTPSPSEGYTSSSSEDYTSSPSKDYTTTRPHLQSTTRPHLQRATRPHHQRTIHPPLQRATHPCIQRATHPHPRGLHVLAFRGLHGLTFRGLHALSLKGLHVFHFRGLHTLAFRGVHALAFRGLHVLTFRGLHVLTFRGPHALTLKGLHGLTFKGLHTITFRGIHDLAFRGLHVLTIRGLHVLTFRGLHALTFRRLHVLAFIGLHVLPFSGVHVLTFRGLHILAFRGLHVLSFKGLHILGFRGLHR

SEQ ID NO: 108611 - protein, 76 aa, Glycine max
  Coding DNA Sequence Number=SeqID_16926
MAYGGDEFVHPDNAVPVSLTRSGYPRIIPSHHRRMILKKDEKADMLSLCSLDKTYTPGTNKGYGLNQPGKPCRHTH

SEQ ID NO: 108612 - protein, 284 aa, Glycine max
  Coding DNA Sequence Number=SeqID_16927
  Homolog annotation: Hit_ID=Q6WAY6; Match level="QueryCoverage=94%, HitCoverage=44%, E-value=5e-31, Identity=33%"; Hit description =Putative uncharacterized protein
MKPYLFSEFYPSLARISKIVQISAQELDHRKQVKNRVVGIPRKYLEAKARILAGKGEWAPFIDILALLIFGGVLFPNVDGLVDLAVIDAFLAYHNHKESPIVAMLADLYDTFDQRCEKSNTRIVCCTPALYVWLVSHLFCQEVRHACSLESHRSCTEKGGANWDQLLASKEGASVNWFPRWKEGRTRVLISCGGFPNVPLMGTRGCISYNPVLAIRQLGYPMRGAPLEDELTPVISRGFNKTNVETLQKVRKAWKVVQKKDKELRGSNNGPIGGDHKWLKAHVQ

SEQ ID NO: 108613 - protein, 179 aa, Glycine max
  Coding DNA Sequence Number=SeqID_16928
MAPTRHPLDPDKSNRALGFPALITGLCQSFGVPVAPSKVIWPPITRAFIEKYCTQRQAQGDAPQAAGVPPPPHQADPAGSIDTERYLRHSMRQHAANHRGLGQVHECLYQLSLNMQSQGFAPFPRPTPDQFRAEVAWPGDWPEAQAGEAPAEAPDDGEEAGMDKEMSDLLDFLGGSGAT

SEQ ID NO: 108614 - protein, 70 aa, Glycine max
  Coding DNA Sequence Number=SeqID_16929
LHHSLSLEKDLTSNPEVLEALGFFPQHLNEDALIPHDVALSGACRPWIFFINGVLFFLKINCNRMEMEER

SEQ ID NO: 108615 - protein, 79 aa, Glycine max
  Coding DNA Sequence Number=SeqID_16930
ERLKALRIQTTTLKGIINSALKGLKDTPQPKFKVGAREIEGTSHPVDNYLKGIINSALKGLKDTPQPKSKVGARWIVVK

SEQ ID NO: 108616 - protein, 159 aa, Glycine max
  Coding DNA Sequence Number=SeqID_16931
MASNSQQLSARNDAIVLRGVHEVAMDSSSSTENKKLEGKLDALVNLVTQPAMNQKYTLVARVYGLCSSADHHIDLFPSLQESGVNEQPKAYAANIYNRPPQHQNQQQQNNYDLSSNRYNPGWRNHPNLRWTSPPQQQQPVPPFQNVAGPSKPYVPPPMQ

SEQ ID NO: 108617 - protein, 160 aa, Glycine max
  Coding DNA Sequence Number=SeqID_16932
  Homolog annotation: Hit_ID=Q6L477; Match level="QueryCoverage=44%, HitCoverage=11%, E-value=3e-08, Identity=32%"; Hit description =Putative uncharacterized protein OSJNBa0009L15.8
  Subcellular localization annotation: CTP_CleavageSite=59; ConfidenceScore=5.73e-01
MGSPPAFTPPPPPPPSDASALPSAMKRTRKASRLRSLSTRPTGAERPMVHVDPATGKADSSHKKKLRTYLGIVVRDKVDVTSENWKEVPTAQKDLIWEDIQAEFDILEASDSRMKRKLLQIVGERWRKFKSDLTRKWALAADQDSVEDNVYEKYGISKEK

SEQ ID NO: 108618 - protein, 291 aa, Glycine max
  Coding DNA Sequence Number=SeqID_16933
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLDQNHWDSTRTYTISYPTFANEFIHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108619 - protein, 67 aa, Glycine max
  Coding DNA Sequence Number=SeqID_16934
MEVDEPWIGLWPPLNYQVDMGASQHRTLELGWSSSLEVRNDIVGLVGNLAINFDPFTGEDQIRKALR

SEQ ID NO: 108620 - protein, 121 aa, Glycine max
  Coding DNA Sequence Number=SeqID_16935
MSKSCGFGMTGPLDESISCFLIRVDPWVLVPITFRGLHVLAIRGLHVLAIRGLHALTSRGLPVLALRGLHALTLGTSYPHQLRGLHVLAIRGLHALTFRGLHVLALRGLHALTLGTSYPHQ

SEQ ID NO: 108621 - protein, 161 aa, Glycine max
  Coding DNA Sequence Number=SeqID_16936
MERSMIDAASGGALGDMTPVEARNLIEKMASNSQQFSARNDAIVLRGVHEVATDSSSSTENKKLDGKLDALVNLVTQLCMNQKSAPVARVYGLCSSADHHIDLCPSLQQSGVNEQPEAYAVNIYNRLPQQKNQQQQNNYDLSSNRYNPGWRNHVEANFIDS

SEQ ID NO: 108622 - protein, 203 aa, Glycine max
  Coding DNA Sequence Number=SeqID_16937
MDELKILNIPTKMFKLFNHSIFPHQGHPTRSMRPPPPHEHTQHASSQFISNIINISIQYHSQHKHHLVSMTLSTTTTSFHINIITYQFKVINSNINKKKFRMQQGHAYILIARFPDRNHGVEMRSLSFALVGPTQVSITPKRKEFSMHFKNKVKGNNWGQIPLSTHKGLRGVSDSTNGNIILKFRSRQCDRGSVTGAKITSML

SEQ ID NO: 108623 - protein, 177 aa, Glycine max
  Coding DNA Sequence Number=SeqID_16938
  Pfam annotation: Domain name=Transposase_23; Domain location=57-127; Score=-14.1; E_value=0.042; Accession=PF03017.5; Description =TNP1ENSPM transposase
MAPEDLEQLAQQIRDQLEESITEKGLALPPKPEVGPSAARVSTKENCVDPSGNDPDTGDSDKCGLYIEENPPRLVALGKVYEGSITVHNIPLLHDQVKVDVEEVRDADAPIPVPIEEVRLVGQTLNTFFAWPTHLIKHLSEQGAMGPSKPTDRPDHEVDDPLYLMTLTIPQLFLNPL

SEQ ID NO: 108624 - protein, 176 aa, Glycine max
  Coding DNA Sequence Number=SeqID_16939
  Homolog annotation: Hit_ID=Q949K7; Match level="QueryCoverage=28%, HitCoverage=57%, E-value=4e-08, Identity=50%"; Hit description =Putative gag polyprotein
MGAYAKDEKLLIHSLQESLTGVAVIWYTSLEPPRVHSWKELMVAFVRQGQYNGFEQDATIEHGSGSPSVSLNGEERNNNNDSRHITSVLLWKMVGYTPSSFADLVFAGEMIKVGLKRGKFDHHALIHAKKKTGANEEDENEGETHAVAAIPIWPSFPPTQQCHYSANNNPSPYPPP

SEQ ID NO: 108625 - protein, 111 aa, Glycine max
  Coding DNA Sequence Number=SeqID_16940
MTSTSGDAIPSSPKTARLMTEMIKLGDQMRRMSYENEERMERMRKENYESLRRIHRISEALNEGCEEDEGGLRNEMYRERRNHRRYGGRQREKGIKGIKVKIPTFKGICDP

SEQ ID NO: 108626 - protein, 39 aa, Glycine max
  Coding DNA Sequence Number=SeqID_16941
MEDIHREYDEEQGIKENSQNKKIEEAKEHHQRHGGELSY

SEQ ID NO: 108627 - protein, 177 aa, Glycine max
  Coding DNA Sequence Number=SeqID_16942
MFVDPKNANIATLVEVAETLQYMVSPQGRNTWTIDDLVPYVDKITILSEEQERITEPVSHGPAPEHEFAPQEFHILPSSVETQGIGRRRKAVKVELYFYPQMEDRGHGMYYTPPKFSQYPTQMYQYPFEGNQTDASASEHSLGGIVKTHPNFSWPTMTPSQQYDTPIPTPNAPLGMQ

SEQ ID NO: 108628 - protein, 58 aa, Glycine max
  Coding DNA Sequence Number=SeqID_16943
MTPVSTATSLGLEVIPQVKELLDEGLVRKSLNPCALLVPEIGIIRHQIPKIGDMMNME

SEQ ID NO: 108629 - protein, 113 aa, Glycine max
  Coding DNA Sequence Number=SeqID_16944
MTRRSTAGDLIPIDLEINTTCRRCNAERNRKFLQDLEAATTLEEEPRSSEVSSSFPIAGQSYIDLIEEVIMAEEARRVTLEDYSSSSVPQFFTIIAQLEVQAKTITYPPSLIQ

SEQ ID NO: 108630 - protein, 81 aa, Glycine max
  Coding DNA Sequence Number=SeqID_16945
MGLTNMDGEELPSPGQDHLGLPSGVETKHERQKPIEDERKRGWGHDRPIVAFLCAKRAENVAARQPRILCILQLSFTICLF

SEQ ID NO: 108631 - protein, 143 aa, Glycine max
  Coding DNA Sequence Number=SeqID_16946
MALARDFCKETTHGAFWFGVGSKIPLAIYTLGMIAKYLDVLEIPRCAHVQFLVPQNALSMHEIAPRKLASKRSRKDKVAEGTSSAPEYDSHRFRSAVHQQRFEAIKGWSFLRERRVQLRDDEYTDFQEEIGRRRWASLVTPMA

SEQ ID NO: 108632 - protein, 209 aa, Glycine max
  Coding DNA Sequence Number=SeqID_16947
  Homolog annotation: Hit_ID=A0ST23; Match level="QueryCoverage=11%, HitCoverage=51%, E-value=6e-07, Identity=100%"; Hit description =Putative reverse transcriptase
LPGINRDTRIYLFCEVISVTGIYSAQSASAVPPVQLLTGWCVTAKAPPDISAGKCSGHAARRVPFAIQAAQLLGRAIGAGLFAITPAGERGMCCKAIKLGINEALGLNPELGLDLKRADQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 108633 - protein, 225 aa, Glycine max
  Coding DNA Sequence Number=SeqID_16948
  Gene Ontology: Mol. function=protein dimerization activity; Biological process=DNA integration
  Homolog annotation: Hit_ID=Q2R1C3; Match level="QueryCoverage=100%, HitCoverage=35%, E-value=2e-39, Identity=38%"; Hit description=HAT family dimerisation domain containing protein
  Pfam annotation: Domain name=DUF659; Domain location=109-225; Score= -40.1; E_value=0.00042; Accession=PF04937.6; Description=Protein of unknown function (DUF 659)
GIATCLKVTDAYLVDLRRVCKEAENRLKSKNLPLPTDKRTLTPPTLPPKRRKSSNIESAFNIEDKNHLRAEIARMFYSAGLSFHLARNPHFVSSYSFAANCNLSGFLPPSYNALRTSLLQQERSHIERLLQPIKSLWSLKGAIDGSKEYKDKHYMFDLLKDVIKEATGLLIEAEFPHIFWTPCVVHTLNLGVKSICAAKNVDGNENVFNECRWIAEVIGDASFIK

SEQ ID NO: 108634 - protein, 120 aa, Glycine max
  Coding DNA Sequence Number=SeqID_16949
  Homolog annotation: Hit_ID=UPI00016621D1; Match level="QueryCoverage =94%, HitCoverage=40%, E-value=3e-08, Identity=34%"; Hit description =UPI00016621D1 related cluster
MSSPSEDYTPSPSEGLHALAFRRLHILAFRGLHVLTFRGLHTLTFRWLHALAFRGIRVLAFRGLHALAFRGLHILAFRGLHALTFRGLHALAFRGLDVLAFRGLDVLTFRGLHALAFRGL

SEQ ID NO: 108635 - protein, 41 aa, Glycine max
  Coding DNA Sequence Number=SeqID_16950
MKFQWISIGGSERGVKKRKIGLYGTCFGEDLSKIRRLPVLV

SEQ ID NO: 108636 - protein, 94 aa, Glycine max
  Coding DNA Sequence Number=SeqID_16951
MKAQVEKHEGPEAETLSRLLIVAEGPSNPCGVYLDLSSFTGSGVYPDLSSFTGSGVYPDLSSFTGSGVIQTFVACIKRSAPTQVHIIWYQSFGS

SEQ ID NO: 108637 - protein, 90 aa, Glycine max
  Coding DNA Sequence Number=SeqID_16952
MCSLARLGEHPLHPKYKNEGRGTFLHPKTPPPPPSFKREDLQRLAVLAPSSHFWLPFAFIFGVIVHSNKYGIGYSKWVPKCNSELRNPNL

SEQ ID NO: 108638 - protein, 163 aa, Glycine max
  Coding DNA Sequence Number=SeqID_16953
MWFGISRHYNYIKCNVEAMRNVENKANAVIIRMWVNSVHENVIGSRALESRCVTVPQLMLMCFGISRPCNETIYKCALDSRDIYNYLIVRIWVNSVHENVIGSRALESRCVTVPQLMLMCFGISRPCNETIYKCALDSRDIYNYLNVRMRVNSVHKILVIHVN

SEQ ID NO: 108639 - protein, 146 aa, Glycine max
  Coding DNA Sequence Number=SeqID_16954
MPPTRHPLDPDKSNRALGFPALIMGLCQSYLAADAPPLPHQVDPAGSFGMERYLQHLVCQQAANHRGQVQTHECLNQLSLSLQSQGFAPFACPTPDQFRAEVAWPGDWPEAQAGEAPAEAPGDVEEARMDEKMTDLLGFLGGSGAT

SEQ ID NO: 108640 - protein, 161 aa, Glycine max
  Coding DNA Sequence Number=SeqID_16955
MKYEDKSPKQVRVWGHLVKFDEDTLNTFLKTPVIVEEGENLCAYSRFALLRPDPQELAAKLCIPGNGFELNVDGLPLKILRKNMTTLAQTWIVLSYCNLVPTSHTFNITFERAKLIYDIIMKMDIVAAYPFAGERGETHGCVFHRRKMRGVATNILLKGKR

SEQ ID NO: 108641 - protein, 70 aa, Glycine max
  Coding DNA Sequence Number=SeqID_16956
  Subcellular localization annotation: CTP_CleavageSite=46; ConfidenceScore=5.18e-01
MRGLTGASSMGGRCAESPPNVYSRKTSKKPERRGLRTLSVKGSEVVFTHGEGCFPCFYVFLNCDKEIKPT

SEQ ID NO: 108642 - protein, 90 aa, Glycine max
  Coding DNA Sequence Number=SeqID_16957
  Homolog annotation: Hit_ID=O69421; Match level="QueryCoverage=31%, HitCoverage=29%, E-value=4e-08, Identity=100%"; Hit description=InsA protein
  Pfam annotation: Domain name=Ins_element1; Domain location=3-62; Score=-14.4; E_value=0.0031; Accession=PF03811.4; Description =Insertion element protein
  Subcellular localization annotation: CTP_CleavageSite=50; ConfidenceScore=5.75e-01
APVASVSISCPSCSATDGVVRNGKSTAGTSALASVAVTLRVTTTPAALKCAATGRVPIRHSGCATVGKGDRCGPLRYYASWRKGDVLQGD

SEQ ID NO: 108643 - protein, 126 aa, Glycine max
  Coding DNA Sequence Number=SeqID_16958
  Homolog annotation: Hit_ID=Q2QPQ8; Match level="QueryCoverage=43%, HitCoverage=23%, E-value=2e-08, Identity=52%"; Hit description =Putative uncharacterized protein
MTAPDFTYESLCIQYPDEDVPCVLKTGLIHLLPKFHGLAGPLPSRRIFQASGNSVEKAYMNTGKDSKKLCASCPHHQISEQLLLQYFYEGLSNMERSMIDAASGGALGDMTSAKAKNLIEKMASNS

SEQ ID NO: 108644 - protein, 219 aa, Glycine max
  Coding DNA Sequence Number=SeqID_16959
  Gene Ontology: Mol. function=cystathionine beta-lyase activity; Cellular component=cytoplasm; Biological process=methionine biosynthetic process
  Homolog annotation: Hit_ID=A6TE03; Match level="QueryCoverage=51%, HitCoverage=28%, E-value=7e-42, Identity=77%"; Hit description =Cystathionine beta-lyase
  Pfam annotation: Domain name=Cys_Met_Meta_PP; Domain location=1-110; Score=-249.7; E_value=5.2e-05; Accession=PF01053.11; Description =CysMet metabolism PLP-dependent enzyme
VARVNHPALPGSKGHEFWKRDFSGSSGLFSFVLNKRLTDAELAAYLDNFSLFSMAYSWGGFESLILANQPEHIAAIRPEAEVDFSGTLIRLHIGLENVDDLLADLAAGFARIVSTLVEKRYHLGKSMVVIQEIVAALWQHDFAALANPHVVGFVYLVMFATLFLENGLLPASFLPGDSLLLLAGALIAKGVMDFVPTLAILTAAASLGCWLSYLQGRWL

SEQ ID NO: 108645 - protein, 45 aa, Glycine max
  Coding DNA Sequence Number=SeqID_16960
MAPRKLSAKRSRKDAAAEGTSAAPEYTAIVSGALSTSSILRPSRD

SEQ ID NO: 108646 - protein, 229 aa, Glycine max
  Coding DNA Sequence Number=SeqID_16961
QAALEDPEEEFNHSRSDLEVLSFSNLAPTSHASDITLDRARLGFPTLITALCKARGVTSDSLTFESLSPAINLAYVKKNCWNLDDPSVTFWGLRKTKGKMFEAPSSSALPTSAPSTSAPASSTPAPASAPTHSGPSTPIMSVDEFLSQVAWPGVQPSPLGGGEASATQEPPDAEIAQEEVASPELIAQPSPSPAPVLDDPQPSAPAPMPNQPLAQDPPAALALDLNEHA

SEQ ID NO: 108647 - protein, 124 aa, Glycine max
  Coding DNA Sequence Number=SeqID_16962
MTETSMRAGNADVYGFLEPQSIQRSGQSQFESESYIKNWMQNSRRDVYLGAYLNGAHWQMIVILPKENVVIWFCSLNNRPDNYLKGIINKSVLFFNIFALALVGNINILIVQYTSMFVFSSALK

SEQ ID NO: 108648 - protein, 99 aa, Glycine max
  Coding DNA Sequence Number=SeqID_16963
MHVIFVTYTEPRSHWRGQNFQMIYPFVKPECSQRSYVVTWRLAWNRRAEKKNKSPSDATRNLRVAHDRVREPSYEDICLSLLNDDFSFKKIMFLTNGMR

SEQ ID NO: 108649 - protein, 159 aa, Glycine max
  Coding DNA Sequence Number=SeqID_16964
MTSRDQVWSFCTLVSSRGGGPDDTRRYLTVIRTLLSSRGGGPDDMRRYLTVIRTLLSSRGGGPDDKQRPKAAGPMIRGDTLRLSAPFCHPEAAGPMTSRDQVWSFCTLVSSRGGGPDDTRRYLTVIRTLLSSRGGGPDDKQRPNLVILHPCIIQRRRAR

SEQ ID NO: 108650 - protein, 83 aa, Glycine max
  Coding DNA Sequence Number=SeqID_16965
MKDADFLALLNDHWKFDFSVVMAAGWFASCLMAFKPMLVKGFDALELQVDMRFDEMDSRITKVEGDVTYICTCFDLPPPPPSS

SEQ ID NO: 108651 - protein, 115 aa, Glycine max
  Coding DNA Sequence Number=SeqID_16966
  Gene Ontology: Biological process=transposition, DNA-mediated
  Homolog annotation: Hit_ID=Q1J7G7; Match level="QueryCoverage=33%, HitCoverage=55%, E-value=5e-15, Identity=94%"; Hit description =Transposase
MVKVGTSYVPINVSFSPKVGPGLPGINRDTRIYLFCEVIFRHRYFFGAKCVGRCCQLIDLVYDGVFEVLQWLVFLSAVPPVQLLTGWCVTAKAPPDISAGKRSGHAARTHHPRRA

SEQ ID NO: 108652 - protein, 130 aa, Glycine max
  Coding DNA Sequence Number=SeqID_16967
MGDQEEIQEQMKADMSSLKEQMASMMDAMLGMRQLMENNVATAAAHTGDISNPYLGYNRVAYPYELPPNYTPPVMRDDVGHVPSPIPEGEPPQHSVKVHEDHAQGDVDFYPPVLVEGLTPVILPQPNLPT

SEQ ID NO: 108653 - protein, 47 aa, Glycine max
  Coding DNA Sequence Number=SeqID_16968
  Gene Ontology: Mol. function=DNA binding; Cellular component=nucleus
  Homolog annotation: Hit_ID=UPI000034EF88; Match level="QueryCoverage =93%, HitCoverage=2%, E-value=5e-10, Identity=70%"; Hit description =DNA binding
MGSARQLFQRLQGPMEEDTLKSHFDKIIKIGQKQRYHRNQVLIKILY

SEQ ID NO: 108654 - protein, 76 aa, Glycine max
  Coding DNA Sequence Number=SeqID_16969
EVCDDIVERLERHLSLGVVTSGSSTHEVIEECLRLAKSVTQDHLIYVRCRRRRRTDQAWFMYILYIDIPCIYRYCT

SEQ ID NO: 108655 - protein, 89 aa, Glycine max
  Coding DNA Sequence Number=SeqID_16970
MAGPPLVEAKLHGESKVIQRCFDDNNDDDKGDDKKLKDQSKNNSSESRTIQEFKNQEESLESRIKIQGSRIKIKIQDSRFKNAEKTQSR

SEQ ID NO: 108656 - protein, 88 aa, Glycine max
  Coding DNA Sequence Number=SeqID_16971
  Subcellular localization annotation: CTP_CleavageSite=60; ConfidenceScore=5.01e-01
MEVRNFVGIMATIALLSRYGSKLAYDTGIGVNSTGFFSGKFLLWLVFWFVLRVVFGLRCVAGTVVTTWVSPSFLFSPFAPGFLFIKAT

SEQ ID NO: 108657 - protein, 193 aa, Glycine max
  Coding DNA Sequence Number=SeqID_16972
  Gene Ontology: Mol. function=NADH dehydrogenase (ubiquinone) activity; Cellular component=integral to membrane; Biological process=ATP synthesis coupled electron transport
  Homolog annotation: Hit_ID=Q47HG5; Match level="QueryCoverage=20%, HitCoverage=5%, E-value=3e-09, Identity=64%"; Hit description=NADH -plastoquinone oxidoreductase, chain 5
MMQADLTSISWLSLAVWLPVLSGVLVLVLGGDHKATLTRWLALAGGLRLCLFCRDCRRVCHRLLFLPPVFPGAWLAKRSGHSNSDLPNAHMLTAFHDDGIMIGDDHAHDDAHHHGLGPTTTHMNQSLGGDSAAGAAGNSIKLVIGYIALEPMVFGDFFRNVIFVNPEAHPAMEHLAHHYHVYAQPCWHGDSWF

SEQ ID NO: 108658 - protein, 152 aa, Glycine max
  Coding DNA Sequence Number=SeqID_16973
MSEIEEVQGQMKSDMEAMKEQMSTMMEAMMSMKRMMEVNAATVVASSTTTEVDPTHPFGFDQVNHPASDMVGQTIQNKHSFPSYGLPPNYMAPNVAHTPNENVDNSVPMPIESQQPQSDHAHVSQLMGEMHEASRDHNLVDSELCLEHATEG

SEQ ID NO: 108659 - protein, 77 aa, Glycine max
  Coding DNA Sequence Number=SeqID_16974
MEEKKKKKVEEAVQFGSTDTMIDPPSPIRRHVKWKMARTKKTGQMTSDVAKEITDKIIHWRSRPHRVPLSPMDVKMY

SEQ ID NO: 108660 - protein, 108 aa, Glycine max
  Coding DNA Sequence Number=SeqID_16975
MARISFLPLFEVALERSPPICASSSSISVVYKSKGETKDIELVEEEQTRIGADPSSGTSNKYENYKEEARKKTLKHKPKRVESVNADAEAFGDDWKILIALCIVKLKQ

SEQ ID NO: 108661 - protein, 157 aa, Glycine max
  Coding DNA Sequence Number=SeqID_16976
  Homolog annotation: Hit_ID=A5BU22; Match level="QueryCoverage=68%, HitCoverage=19%, E-value=5e-10, Identity=33%"; Hit description =Putative uncharacterized protein
NPSDLQPFDPEIDRTFHRLLRHHLVPFEHPGHSVIGDFEHYCFEHSDFGHSENMTQPPPRERTLREMAAPDFTYEILCIQYPDEDVPYVLKTGLIHLLPKFHGLAGFPHSLKGVAKDWLYYLAPRSITSWDDLKRVFLEKIFPASRTTAIREGYLRY

SEQ ID NO: 108662 - protein, 215 aa, Glycine max
  Coding DNA Sequence Number=SeqID_16977
LLWCLALCLPGGAILLDESSVSRRPDDLAGGDGHSVEHTEARNQSWKPQDPVGLLWVHWVHPIGLIEARNQCWKPQGPVGNNAYLPMSGRHRPTDTFAGGDRHYVVMLVRTINTCLFVAARVKSCPGMHSSCVIASLSGCIRTVGALQCQGVAQELIKGNYWPLNRECKSRLSIYGQRTLNSLKVQMWSPLKARMRSPLKARECAALRRRGHVAL

SEQ ID NO: 108663 - protein, 27 aa, Glycine max
  Coding DNA Sequence Number=SeqID_16978
STLEDPPTSKDKKESSSDATRNPWGSS

SEQ ID NO: 108664 - protein, 57 aa, Glycine max
  Coding DNA Sequence Number=SeqID_16979
MKNIPDSGVVFTFEEGEELATQLAQASQVASSKSNRLLEEQSGRPKWAKLLFAPFFY

SEQ ID NO: 108665 - protein, 189 aa, Glycine max
  Coding DNA Sequence Number=SeqID_16980
  Gene Ontology: Mol. function=transcription regulator activity; Biological process=regulation of transcription, DNA-dependent
  Homolog annotation: Hit_ID=Q3BM50; Match level="QueryCoverage=98%, HitCoverage=98%, E-value=2e-84, Identity=83%"; Hit description =Putative transcriptional regulator, TetR family
  Pfam annotation: Domain name=TetR_N; Domain location=12-58; Score =60.5; E_value=5.8e-15; Accession=PF00440.14; Description=Bacterial regulatory proteins, tetR f
MSKATADTHQKILATAEALIYQNGIHATGMDLLVKTSGVARKSIYRHFENKDDVAAAALSARDVRWLAWFRQECDKADTPETRILGMFTVLKGWFQSEGYRGCAFINTAGEVGDPADPIREIARNHKQKLFDYTLELTEQLDVEQPADLARQLLILMEGAITLSRVMGDYDAADTAKDVAKLLLEQAKR

SEQ ID NO: 108666 - protein, 179 aa, Glycine max
  Coding DNA Sequence Number=SeqID_16981
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPFVHTVTAIPVKRVIVISCHVDLHSDRAVHIFIVANP

SEQ ID NO: 108667 - protein, 171 aa, Glycine max
  Coding DNA Sequence Number=SeqID_16982
MEKEMITMIVDTLQVFYYEKMAGYMPSSFTDFVFTGERIEVGLRRGKFDYAASASTSNRRFGVGGAKKKKGGTHAVTSAPTWPKSQQTPHNPTYQYSPHQPNYSANVGNPPNLALVQQRLPTQPTKASPTKFISLTISSCQQHQSQHKHQSGKEFSSKEACGIHPNTNDIC

SEQ ID NO: 108668 - protein, 40 aa, Glycine max
  Coding DNA Sequence Number=SeqID_16983
MTCKERVAYGADREVMMKGSSLWVMARRLQWKLLELLDYS

SEQ ID NO: 108669 - protein, 162 aa, Glycine max
  Coding DNA Sequence Number=SeqID_16984
MWAFLTGRQIDWSHLVRYRLHKALQLNAPLPYPHLVTLFLQHFNIPLDSEPYVPIKRSFLIGAAVIAFSGYRKEHDGSWVKKGAQPIDEEGNLPVGEDSSLLQRILDRFDGLQTFVGERFDALELQVDMRFDEMDSRITKVEGDVSYIRTCFDLPPPPPPSS

SEQ ID NO: 108670 - protein, 79 aa, Glycine max
  Coding DNA Sequence Number=SeqID_16985
  Homolog annotation: Hit_ID=B0HC01; Match level="QueryCoverage=39%, HitCoverage=65%, E-value=1e-09, Identity=100%"; Hit description =Putative uncharacterized protein
MEKRQQRGLFTVPGLLLAFAHMFFLRYPLILWITVLPPLSELIPLAAAERPSAARNSYDHDYEFELGTHKHHERRMYAL

SEQ ID NO: 108671 - protein, 165 aa, Glycine max
  Coding DNA Sequence Number=SeqID_16986
  Homolog annotation: Hit_ID=A2W599; Match level="QueryCoverage=44%, HitCoverage=20%, E-value=9e-08, Identity=39%"; Hit description =Cytochrome bd-type quinol oxidase, subunit 2
MAFLRRRLEAKLEGHAAENQPDQHQRQRDRQRVEDHRVGQREGAEQRRAAQHQPGLIAVPHRGNGVHHQIAVAALFHPRKQDADAQVETVHHHVHHGAEHDDHKPNQRKIDAHIQLLSSRVSLTADSGRAGRPSVLSSWCRRARRPRPWCAAGRTPPTAGGRSRW

SEQ ID NO: 108672 - protein, 46 aa, Glycine max
  Coding DNA Sequence Number=SeqID_16987
RTREPRLARPQKGMLRQLVTPLGNHGAKHASYHRAIQGRVEPVCDP

SEQ ID NO: 108673 - protein, 80 aa, Glycine max
  Coding DNA Sequence Number=SeqID_16988
MLLGSTYFHSHYLRKPRGGCIHSKVVGCTLCGGALESGYCIPTEESTHEVNYMGNQARQNFNGGGFSGFQQGQHYNQQQN

SEQ ID NO: 108674 - protein, 122 aa, Glycine max
  Coding DNA Sequence Number=SeqID_16989
MVSRGGDERDEYLFHLGESHDMETCPVVEELLQRLMDYGQLEVSIGGREEPQICMQSEEKKVPLTPKALVICFTRKGTGSTPIYPRTAPKPTPFAYQSNKAVPWKYTPPVSSERVATEVDSP

SEQ ID NO: 108675 - protein, 151 aa, Glycine max
  Coding DNA Sequence Number=SeqID_16990
KTPTHGFSEPIQLKIFIDGLRPQSKQLLDALAGSKIKMKTPDEAIDLIESMAASDIAIWRDRAHIPTRKSLLELTSQDALLAQNNPEEISIQVDFQHFRTPSSINSREWKNHPGNQINRDQGGSSTRPQQQMPSLYDQTTKLEKTLAQFMQ

SEQ ID NO: 108676 - protein, 189 aa, Glycine max
  Coding DNA Sequence Number=SeqID_16991
VGTGERTRELPGGNAGIFIVLSGFATSDLSVDFCDARQGGGAYGKTPATRPFYADTARRSRTTERSESVSEEAEERPIRKPPLPAPDNNFTQETAMTMITNSSSVPRRVHRVLTINHAHPEKNGALIASRETRGRAYHFYKCPSCGAEIDGEPARNNEVAISRSGIPVHGVLPEAQPDSAEWDFIQGIL

SEQ ID NO: 108677 - protein, 94 aa, Glycine max
  Coding DNA Sequence Number=SeqID_16992
MTTMPISPCRCIGWDRAHKTPSGPEEVQQGPGVSSSGIAPIRHPVGPKKSNRALGFLALVTGLCSPTGCPFPPARSRHHRDRACKTPSGPGGIL

SEQ ID NO: 108678 - protein, 116 aa, Glycine max
  Coding DNA Sequence Number=SeqID_16993
MGGAVTLLDIPGGGNKVCIEGAYVDPFYLMTLTIPQLFLKPLQVMWDATLFGLFNEDFPLHMTRTSMRAGNADVYGYLEPQSIQRFDQSQFESKSYLKNWMQNSKRDAYLGAYLNG

SEQ ID NO: 108679 - protein, 185 aa, Glycine max
  Coding DNA Sequence Number=SeqID_16994
  Homolog annotation: Hit_ID=A6H5B3; Match level="QueryCoverage=36%, HitCoverage=84%, E-value=1e-27, Identity=88%"; Hit description =Putative ribosomal protein S3
  Subcellular localization annotation: CTP_CleavageSite=46; ConfidenceScore=5.03e-01
KRQPGELKHLSSQRKRSKSDSRSSGERNGSSLNRENGVVGELYKCRAARRSSRECCTLDGESPVAESITSLRSDPSSMGHVESRVNQQGPPCKAKYSWVTDSEVVPETTGAVAKASLHRAIVTAYGPEPGGEMPLEPRASWFSPKCVEAQQLTRHLGVKHCFGAGRESASSSRGKQPGSPAKAPK

SEQ ID NO: 108680 - protein, 93 aa, Glycine max
  Coding DNA Sequence Number=SeqID_16995
MSCFLLYRMLPLRKKPAANLLNVLLSLSEASHGYSLSSINVQACCDIGTRCTESSHAGLAETWMLEWQAHRPFDSPLWEYGGRICHRRTLSVS

SEQ ID NO: 108681 - protein, 152 aa, Glycine max
  Coding DNA Sequence Number=SeqID_16996
MTSRDKIWSFCTLYHPEPAGPMIRGDTLQLSAPFCHPEAAGPMTSRDKIWSFCTLVSSRGGGPDDTRRYLTVIRTLVSSRGGGPDDTRKCPSGYPYKLSFAICKTERLIACRGSHSLLHLLFLREQQVIYMRKFHGRPRLSSTERSEISVIH

SEQ ID NO: 108682 - protein, 95 aa, Glycine max
  Coding DNA Sequence Number=SeqID_16997
DAGSRQARQGASAGVGGCRGWLNYAASEQIVLRVHHMRAIGAGLFAITPAGERGMCCKAIKLGNARVFPVTTLSTLEDPPPDSTLSETDDATAAT

SEQ ID NO: 108683 - protein, 80 aa, Glycine max
  Coding DNA Sequence Number=SeqID_16998
MKKEELQGLLAFTSFTAWTSASGRSDVEFSYLTPIAKHFVRFFNVSEGNVQNTQKEGKRDEVISSLGRATFIPNALFCYK

SEQ ID NO: 108684 - protein, 160 aa, Glycine max
  Coding DNA Sequence Number=SeqID_16999
  Homolog annotation: Hit_ID=Q5KQG8; Match level="QueryCoverage=73%, HitCoverage=14%, E-value=6e-08, Identity=36%"; Hit description =Putative uncharacterized protein OSJNBb0086G17.7
MLPFGFRCITETYGLCINIFLVFRHVLEFHKLPNDGCQAPRKDQRKVACHHAKRCIGALDGTHISVIVSPNERPRYCLFICYLGGKGLQEILEYYEMHYVIKKLEILTGLFICYLGGKGLQEILKYYEMHYVIKKLKIPTGKYFLVDAGYTNDPGFLAPC

SEQ ID NO: 108685 - protein, 89 aa, Glycine max
  Coding DNA Sequence Number=SeqID_17000
GASAKRNIPGLSTRKNPEEDELCRFAKCTASVHPLSEKGAQSQKSLTCAKRTSTNKATYLSLKSDFERGVWTGIQSFRLELEAGAGLKA

SEQ ID NO: 108686 - protein, 111 aa, Glycine max
  Coding DNA Sequence Number=SeqID_17001
  Subcellular localization annotation: CTP_CleavageSite=38; ConfidenceScore=5.05e-01
MPISPCESIGWSVPSRHRGSAHKTPGGPRGTQQGPGVSSSGYEPLSVLQGACPPQQESHPQRHLVDPEKSNRALGFPARVTGLFQFYGALVPPASSCHCDIGKYAHPPTDF

SEQ ID NO: 108687 - protein, 107 aa, Glycine max
  Coding DNA Sequence Number=SeqID_17002
  Subcellular localization annotation: CTP_CleavageSite=32; ConfidenceScore=5.27e-01
MAEPSKKRKGTLSQSQRHSGSQKMPIPSSIPSGSLFSSEEQCIRYTKLFSSRSIIDPKFIDMDFFSNESFECFQAFENSNLIPFMSLKLPVYSELVKAFYSNLESMK

SEQ ID NO: 108688 - protein, 41 aa, Glycine max
  Coding DNA Sequence Number=SeqID_17003
MTMSDGTWRTMFGWGNSWGAGSLRGSRGPRWASPSSSSCRG

SEQ ID NO: 108689 - protein, 356 aa, Glycine max
  Coding DNA Sequence Number=SeqID_17004
SSSETFYTLVWRLACSLSKEALSRLLLRGSSVTLIMAGGFALRAFFLATEGGLSMENSMMPHPHGAAESTHSDGFTYTSDMVPDSSSSGRSISSVEQPIPEEKPYIALLQLEGERKRVMEEILHIVEGQLEDPGLPRGPHEQALRFCWFELDINDNSSLTDLQDWRGSLRGGNLGQYQSIFGFYKPGGIYYPGNTPPEQEEEEKKAYDEHLFESINHPLHHPYTGSLVPLMIILCVLSGLESGYTLHMMDPAGGQPAANPAAEQPSNVPSGASTSGWRSFEEGVLLESSNESSEASVNQQPVIPELEPPLLDDNTRRAELAVRLRANWWGIAYNERILDSFVRSQLAIERHIEAAL

SEQ ID NO: 108690 - protein, 123 aa, Glycine max
  Coding DNA Sequence Number=SeqID_17005
MLLSSNVIYIYVRVVMLVRMIRTRLFATAQVKSCPGMHSSCVIASLSSCACTVGRPPILGGGPGTVKRKLLVWIWSPLKVRTRSPLKVRVCSPTKVKAHDPLTVRTCSPLEVRAMQPSVGEDV

SEQ ID NO: 108691 - protein, 70 aa, Glycine max
  Coding DNA Sequence Number=SeqID_17006
MIIEESIHVSFDESNAILPRKDVLDDISESLEEMHIHGEDHKGKGDGNNQDFNIGEIKANADLPREWRAS

SEQ ID NO: 108692 - protein, 165 aa, Glycine max
  Coding DNA Sequence Number=SeqID_17007
  Gene Ontology: Mol. function=sugar:hydrogen symporter activity; Cellular component=membrane of vacuole with cell cycle-independent morphology; Biological process=carbohydrate transport
  Homolog annotation: Hit_ID=Q9SD00; Match level="QueryCoverage=87%, HitCoverage=19%, E-value=5e-32, Identity=47%"; Hit description =Monosaccharide-sensing protein 3
MQLARQVSRLESGQSIMLYTVPILIVCLLILVIKQFFQINSVVDAAITAISVVVYESVFCMGFGVIPNIICAEIFPTSVRGICISLTSLTYWGCTLIVTLIFPYLLQLLGLTGVFGLFVVGCIISWIFVYLKVPETKGMPLEVIIEFFAIGAKPGTDPAALGIKG

SEQ ID NO: 108693 - protein, 261 aa, Glycine max
  Coding DNA Sequence Number=SeqID_17008
  Homolog annotation: Hit_ID=O22783; Match level="QueryCoverage=57%, HitCoverage=28%, E-value=2e-24, Identity=45%"; Hit description =Putative uncharacterized protein At2g33320
MRCEIPHRCVRRKYRIRRHSPFRLRNCWEGRSVRASSLLRQLAKGGCAARRLSWVTPGFSQSRRCKTTASAKLACLQVDSRGSPNPAVGFNGSQRGTPMHPFGKVNGAGFEYMTPRRSNLANMGHVVITESELGPSPSEVAAAIARKPVIDEGENSTVGGWSLDAESVEGLQSKLERWRTDLPPVVDRGEVSSYPTTSTTKTSRHSRRHTDGGSTGSGLFSCFSNICGVECYVGCGGDPKGKKNRIRSRRTPSADDSSSLL

SEQ ID NO: 108694 - protein, 347 aa, Glycine max
  Coding DNA Sequence Number=SeqID_17009
  Gene Ontology: Mol. function=hydrolase activity, hydrolyzing O -glycosyl compounds; Cellular component=cytosol; Biological process =carbohydrate metabolic process
  Homolog annotation: Hit_ID=A8GBI5; Match level="QueryCoverage=100%, HitCoverage=45%, E-value=0.0, Identity=91%"; Hit description =Glycoside hydrolase family 3 domain protein precursor
  Pfam annotation: Domain name=Glyco_hydro_3_C; Domain location=2-232; Score=231.0; E_value=2.7e-66; Accession=PF01915.13; Description =Glycosyl hydrolase family 3 C terminal domain
MADSQRDVMGSWSAAGVVKQSVTLREGLERAVGDKARILYAKGANVTQDKGIIDYLNEYEPAVAFDTRSPQQMIDEAVQAAHKADVVVAVVGESQGMAHEASSRADITIPQSQRDLIAALKATGKPLVLVLMNGRPLALSWESEQADAMLETWYSGTEGGNAVADVLFGDYNPSGKLPMTFPRSVGQIPMYYNHLNTGRPFGKENPGKYTSRYFDSPNGPLYPFGYGLSYTTFSLSDLKLSSPTMARNGKLTASVTLKNTGKYDGATVVQLYLQDVTASVSRPVKELRNFKKVTLKAGQSQQVELPISEDDLKFYNASLKWGAEPGKFNVFVGLDSDNVQAQSFTLK

SEQ ID NO: 108695 - protein, 219 aa, Glycine max
  Coding DNA Sequence Number=SeqID_17010
  Subcellular localization annotation: CTP_CleavageSite=22; ConfidenceScore=5.34e-01
MVSRRIRTSRSVIVTAIFTQCNARSLSGASPALVVCHVRSFFRHKLTEQLLALQRLTAQIRFQRHTREAFGGTQRVGVGKFALPQRAQLATGETALIDHQTSDKAFLFAIAVGHAVVDRLAAAGAVQKVDAVAQVAKQCQLKTAQRWLGRTVGRRQRLDTGEIIEEQFGEGNFLLQHPRQQLVNIQAAVERDAAERQRQRHRFGVTQGFDFATPAPAHQ

SEQ ID NO: 108696 - protein, 190 aa, Glycine max
  Coding DNA Sequence Number=SeqID_17011
MNKNDLFETFIGFQIANDRQERRKTGAGREQPEILARFQIVVEQRADRLLGQDDLVANLQMLQLGGQRTVRHLDREEFQPVFVKARGNRISARKRLAVYFQPHHDELAALEAKAGVARGAEGKQRIGPVMDVGDGFLIEVAAHFRNCLCLAPAPLGRTAPVDGSVVLVIAAFCPQSRSSVESAFPAGKTP

SEQ ID NO: 108697 - protein, 101 aa, Glycine max
  Coding DNA Sequence Number=SeqID_17012
MGLYVVGDQCTQLVALGKVYDSASTIHNVPYTDDVVRDSQKHLPKRVTSTGMHNAVAAVDPLGELVKNLFDAYQKPIELPWDGAKFGYLMLKMAFSSHMQM

SEQ ID NO: 108698 - protein, 136 aa, Glycine max
  Coding DNA Sequence Number=SeqID_17013
MAHNVFASCPYFRDLYGRELKGFFVIIPKVVISLLMVSRGIIPFEEHIAAVGTTSNNMLSKRKTLDEVPSGVANCLNLPFGGRATRGLTGASSKKGKCAESPPTFIQGKHRKTRKRRGLRTLSERFGSCIYARGRY

SEQ ID NO: 108699 - protein, 124 aa, Glycine max
  Coding DNA Sequence Number=SeqID_17014
MTIICLCAFIRHRVLQIAKRADDHNLSSHVIGHDRLWMTKGRIMTIICLCVPSDTTVSGWRKGVRNNHNLSPHVIEHDRLWMTKGRRMTIICLCVPSDTIVSGWQKVRNDHNLSPHVIRLAAFG

SEQ ID NO: 108700 - protein, 62 aa, Glycine max
  Coding DNA Sequence Number=SeqID_17015
MRTALPQLTFALKFGNRVREWEHFVPILVGAVVRDNLPWQTISADDLCLNEPDHHIPRDIGI

SEQ ID NO: 108701 - protein, 63 aa, Glycine max
  Coding DNA Sequence Number=SeqID_17016
MEKWGHPFYNQKPKNPDQKQNPFPTEVLLIHDHASRSHFSEENTETISSLTSYQELRRSEFLI

SEQ ID NO: 108702 - protein, 191 aa, Glycine max
  Coding DNA Sequence Number=SeqID_17017
  Homolog annotation: Hit_ID=UPI0000ECBAF8; Match level="QueryCoverage =18%, HitCoverage=42%, E-value=3e-12, Identity=100%"; Hit description= UPI0000ECBAF8 related cluster
PPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMHASLALAVVYNVVTGKTLALPNLIALQHIPLSPAGVIAKRPAPIALPNSCAA

SEQ ID NO: 108703 - protein, 68 aa, Glycine max
  Coding DNA Sequence Number=SeqID_17018
MAERARRRGQRRGRTTPVTMRGGDIGDSDDERLGLHRLLQDVWILRFVADIFGHEAIIDGVMPQDVED

SEQ ID NO: 108704 - protein, 91 aa, Glycine max
  Coding DNA Sequence Number=SeqID_17019
MCTSMTTLTQTWMTLLFSNVLPSDHNSDLPLPKCQLVYAILTRMNIHVAQAFIEKYCMPRQAQGDAHQATDAPPPARQADPAGSLGVERYL

SEQ ID NO: 108705 - protein, 215 aa, Glycine max
  Coding DNA Sequence Number=SeqID_17020
METTKSTQQALQSVEIQVGELAEAVTQFMSRLEKSFVEVKAQEKSPIKEHELREKDEEKNKEHTQQQWEKYSIVENQQGNILQSNNLPHQLIDKKGRQGEHEKTLSATLSLITNTFLEMIWNVLPDYMKFMEFLAKRRNFKEDEYIIQSLDVKHKGFNFLEKGLKNNLEKYFLKNSPFAKSIFVHALSCESQALSAQPLHLRLIWSAKLAKVELS

SEQ ID NO: 108706 - protein, 90 aa, Glycine max
  Coding DNA Sequence Number=SeqID_17021
MYNYHEKGRALDLESVLADFITYQASSKDDLLMQFKGTVDSMQQAFKRAKTQIGNLVDDMIKVMVRREEEYAEIETHQESILQVNTIHHQ

SEQ ID NO: 108707 - protein, 135 aa, Glycine max
  Coding DNA Sequence Number=SeqID_17022
QTQEQRSLEQMDQWLALNSGFTCDSPQISASPNQLDLAPYASGPYNAQWNAPGLLHDKHTLRSSRILREMEVDEPWLGLWLPLNYQVDMGASQHRTLELGALWLILGMAFVDNWAVGKEKTHFDPFVGEDHIIKA

SEQ ID NO: 108708 - protein, 66 aa, Glycine max
  Coding DNA Sequence Number=SeqID_17023
MGEVEEVQKQMKADMEAMKEQMATKMEAMMSMKKIMEANAVVVAATNVIAKVNPMPPSGLTQPQLW

SEQ ID NO: 108709 - protein, 144 aa, Glycine max
  Coding DNA Sequence Number=SeqID_17024
MLLPLACITNLKPALIHYPLQQILCHRACLYIMCLQYKPPRGYHIFHLLRPLRSALLHHINRWPPMTGKRVTLGLYHQGKGDWKIFPGVTTAIWLAIKDGGKSVYDIGMGANSESFFTGKFIPGLVFMLGLELPMGRGCVGAKF

SEQ ID NO: 108710 - protein, 268 aa, Glycine max
  Coding DNA Sequence Number=SeqID_17025
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=71%, E-value=1e-34, Identity=95%"; Hit description=LacZ protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTRGLVDLPGSYYGHLVADKGRQEVFVRHWEWGEFWNWLRGKVPHCVGIVGQASCGWSRNLGSLPGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 108711 - protein, 99 aa, Glycine max
  Coding DNA Sequence Number=SeqID_17026
MAILITNTRQHFIEMKDSGIRMLCMENVIMRLRCPKKHHFLVNHALGRQCPMCAIKKVIWTFRLPVTKDETNIQCMRDDMMQMRKSATGGCTQHGNILK

SEQ ID NO: 108712 - protein, 86 aa, Glycine max
  Coding DNA Sequence Number=SeqID_17027
MPISACRCIDWDHAHKTPSGPEEVQQGPEGSRLQDTQWTRRSPAGSWSCQALITGLCQFYGVPVTSSKGIKPPTNRAFIKKYCVPR

SEQ ID NO: 108713 - protein, 85 aa, Glycine max
  Coding DNA Sequence Number=SeqID_17028
MSIKGGTGRASGGGRISTSGEVGGSTTGGCNSFGASSILVGIGLGKQPREIFLTAAELQARPLYLKITPWILLACYEPTATGCRQ

SEQ ID NO: 108714 - protein, 162 aa, Glycine max
  Coding DNA Sequence Number=SeqID_17029
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
SEQESARGSFQGETPGIFIVLSGFATSDLSVDFCDARQGAGAYGKTPATRPFYADTARRSRTTERSESVSEEAEERPIRKPPLPARNSYDHDYDSSSVPIKVVIKDKDEGMQAWHWPSFYNVVTGKTLALPNLIALQHIPLSPAGVIAKRPAPIALPNSCAA

SEQ ID NO: 108715 - protein, 97 aa, Glycine max
  Coding DNA Sequence Number=SeqID_17030
MSEIEEVQEQMKADMEAMKDQITSMMEAMLSMKWMMEENMAVVIATSAATEADPTHPSSINQTSRPVPDMKNLEEDDLYRCTERESNSLSAPLAPPG

SEQ ID NO: 108716 - protein, 145 aa, Glycine max
  Coding DNA Sequence Number=SeqID_17031
MWRGVKCHWNLGAERLYVVLTVCSWCIPLLVTCLGRCHEWVRYAKKPLHVIRRYLPRRRRDALDVTELAYHPLRSKYDDHRIPSELTLERWNLLKRPNPPMLSVRQPGHICDGQTITMCPVRCSCDALYVRLRRQPPGSTWGRLL

SEQ ID NO: 108717 - protein, 204 aa, Glycine max
  Coding DNA Sequence Number=SeqID_17032
MAEKTKKKLEEATQSGTTNGVIDPTSPIRRHVKWKMTRTKKIEQMTSEAAKEIAEKIASQGSFVPHGCQDVLTTIIGRPDHPGYVRAAGSVADLTNQGPARGVDHRKSDSTADGIFQPDAVPVSIPDAILGTCTASRAYGNDPKTDDSDKCRLYIEANPPCLVALGRVFEGSTIHNIPLLPGHVKVGVEEVKDAQAPVPVPTDE

SEQ ID NO: 108718 - protein, 207 aa, Glycine max
  Coding DNA Sequence Number=SeqID_17033
  Gene Ontology: Mol. function=P-P-bond-hydrolysis-driven protein transmembrane transporter activity; Cellular component=type II protein secretion system complex; Biological process=intracellular protein transport across a membrane
  Homolog annotation: Hit_ID=Q7N0I4; Match level="QueryCoverage=42%, HitCoverage=80%, E-value=6e-37, Identity=87%"; Hit description =Preprotein translocase YajC
  Pfam annotation: Domain name=YajC; Domain location=28-111; Score =142.6; E_value=1.1e-39; Accession=PF02699.6; Description=Preprotein translocase subunit
MAGLRQAIEEGKLEQFVADFYGAPAQGSPYSLIIMLVVFGLIFYFMILRPQQKRAKDHKKLMDSIGKGDEVLTTGGLIGRVTKVADTGIIAIALNDTTEVMIKRDFVAAGIAVLNRYPLWKYLMLIVVILVGLLYALPNIYGEDPAVQITGARGVAASETTLDQVRTVLEKDNIASKSIALENGAILARFKDPDVQLRAREALVTEL

SEQ ID NO: 108719 - protein, 104 aa, Glycine max
  Coding DNA Sequence Number=SeqID_17034
  Homolog annotation: Hit_ID=A6FJQ2; Match level="QueryCoverage=36%, HitCoverage=84%, E-value=3e-11, Identity=92%"; Hit description=50S ribosomal protein L5
  Subcellular localization annotation: CTP_CleavageSite=45; ConfidenceScore=5.38e-01
AYHEALSSRAFSVMTVKTSDTCSSRRRSQLVCKRMPGADKPVRARQRMRKEKIPHQAPFAIQAAQLLGRAIGAGLFAITPAGERGMCCKAIKLGNARVFPVTTL

SEQ ID NO: 108720 - protein, 195 aa, Glycine max
  Coding DNA Sequence Number=SeqID_17035
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMLEPLTALLHPSLKKLDQKAPSQSSYKIIGMQAWHWPSFYNVVTGKTLALPNLIALQHIPLSPAGVIAKRPAPIALPNSCAA

SEQ ID NO: 108721 - protein, 193 aa, Glycine max
  Coding DNA Sequence Number=SeqID_17036
RTTRPHLERATRSYIQRIYTSSFKGLHASPLRGLHVLTFRGPTHSHFRGLHILTFRGYTPLTDSEDYTSSTFQRATRPHLQMDTSSPSEGYTPSTFRGLTRPHLERATLLTFRGLHVLTPVLPSEDYTSSPSEGLHALTLRGLGLHILTFRGLHALTDRGLHVLAFRGLHALTFRGRCTSSPSEGYAPSPSED

SEQ ID NO: 108722 - protein, 57 aa, Glycine max
  Coding DNA Sequence Number=SeqID_17037
MAKFDPEIVLEFYANAWPTEEGVRDMRSWSQGFASFSCPTPDQFRAEVAWPGDWPEA

SEQ ID NO: 108723 - protein, 135 aa, Glycine max
  Coding DNA Sequence Number=SeqID_17038
  Subcellular localization annotation: CTP_CleavageSite=35; ConfidenceScore=5.31e-01
MHTQSFTIPQFPKIGLTHKNSPQWSRQLSQHARLRGCAFQGRKDARSHHQRLFVENVGKTEGNRSERKFQVRELYLRLRKVDKSGALAPTYPPSKRKSDLRSSSLRVNQAILFTWKVIILRRWTLKMIHLLGKKN

SEQ ID NO: 108724 - protein, 189 aa, Glycine max
  Coding DNA Sequence Number=SeqID_17039
  Gene Ontology: Mol. function=nucleic acid binding
  Homolog annotation: Hit_ID=A5BD12; Match level="QueryCoverage=96%, HitCoverage=26%, E-value=1e-15, Identity=28%"; Hit description =Putative uncharacterized protein
MTTNLSKCINKVLKDCRNIPITALVKSMYSRCRKYFVEHWQVYCSKLVKELRNNQEQACSHIVRVYDIHSTRFEVEETFNPITQCGRQKWAVNLNGHYCQCGSLWLPYSAQWWPLGNEAAIPPSNDTWTLIPDPTTIRVKGRPKSTRIRNEMDWVEPSEHRQKCSRCGAEGNNRRRCPMQSERDSCSIH

SEQ ID NO: 108725 - protein, 51 aa, Glycine max
  Coding DNA Sequence Number=SeqID_17040
YVFKGEKGILNVVKDSIIVMRGIMKNGLYYVDGEVVIGSAATATGRVFIKN

SEQ ID NO: 108726 - protein, 35 aa, Glycine max
  Coding DNA Sequence Number=SeqID_17041
MSWNFADYLTMDVKYLKAVKRRLHDIKRWSPDEIR

SEQ ID NO: 108727 - protein, 225 aa, Glycine max
  Coding DNA Sequence Number=SeqID_17042
  Gene Ontology: Mol. function=motor activity; Cellular component=cell projection
  Homolog annotation: Hit_ID=UPI00006A2D9E; Match level="QueryCoverage =94%, HitCoverage=98%, E-value=3e-13, Identity=16%"; Hit description =UPI00006A2D9E related cluster
MHTLTFRGLQVLAFRGLHVLAFRGLHTLAFRGLHVFAFIGLPVLVFRGLHVLSFRGLHVLAFRGPHTHTFRGLDVLAFRGLHAQAFRGLHVLAFRGLHVLAFRGLLALTFRGLHVLEFRGLHVLAFRGLHALAFRGLHTLTFGGYTPSPSKDYTSSPLEDYTSSPLEAARHRLQRLLHVLAFRGLHVLAFRGLHVLAFRGLHAFAFRGFHVLAIRGLHALIPSED

SEQ ID NO: 108728 - protein, 224 aa, Glycine max
  Coding DNA Sequence Number=SeqID_17043
  Homolog annotation: Hit_ID=Q5QJQ3; Match level="QueryCoverage=42%, HitCoverage=74%, E-value=2e-51, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTLMSRSRAPSSRWTNLGTELEFVIMVIAVSCSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPGNYRLESNP

SEQ ID NO: 108729 - protein, 164 aa, Glycine max
  Coding DNA Sequence Number=SeqID_17044
MWAFLTGRQIDWAHLVRYRMHKALWANAPLPYPQLVTLFLRHFQIPLDDEPFVQVKCSFAIGVGVVTSFGYRKDRNGQWLKKDALPPQVERTPSPPPQRDDSTLMTEVLSELRGLRTYVGDRFDSLDNRFAGMDIRLTQLEEDVGYIRQSFDLPCRAKHVHLSC

SEQ ID NO: 108730 - protein, 109 aa, Glycine max
  Coding DNA Sequence Number=SeqID_17045
MVRNHLLKELANFSEDYIKLFGGTEIFEELRMSLLVDGLIKVTTDEWMDITDMGHVYLKERCPLPSASLLWSSNCHPHAKLRPNPYISRMQHYKSFVMFKRDYVDINDD

SEQ ID NO: 108731 - protein, 186 aa, Glycine max
  Coding DNA Sequence Number=SeqID_17046
  Homolog annotation: Hit_ID=Q9ZTB2; Match level="QueryCoverage=26%, HitCoverage=10%, E-value=3e-21, Identity=100%"; Hit description =Nodulin
MTVKTSDTCSSRRRSQLVCKRMPGADKPVRARQRMRKEKIPHQAPFAIQAAQLLGRAIGAGLFAITPAGERGMCCKAIKLELSIKMYKVANASEYLVITGVGITDIKLAKKAWVLPGQSCTVFDLSPVNYTFEVQGRETCRASCINESANARGEAVCVLGALPLPRSLTRCARSFGCGERYQLTQR

SEQ ID NO: 108732 - protein, 64 aa, Glycine max
  Coding DNA Sequence Number=SeqID_17047
MWDVYLEAYLNGAHWQMVVILPKENVVIWFFSLHNRSDNYLKGIINSALKGLKDTPQSKSKAAA

SEQ ID NO: 108733 - protein, 266 aa, Glycine max
  Coding DNA Sequence Number=SeqID_17048
  Homolog annotation: Hit_ID=Q6WAY6; Match level="QueryCoverage=37%, HitCoverage=18%, E-value=3e-10, Identity=35%"; Hit description =Putative uncharacterized protein
AINWFPRWKEGKEGVLFSSGDYPNVPLLGTRGCINYNPALAIRQLGYPMRGAPTEESLSPLLVRDLGAQSLKVIQRVHNAWRSPLRKDKELRGIRNGVIGGYHGWLRVHTRGLDWLSKLKVVDEENFEAPEEIEEVRALKLELGKARLAKEKFKSAATHIRKECTELQEENATTARALEQETKRARKEEHGREKFRGALSKRSLAQHLEAMEQSMLAIIGQYKEELNQSVTHEQKLVEDFSQVYAVKEARGRVIDALHQEATMWMD

SEQ ID NO: 108734 - protein, 192 aa, Glycine max
  Coding DNA Sequence Number=SeqID_17049
MTDLVSAEDDVNLRVSTGLSAAIDEGHRRRHSKKNVYTDNHPGISARQRDSKVSMTDLVSTEDDVNLCVSTGLSATIDEGHRRRHSKKNVYTDNHPGISARQRDSKVSMTDLVSAEDDVNLRVSTGLSVAIDEGRRRRHSKKGFERADNHIGYLRMSRDSSASMTELVRVADKSEALAPTYPPMRNSDLRSS

SEQ ID NO: 108735 - protein, 108 aa, Glycine max
  Coding DNA Sequence Number=SeqID_17050
MDQLKCLSTPYKCLDSLITLVTLVWAIRQGQCTLPPMTYTPYDVCSWPKASAKDPGSMQQGQANILIARFLTLTMVLKRFSKGSIRHAMAVPKSEKMQRQDETNKKQA

SEQ ID NO: 108736 - protein, 91 aa, Glycine max
  Coding DNA Sequence Number=SeqID_17051
  Gene Ontology: Mol. function=nucleic acid binding; Cellular component= intracellular
  Homolog annotation: Hit_ID=A7P8Q3; Match level="QueryCoverage=46%, HitCoverage=4%, E-value=3e-11, Identity=73%"; Hit description =Chromosome chr3 scaffold_8, whole genome shotgun sequence
MKQRSSNEIIRKKVYVCPQASCVHHDPSRAMVADHASIMPMIYLLPTAYMDAGSGIALKNFKRVQKAWGQGSISSLQPQQNDFLDYYDGSG

SEQ ID NO: 108737 - protein, 133 aa, Glycine max
  Coding DNA Sequence Number=SeqID_17052
MYQVSMSLALGALLYKVQAIRLKGWPIVVTPENPGSHGGLLPPVNILFLRRWVWALLNRQLWQSTISQSFAKPSYWLKEDELSSSLSAPLQVIKRTTSAHPLSKTSALSQNPLMRAKRSRSVLSARARTRPPI

SEQ ID NO: 108738 - protein, 193 aa, Glycine max
  Coding DNA Sequence Number=SeqID_17053
MGNEEGVQEQMKADMSALKDQMASMTEAMLKIQKSIEDNPTAAASNTTREAEPVLQPAMNSCRDRSAVGFNRRYSPQAYPYGLPPDFTPRTAPDDLSQAPTFEGQLPPHADYPLPSTSLKGIGPHELPQPNIISHAPSQFAPVKEPVPISKDKGKIDLLEERLREVEGLDNYPFSDLTDLCLVPDIIIPPKFK

SEQ ID NO: 108739 - protein, 60 aa, Glycine max
  Coding DNA Sequence Number=SeqID_17054
MGLNQFRFFNMVHDILVKVKLEVTRTSTVLNVFGSRRSSDVYDPNMRKMQGSRMSEHENK

SEQ ID NO: 108740 - protein, 39 aa, Glycine max
  Coding DNA Sequence Number=SeqID_17055
MSHGRLYQQRMKNAFDKKGQNQLAVVRCQDEVGGRNPSR

SEQ ID NO: 108741 - protein, 135 aa, Glycine max
  Coding DNA Sequence Number=SeqID_17056
  Subcellular localization annotation: CTP_CleavageSite=69; ConfidenceScore=5.03e-01
MKRARMKEKPMPRLPFLHGNFPPAKQCHYSANISPSHYPPPSHPQRPSLNQPQSLSTTLPITNTTFRTNQNTNEGRNFAVKKPIEFSLIPVSYDDLLPYPLDNSMIAITPTKVPQPPFFQEYDSNATCALSIVGP

SEQ ID NO: 108742 - protein, 175 aa, Glycine max
  Coding DNA Sequence Number=SeqID_17057
  Subcellular localization annotation: CTP_CleavageSite=11; ConfidenceScore=5.16e-01
MWSSAPFPEMSASFGGDFFKSHKLSRTTDKIWSFCTLLSSRGGGPDDTRRQNLVIPHPFAIQTQSCPMARRDKIWSFCTLLSSRGGGPDDTRRQNLVIPHPFAIQTQSCPMARRDKIWSFCTLLSSRGGRPDDMRRQNLVIPHPFAIQTQSCPMTRRDKIWSFCTLFVIQRRRTR

SEQ ID NO: 108743 - protein, 41 aa, Glycine max
  Coding DNA Sequence Number=SeqID_17058
MRRNWVANLVLKFHDDPAVNKSEIVIFRRQVWWAARKKKGF

SEQ ID NO: 108744 - protein, 168 aa, Glycine max
  Coding DNA Sequence Number=SeqID_17059
  Homolog annotation: Hit_ID=Q2HSX6; Match level="QueryCoverage=100%, HitCoverage=55%, E-value=1e-49, Identity=56%"; Hit description =Cyclin-like F-box
MDLTRMSEVCTFLRDRCRSDPLWELHMKQKWGGVIGDVAYKEWLWHITTPKEKGINQLNQHNNQNGSMGPFSGTWPMLYLRSYLEDCSYLNSSSLANSFMMALYFSLENGNFWFPAQIYRGLYFRDALVRYDSKTDNFQARLENNWGTTSNGIKLRAPPVDTLPSVRY

SEQ ID NO: 108745 - protein, 219 aa, Glycine max
  Coding DNA Sequence Number=SeqID_17060
  Gene Ontology: Mol. function=DNA binding; Biological process =regulation of transcription
  Homolog annotation: Hit_ID=Q5IR72; Match level="QueryCoverage=43%, HitCoverage=70%, E-value=2e-26, Identity=51%"; Hit description=Zinc finger homeodomain protein SZF-HD1
  Pfam annotation: Domain name=ZF-HD_dimer; Domain location=106-161; Score=92.3; E_value=1.5e-24; Accession=PF04770.3; Description=ZF-HD protein dimerisation region
MTVKTSDTCSSRRRSQLVCKRMPGADKPVRARQRMRKEKIPHQAPFAIQAAQLLGRAIGAGLFAITPAGERGMCCKAIKLGNARLGYLERERMEGGSGGGEREKWNSVSVYRECLRNHAASLGSYATDGCGEFTVDGAGGLQCAACGCHRNFHRKVKYPVAEHEEYGGKKRFRSKFTADQKEKMLGFAEKLGWKLQRKDLNDEIEGTELEFVIMVIAVS

SEQ ID NO: 108746 - protein, 128 aa, Glycine max
  Coding DNA Sequence Number=SeqID_17061
  Subcellular localization annotation: CTP_CleavageSite=33; ConfidenceScore=5.26e-01
MASIIVAIFSIMASMSAFIFSCTFSTSPITLALAQRKTQGSGMSKHVEQKERYVHYDAEEMFMRCMIWIVLLAHLGAKCPMCAIKKTIWIFRLPSTKDETHIQRMCDGIMQMRKSATGGFTQHGNILK

SEQ ID NO: 108747 - protein, 280 aa, Glycine max
  Coding DNA Sequence Number=SeqID_17062
  Homolog annotation: Hit_ID=Q2HW90; Match level="QueryCoverage=90%, HitCoverage=55%, E-value=1e-20, Identity=27%"; Hit description =Putative uncharacterized protein
VKSLGITSLKELGQLMGQLQRQPFRKAYGKIWDLAMVEVSAEAIASLAQYYYLSLRCFTFGDFQLSPMVEEFEEILGCPLGGRRPYLFSGFYPSLARISKIVQISAQELDHRKQVENGVVGIPRKYLEAKARILAAIDAFLAYHNHKESPVVAMLADLYDTFDQRCEKSSTRIVCCTPTLYVWLVLHLFRQEVRHACPLESHRSCTEKGGANWDQLLANKEGVSVNWFPRWKEGGTGVLISCGGFPNVPLMGTRGAPLEEELTPVISRGFNKTNMETLQK

SEQ ID NO: 108748 - protein, 119 aa, Glycine max
  Coding DNA Sequence Number=SeqID_17063
IAEGKAAISSFHQLSDESLSEALERFRSLLRKTPTHGFSDASSIGACRPRIFFINGFLCFLEDEWQRNGERKRERRRHFKEKMSLEEAHHHRRPWIRAWRKKEMNEGRGREEHEILCSK

SEQ ID NO: 108749 - protein, 132 aa, Glycine max
  Coding DNA Sequence Number=SeqID_17064
  Homolog annotation: Hit_ID=A6FJQ2; Match level="QueryCoverage=28%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLIPTYCALKDDGYDIVYQRIPLTTERHVLASAVDATQYCQHE

SEQ ID NO: 108750 - protein, 86 aa, Glycine max
  Coding DNA Sequence Number=SeqID_17065
MTDLVSAEDDVNLRVSTGLSAAIDEGRRMTIICLCVPSDTTVSKGKKVCGMTTICLRMSLGSPPLDDKRAQNDHNLSLRAIGHNCA

SEQ ID NO: 108751 - protein, 195 aa, Glycine max
  Coding DNA Sequence Number=SeqID_17066
  Homolog annotation: Hit_ID=Q5QJQ3; Match level="QueryCoverage=15%, HitCoverage=24%, E-value=4e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPAFFRNSSPILLEFSIKYPWGRETCRASCINESANARGEAVCVLGALPLPRSLTRCARSFGCGERYQLTQRRSFAPSWAVCTNPPFSPTAAPYPVTIVLSPT

SEQ ID NO: 108752 - protein, 69 aa, Glycine max
  Coding DNA Sequence Number=SeqID_17067
MTENKRGYISYGSVLVEGTSTRLFKENKGGHIPCGSLLIKQVNNTRELLTQFGATSPTSGGYQAREEIH

SEQ ID NO: 108753 - protein, 185 aa, Glycine max
  Coding DNA Sequence Number=SeqID_17068
MVIDQSLFFELTQLSSDGVPFEGTLDDEWKFDFSVSDARRMVCTNQADMTGRFFAGSLAFKCRIMHYLIVRILLPRSSNLAQVSEEDLIILWIFLTGRQIDWAHLAAEDRSPSPHCQRDDSSSLMHNILDRLDGLHTFVGERFDSLDSRIEAMDARFAGMDTHITKLEEDASFVRQCFDLPTPSS

SEQ ID NO: 108754 - protein, 87 aa, Glycine max
  Coding DNA Sequence Number=SeqID_17069
NKKNANNLTFRKLLRPIPEEVLLENSLPEVTEPIPEEVFPENTFGSTSSGMGLNNFRKKVFRKLPIPEAVLPEVFSGRTSSGIGLSA

SEQ ID NO: 108755 - protein, 68 aa, Glycine max
  Coding DNA Sequence Number=SeqID_17070
  Subcellular localization annotation: CTP_CleavageSite=27; ConfidenceScore=5.02e-01
MVQPKPSTGLKGKSLQHALTFMPSRIQKSKAWVPRPKHFTEHLVVALLGINNKGIGAMWLAPSFQNTT

SEQ ID NO: 108756 - protein, 128 aa, Glycine max
  Coding DNA Sequence Number=SeqID_17071
MGCYSNTQWLSARKNPKEDELYRFAERITPGHQAHCFSSSAKREMRATSKITNSLDWDSELCMSRVSRERKVQVPESFERFCCVKICRDQSLKQEPASWYGKLNPLLDLPCRVIQQWNWSDSKVLDSA

SEQ ID NO: 108757 - protein, 315 aa, Glycine max
  Coding DNA Sequence Number=SeqID_17072
  Gene Ontology: Mol. function=motor activity; Cellular component=cell projection
  Homolog annotation: Hit_ID=UPI00016621D1; Match level="QueryCoverage =75%, HitCoverage=40%, E-value=3e-18, Identity=32%"; Hit description =UPI00016621D1 related cluster
MAVPKDSFSTETESQVGDFVTFIGLHTRTFRGLHVHAFRGLHVLMFIGLHALAYRGLHVLACRGLHALAIIGLHALAFRGLHVVTFRGLDALAFRGLHVIAFRGLHVQSIRGLHILTFRGLHVLTFRGLHLIALRGLHVLTFRGLHALGFKGLHALTFRGLHILAFRGLHVLTFRGLHRAARLRLQGLCVLTFIGLHTLTFIGLHVIGFRGLHALAFRGQGLHVLAYRGLHVLPFRGLHVLAFRAQHVLAFRGLHVLAFKGLHVLTFRGLQVLAFRGLHILTFRGLHALTFRALHILAFKWLHALSFRGLHVLAF

SEQ ID NO: 108758 - protein, 204 aa, Glycine max
  Coding DNA Sequence Number=SeqID_17073
METCPMTEELLQGMMEKGLIEVCSARKGEGDVCMQSVDKRPSKPKPLVNHFTKDVAAQKPQGFQSVPVKKPVPFPYKSDKAVPWRYATQGPEGRKDAFVVHVKDDLSSAKVTNISRTSGMTRSERIFATPEPPVRSKDLKGKVKANVVESDKVNGEVPFGRCHTLISSGDDHWQKFGFLPAKLSCLTPVTMHSVRFFDVSEGNV

SEQ ID NO: 108759 - protein, 373 aa, Glycine max
  Coding DNA Sequence Number=SeqID_17074
MGEIEEGQERRKADMQAMKEKMATMMEAMMSIKRIMEVNAAAVAATSAIVEVDPTPPSSLNQINHLTSDVVGQEGKELGSIGDPHFVQVQNTHAFPPYGLPPNYTTPNVAHTPNENVNNSTTILVESRQPQSNHAHVSQPMGETHEIPHHNLADFEPCIGCATEGQAIGGVPLSNTLEGPRFCPQPQPFYFAVGRVPPAMAENGKLDQIEERLRAVEGGEDYAFADMEDLCLVPDKAKGLHVLTFRGLHILTFKGLHALAFIGLHTLAFRGLHVLIIRGLHILAIRGLHILAFRGLHDLTFKGLHVLAFRRLRVLTFKGLHALAFIGLHLLALRALHALAFIRLHTFAFRGLHILAFRGLNALAFIELHALTF

SEQ ID NO: 108760 - protein, 107 aa, Glycine max
  Coding DNA Sequence Number=SeqID_17075
  Subcellular localization annotation: CTP_CleavageSite=60; ConfidenceScore=5.45e-01
MTPTRHPMDPDKSNRALGFPTLITGLYQSFGVPVTPSKMSLSLQSQGFTSFPCPTPDQFRAEVAWPGDWPEAQVGEAPAEAPDEADEAREDEEMTDLLDFLGGSGAT

SEQ ID NO: 108761 - protein, 129 aa, Glycine max
  Coding DNA Sequence Number=SeqID_17076
MAYTHIPVKVENPGESLETSNNSFQNCPIQHQLDLAPYTSEPYHAQWNASGLLRDKHTLRLSRILGEMEVDEPWLGLWLPLNYQAFSLQNSLLGWCLRFVLKVVFVIGSAVERLCGRFRDGFCGYLGGG

SEQ ID NO: 108762 - protein, 127 aa, Glycine max
  Coding DNA Sequence Number=SeqID_17077
MTRGNPSDLQPFDPEIDRKFHRLVRHHFIPFDHPEHSITGESVHYVIGDFEHPDFEHYNFEHSDSEHSDFEHSENMAQPPPRERTLREIAAPDFTYESLCIQYPDEDVPYVLKTGLIHLLPSFMALQ

SEQ ID NO: 108763 - protein, 173 aa, Glycine max
  Coding DNA Sequence Number=SeqID_17078
  Subcellular localization annotation: CTP_CleavageSite=41; ConfidenceScore=5.31e-01
MAESSKKRKGSSSTAAAAAHRRHGPSEAPTAPIHPSLSSPRSSTLFSSYDQRLRYLSQFSSRIILDPKYLDIDFFNDETFDCYQVFQNSGLVDFMSFKLPYYPELVKVFYCNLTIQDDILSSEVHGIPMIIDQSLFFSLTKLPSQGAPFEGTIVDDWKFDYSSHDARRMVCND

SEQ ID NO: 108764 - protein, 121 aa, Glycine max
  Coding DNA Sequence Number=SeqID_17079
  Homolog annotation: Hit_ID=P03851; Match level="QueryCoverage=66%, HitCoverage=95%, E-value=4e-40, Identity=95%"; Hit description =Uncharacterized 9.4 kDa protein
MARLGTVKRPRCWRFSIGSAPLTSITKIDAQVVRSKLGCVHEPPVQPDRCALSGNYRLESNPVRHDLSPLAAATGNRISRARYVGGATEFLKWWPNYGYTRRTVFGICALLKPVTLRKKSW

SEQ ID NO: 108765 - protein, 173 aa, Glycine max
  Coding DNA Sequence Number=SeqID_17080
MSYADLLPYLLDNSMVAITPTKVHQPPFLREYDSNATCACHGEAPGHSIEHCRALKRKVQGFSNFHWNWVQAIGLFAQATCAPEFGLPRPFNQRLLVLHVGGAAVRQQRSELSRIGCWTNGLSYLKKKKGVELRYKDYSPIKLSLSLYGLTMHTGTTLPLCSGILYNKRLTVS

SEQ ID NO: 108766 - protein, 112 aa, Glycine max
  Coding DNA Sequence Number=SeqID_17081
  Subcellular localization annotation: CTP_CleavageSite=21; ConfidenceScore=5.06e-01
MVFDGYGVSKDMIFISANQVVTSLKEYCRNMPFCERARRGSRMRFPKKERCAESPPTFICGKRRKNRRKPVKMKILSSGVVFTFEEGISTSHVDKSGAFAPTYPPSKRKSDL

SEQ ID NO: 108767 - protein, 152 aa, Glycine max
  Coding DNA Sequence Number=SeqID_17082
  Homolog annotation: Hit_ID=UPI0000ECBAF8; Match level="QueryCoverage =26%, HitCoverage=48%, E-value=1e-16, Identity=100%"; Hit description= UPI0000ECBAF8 related cluster
RKRKSAQYANRLSPRVGRFINAAGTTGFPTGKRADAIAQLLCILGSQLAAWRRVRIMHTSMTIYQFAGTTPMRHPMDPERSNRNDRPLPILRSARRPQQGMQAWHWPSFYNVVTGKTLALPNLIALQHIPLSPAGVIAKRPAPIALPNSCAA

SEQ ID NO: 108768 - protein, 94 aa, Glycine max
  Coding DNA Sequence Number=SeqID_17083
MGSKIYPKVHENPRAFFSSSSPSLLESSIQYPWGVGLHHPLQLGKDLTSNPESMVSSENPFHGHLPMKDMVPHQLNEWCYKYRKIWDKPYVKVC

SEQ ID NO: 108769 - protein, 276 aa, Glycine max
  Coding DNA Sequence Number=SeqID_17084
  Gene Ontology: Mol. function=dihydrolipoyllysine-residue acetyltransferase activity; Cellular component=pyruvate dehydrogenase complex; Biological process=metabolic process
  Homolog annotation: Hit_ID=A8GJ15; Match level="QueryCoverage=100%, HitCoverage=66%, E-value=1e-81, Identity=64%"; Hit description =Pyruvate dehydrogenase complex dihydrolipoamide acetyltransferase
  Pfam annotation: Domain name=Biotin_lipoyl; Domain location=61-132; Score=102.5; E_value=1.3e-27; Accession=PF00364.13; Description =Biotin-requiring enzyme
  Pfam annotation: Domain name=E3_binding; Domain location=180-218; Score=72.2; E_value=1.7e-18; Accession=PF02817.8; Description=e3 binding domain
  Pfam module annotation: Pfam domain module=Biotin_lipoyl::E3_binding; Domain location=61-132::180-218
MEVPAPFAGVVKEIKIATGDKVNTGSLIMIFEAEGAAPAAAAKPAVKEAAASAPAAAAGAKDVNVPDIGGDEVEVTEVLVKVGDKVEAEQSLIVVEGDKASMEVPAPFAGTVKALKVATGDKVSTGSLIMVFEVEGAAPAAAAPAAKQEAAPAAEAKPAAAPAPAAAKADAKSEFAENDAYVHATPVIRRLAREFGVNLAKVKGTGRKGRILKEDVQAYVKDAVKRAEAAPAAAAGGGIPGMLPWPKVDFSKFGEIEEVELGRIQKISGANLSRNW

SEQ ID NO: 108770 - protein, 102 aa, Glycine max
  Coding DNA Sequence Number=SeqID_17085
MQQGQAVILIARFPDPNYGVKTGSSRCGVSTEKNDSLWWLMVAVGDVESAWDVRNGFGRKKEKKMMFFLSYLDYKAQNAQAKFREDPTVNEGWTTFLLRQLH

SEQ ID NO: 108771 - protein, 72 aa, Glycine max
  Coding DNA Sequence Number=SeqID_17086
DGLRPVLYSEAMGHATLPPFSCYSCLNKRPPSARRNAPMTYEYDLEPKLLASMQGNILMAKNLNFGFGSGKA

SEQ ID NO: 108772 - protein, 53 aa, Glycine max
  Coding DNA Sequence Number=SeqID_17087
  Homolog annotation: Hit_ID=Q2HW89; Match level="QueryCoverage=62%, HitCoverage=3%, E-value=3e-08, Identity=81%"; Hit description =Integrase, catalytic region; Ribonuclease H
MKQASTEGRPRVFKKEILCSRRTFSGGALTLTTMDGDELPRPVNADAVKKYFV

SEQ ID NO: 108773 - protein, 127 aa, Glycine max
  Coding DNA Sequence Number=SeqID_17088
  Homolog annotation: Hit_ID=O23282; Match level="QueryCoverage=45%, HitCoverage=11%, E-value=2e-17, Identity=81%"; Hit description =Putative uncharacterized protein
DAGSRQARQGASAGVGGCRGWLNYAASEQIVLRVHHMRAIGAGLFAITPAGERGMCCKAIKLGNARVFPVTTLSTLEDPLLGHNHALFRRAQLKALGSIHSQEAGKGGELTHDEATIISGALDLTEK

SEQ ID NO: 108774 - protein, 73 aa, Glycine max
  Coding DNA Sequence Number=SeqID_17089
NVWSAWASSILEGRSRLLLLLLRAGPSEIRVIPPSRIVSVAGEAAQLLQVAAWKGKGLYGGQQRSTNHKPLRQ

SEQ ID NO: 108775 - protein, 28 aa, Glycine max
  Coding DNA Sequence Number=SeqID_17090
MNRIDPKIRMNTSGVFQYGPTVPGITIL

SEQ ID NO: 108776 - protein, 248 aa, Glycine max
  Coding DNA Sequence Number=SeqID_17091
MPADRQSRLRGIPMGNVQAEMKSLQCFSVLSGSTDECSDRPDTRAGWHHQRRHLRAAGLVHPAGLYRYPRAVHPPGRVRRLRRAHHGRAAGRQAGAAGVAAAGVRAGRGRGRSDGARQTAGTPRAAVAHRRQGGVSAAAGRAVLPPAAGAAADGRAGAADAAAGGADGPAAVPPVLPADRLGLDAGAADRVDRRTPGAGRPGPAGLWRRGRAHRAVQGRQPGAGPGQRQQPGAVGGGGVGAADRGAVP

SEQ ID NO: 108777 - protein, 303 aa, Glycine max
  Coding DNA Sequence Number=SeqID_17092
  Gene Ontology: Mol. function=transferase activity, transferring phosphorus-containing groups; Cellular component=membrane; Biological process=two-component signal transduction system (phosphorelay)
  Homolog annotation: Hit_ID=A9CH46; Match level="QueryCoverage=100%, HitCoverage=57%, E-value=1e-124, Identity=77%"; Hit description =Sensor protein
  Pfam annotation: Domain name=HisKA; Domain location=141-211; Score =48.2; E_value=2.9e-11; Accession=PF00512.16; Description=His Kinase A (phosphoacceptor) domain
MGLKQQGVTDMRAHARANPGFTQQCIDLITVVASNEAGKEMLGYDSSLRGTLQRSIVSSSGKFVDVLQAIIDNRRVFEDKVVVRTESGEDKLVLLSISFPAEAAAFNRVVVSMVDITQREMALKALAEAQAELTKASKAAAVGAMSASLSHELNQPLGAIIVNAQTLLRWLDRDPPDLAAARRSAERMIRDGQRASDIIQNTRSQLAHTSGKTETFDLDEFIDETLSLLEHELERSGTAVHVDKQATPPITAVRIELQQVLINLLTNAIQAMEEAGSTNRTITVRKEREDGHNIHIAVHDNGP

SEQ ID NO: 108778 - protein, 197 aa, Glycine max
  Coding DNA Sequence Number=SeqID_17093
ASAPVTVARVYGLCSSADHHTDLCPSLQQSRVNEQPEAYAANIYNRPPQQQNQQQQNNYDLSRNRYNPGWRNHPNLRWANPPQQQQQSVPPFQNAVGPSRPYVPPPMQQQHQRQQATEAPSQPSLEELNPKNVSAITLRSGKQIEVPPPVAAPAPEPVKLHSTPEKEDELASQKRKLPDHEGANKNFHASGPSSIST

SEQ ID NO: 108779 - protein, 100 aa, Glycine max
  Coding DNA Sequence Number=SeqID_17094
MCMISLRLLAFNEYGSGVIDILTGSVCHIGWCIVGRQAIWSTSTMVLVAAIATTLTSIISFMLIMTSIILAICSFKAFVSAFICSYTSSTSPITLALARV

SEQ ID NO: 108780 - protein, 115 aa, Glycine max
  Coding DNA Sequence Number=SeqID_17095
MPAEPSHMNRKGSFLIGASVIASFGYQKEHDGSWVKKGARHVGEEGRDGEDSSLLSKILDRFDGLQTFVGERFDTLELQVDMRFNEMESRITKVEEDVSYIRSSFDLPPPPPPSF

SEQ ID NO: 108781 - protein, 120 aa, Glycine max
  Coding DNA Sequence Number=SeqID_17096
  Subcellular localization annotation: CTP_CleavageSite=53; ConfidenceScore=5.11e-01
MYPPLFSLNNLVDVPSTRTDPQEMYPLLLSVTTTQVDVPSTCTTKDVPSNVLRQSSQAGMGRIKRILKLCHFEFFDKGEGRHKRIQAISPLFFWKREKRDTKRIQAVSPWRILFGKGIRE

SEQ ID NO: 108782 - protein, 64 aa, Glycine max
  Coding DNA Sequence Number=SeqID_17097
MGKQNSNDNIVYDATIKENRVDDHGDDKEGGIGVVGASDGPWWRWPAAVVMEDVPFHFFDDSTI

SEQ ID NO: 108783 - protein, 67 aa, Glycine max
  Coding DNA Sequence Number=SeqID_17098
  Subcellular localization annotation: CTP_CleavageSite=54; ConfidenceScore=5.59e-01
MAPKKLSTKRSRRDATAEGSVSPPSLIVIVSGAPSTSSVSRPSKDGRSTERGVSSSGRMSIRTFRRR

SEQ ID NO: 108784 - protein, 88 aa, Glycine max
  Coding DNA Sequence Number=SeqID_17099
  Homolog annotation: Hit_ID=A6FJQ2; Match level="QueryCoverage=43%, HitCoverage=84%, E-value=3e-11, Identity=92%"; Hit description=50S ribosomal protein L5
MTVKPLTHAAPGDGHSLSVTGCREQTSPSGRMRKEKIPHQAPFAIQAAQLLGRAIGAGLFAITPAGERGMCCKAIKLGNARVFPVTTL

SEQ ID NO: 108785 - protein, 131 aa, Glycine max
  Coding DNA Sequence Number=SeqID_17100
MSHSSSSLPPEELQQLTQQIRDQLEESIKEKVTRQLMASFSQMQSQFQSQMQSQGLALPPKHLVGPSGNNPKMGDSDRCGLYTEANPARLVALGRVYEGSTVVHNTPLLPCQVKVGVEELKIQMLSVPVST

SEQ ID NO: 108786 - protein, 42 aa, Glycine max
  Coding DNA Sequence Number=SeqID_17101
MKEVVKGSKRVTMDTNARSMAAEWRRRKGDWRGHFKEKMSLE

SEQ ID NO: 108787 - protein, 158 aa, Glycine max
  Coding DNA Sequence Number=SeqID_17102
  Gene Ontology: Mol. function=RNA-directed RNA polymerase activity; Cellular component=mitochondrion; Biological process=RNA-dependent DNA replication
  Homolog annotation: Hit_ID=P92567; Match level="QueryCoverage=58%, HitCoverage=46%, E-value=2e-27, Identity=63%"; Hit description =Uncharacterized mitochondrial protein AtMg01410
MTSRVLPIGGLLCFCLKGLRYCLTGTNVFEVPFVKRALSQVSFVTGQPLGYYGYWPLFAFTHHVLVWWAAEQVRPGILFDRYAILGDDVLITDPLVAEQYRLGLQRLGVKISTHKSLISSTGAVEFAKQFLVKDMRVNLSPVSMKALCGFHHPHGYYF

SEQ ID NO: 108788 - protein, 47 aa, Glycine max
  Coding DNA Sequence Number=SeqID_17103
MWRSNWFLEVSIVYIESFITQLTDADQVCSQSLYQQYFVQTRKSIMD

SEQ ID NO: 108789 - protein, 74 aa, Glycine max
  Coding DNA Sequence Number=SeqID_17104
MTRGIHILAYRGLHVLAFRKLHALVFRGIRVLNFKGLHALAFEGLHTLAFRGLHVVAFRGLHVLAFTELHILAL

SEQ ID NO: 108790 - protein, 69 aa, Glycine max
  Coding DNA Sequence Number=SeqID_17105
MDCPLWMLWSMECNICGVNEKSEGGMTGAEEGGISEDGGASDLFPLALRGPLKVTERSSSVVRFFKIST

SEQ ID NO: 108791 - protein, 103 aa, Glycine max
  Coding DNA Sequence Number=SeqID_17106
GTIVHILNIIPKEEKRIEGLKRLTLAFHISTEKIMLRPTYIEKRRLNNSLLAIILAKREKFHWLPLAFKVEYWNDLKSALRKRHIPSYYERELMDKLQRHRQG

SEQ ID NO: 108792 - protein, 22 aa, Glycine max
  Coding DNA Sequence Number=SeqID_17107
MAAAKPQRTPQEVGTELEFVIM

SEQ ID NO: 108793 - protein, 114 aa, Glycine max
  Coding DNA Sequence Number=SeqID_17108
MKDKRDEEEKIEKQKKKKDSKALSSKAKGKEKEGKDSSKKIVKKGVQIATRPTWAFQEVLQKAVPSRGSNLARLGELGGKLLPHFPINRRRREEQKCSTLLIFRHSSSFFGLQP

SEQ ID NO: 108794 - protein, 116 aa, Glycine max
  Coding DNA Sequence Number=SeqID_17109
NVRSENSFPGHLPMKEHGSSLSYPNFVRGPLLDDVRPLLGPCKKAVPSGGSNPARLGELGGKHLPYFAINRGGSEKEKAEALPKRFCNIFREEFRKGFDRSSTFFIRSSSFFDLQR

SEQ ID NO: 108795 - protein, 166 aa, Glycine max
  Coding DNA Sequence Number=SeqID_17110
MQMANRDRGGGHRTFNRGRRRGLILGAPITTNPSTSSIHISTLESMIHVIAPTPNTLPTARDQPNPTFVRESIPTTPIRDASPSAPDDSLTPEYPPDPNFEHIVDQRPFIRAYKGEEKFDEPTTNWLKVSVDLCDRWFGEFKKDYSGTQKKSEPLELFLRQKVHAF

SEQ ID NO: 108796 - protein, 143 aa, Glycine max
  Coding DNA Sequence Number=SeqID_17111
MNGEVASSKWIMDKDTLGCSGQRDSWDLGELASDDSFGMGMFTDLTLLFLIGSHIILFELGAWGSVYDVSERRTYPYNQQLLGLGDVNEVVPLRAWCSSFYLGMEVPHDAQEFEMTPVRRSHIDMTPDEEEVYRELLRSRAFI

SEQ ID NO: 108797 - protein, 107 aa, Glycine max
  Coding DNA Sequence Number=SeqID_17112
MVERPTSSFRANTEKNPKEECKAVLTRSQRRTGKKEEKEKEEEKKVLTFKTKSQLAREARKEEPPTPLKELSYPLVPLKKNKECYFKRFLEIFKGFEITMPFGEALQ

SEQ ID NO: 108798 - protein, 81 aa, Glycine max
  Coding DNA Sequence Number=SeqID_17113
  Gene Ontology: Mol. function=transferase activity; Biological process= biosynthetic process
  Homolog annotation: Hit_ID=Q0GN93; Match level="QueryCoverage=69%, HitCoverage=11%, E-value=5e-10, Identity=53%"; Hit description =Plastid 3-keto-acyl-ACP synthase II
  Pfam annotation: Domain name=Ketoacyl-synt_C; Domain location=3-48; Score=-21.1; E_value=0.00044; Accession=PF02801.13; Description=Beta- ketoacyl synthase, C-terminal do
MNVNFNKLRVNSTKSMIGHLLGAAGGVEAVATIQAIKTGWVHPNINLENPDEGVNNQTMYWILTLLLWLNKNDYRGDCFLG

SEQ ID NO: 108799 - protein, 338 aa, Glycine max
  Coding DNA Sequence Number=SeqID_17114
  Pfam annotation: Domain name=DUF1249; Domain location=156-270; Score=- 48.2; E_value=0.1; Accession=PF06853.3; Description=Protein of unknown function (DUF1249)
  Pfam annotation: Domain name=Transposase_23; Domain location=183-253; Score=-4.6; E_value=0.0038; Accession=PF03017.5; Description =TNP1ENSPM transposase
  Pfam module annotation: Pfam domain module=DUF1249::Transposase_23; Domain location=156-270::183-253
MEVSSYCSEGFDMGGYSADKESDDDIVCKKYDISKEKWAQFCQTCRDPSWKDVQKKTQAIQKQNTAPHVLSRGGYEYLENKLMNEKRKKKLEEDAQSGSTGTMIDPPSPIRQHVKWKMTRTKKPGQMTSEAAKEIPDKIIKHPGRVRATGAGVTIKKYFGPAPRTSHTSFSMAPKDLEERSRQGDSDKCELYIEENPPCLVALGRVYEGSTTVHNIPLLHDQVKVGVEEVRDIDAPIPIPTEEVKLVGQTLNTFLAWLTHLRAVGLAKPADRPDHEVDDPIYVMTLTIPQLFLKPLQVMWDATMFRVFNEDFPLYIKHGDLSDIAHGGQCLSIFVIQL

SEQ ID NO: 108800 - protein, 175 aa, Glycine max
  Coding DNA Sequence Number=SeqID_17115
MELVVDPWIWGSLCIKNLPSSARDLQSRPTVRTGPPPPPNYHKRPNLIRNAFYRHNRDRFGVKFGSFEGFPGGVTDPHGGPADECDSAVAATAEPGEDNEVEEVAEVEGFLGGVEAAINLEGWRCQARAVESFTVVTKAKAKANCPSFETRNLPSLSIQFIREPFITPGETLPKY

SEQ ID NO: 108801 - protein, 64 aa, Glycine max
  Coding DNA Sequence Number=SeqID_17116
MKSKIRFLKLRLRLDYIRFPKIMVRTRGLGRALGRTIGKVLGRRDESDDDAPQRRRLTTSACRQ

SEQ ID NO: 108802 - protein, 105 aa, Glycine max
  Coding DNA Sequence Number=SeqID_17117
  Gene Ontology: Mol. function=pyridoxal phosphate binding
  Homolog annotation: Hit_ID=Q38IW9; Match level="QueryCoverage=30%, HitCoverage=6%, E-value=8e-10, Identity=93%"; Hit description =Ornithine aminotransferase
MSCFFEFQENMCEPKEKTYSIVLFMSSRFKPDSKLSFKYLSALFATTKCNTLRLFINVESKLAAYILGKASGGGVIPISAVLADKDVMLCIQPGQHGRFHFIINL

SEQ ID NO: 108803 - protein, 69 aa, Glycine max
  Coding DNA Sequence Number=SeqID_17118
MTVANSIKTTLPKIESAKRKSRHFQKDYLKCKSWFKKKSELNAHRFLTIQTINSNEKFVFMGNKVKASV

SEQ ID NO: 108804 - protein, 117 aa, Glycine max
  Coding DNA Sequence Number=SeqID_17119
MDENPRSLKRPIHMLTSFFEDWKRTSKLLLNLMRLTVATNVKPCMPKRGNVLKFIKLARDYSHSNITDKALWDTYQDKDNDQLKVKKEGVRKEKKYYFCKPNGDFKKVCLKRKKWIE

SEQ ID NO: 108805 - protein, 321 aa, Glycine max
  Coding DNA Sequence Number=SeqID_17120
  Gene Ontology: Mol. function=L-ascorbate peroxidase activity; Cellular component=cytoplasm; Biological process=response to oxidative stress
  Homolog annotation: Hit_ID=Q76LA8; Match level="QueryCoverage=14%, HitCoverage=17%, E-value=6e-16, Identity=91%"; Hit description =Cytosolic ascorbate peroxidase 1
MLEIPSHARKYLKECENHWTILWKNAPPLQWDVVTLDRDIKDKSIVRPWYKFLKENDFHHGDEVSSFPIFIPSLFDFLFIFPFLFLPWQKAPFSFSLTHFLSLYKLEAFSLSKQQGPPPPPPPISVFHTERDTVCLNKFWAFGGNVVAMDKDSCGVGFMAELSDESSRKTVIDVLEMLVRMDPSDIAIRLLEPLKAEFPILSYADFYPLASVVAVEVTGGPEVPFHPRRELAGVVDVEVTGGLEVPFHPRRELAGVIAIEVTGGPQVPFHPGRESTRIGNQLNITTMGEVRCFLSQILALWRLNNSYALDFVVDRYTCNIC

SEQ ID NO: 108806 - protein, 344 aa, Glycine max
  Coding DNA Sequence Number=SeqID_17121
MRELGTYSVERKLRVLVDRGCYGDVTALADNYRLVDKSQALRMTLLAASLSDCWSGDVQQSFELGAIVGDNGVREAILPYDVFLGELLYLISCDFSKWSCLDPLGEVANDDYVYAGSLECLLDDSLEVFDLFGVAQLRKQVCFGVALPSTVSLVWYLLATCPWTSFEVELEGLLYSDIIRSFEDDSYPAPFHVGHTVNIEAPPVSSDQTLKVLRTMPPSSLLVHASQNLFDGVVRLDYHLMTLEIGPETSGRVLLGVMGYTDGEVDRELVLPFLLTGDVAMVFLKAKKACSSMHLQYGCAFVEDGFYSLMCDHEAQELASVDLESTFFRVEAHVLFAELFEDLF

SEQ ID NO: 108807 - protein, 899 aa, Glycine max
  Coding DNA Sequence Number=SeqID_17122
MDVTKVGSTISHVGLGFPFVKRTKGRTCKIKDSDAPVRLDVCASVPGMRWRVDCVLECHVAYHVLSSVEGSSLDKSVRLIKPPQPGQVLYGLLLLSCPGGHAFGFLDEVRHVRRVQCTRVALAYVSPMEWARTRDVVIPIGGSSSKKTCHGASDSESSSSERLTASRRVGGGTFRLCMRAQPSIASMDEEPVPVTTILLFSVSGGARRNGDEDIRASPMCIVATVLGRLHPLLSSLAMSGVAALHRQVKLANPEGTYKIVVQACGSDDFPFLRVVSALECNPSQLHPNSWAMSDPTRFKSFEEDLLTLVKRVDKVILVQLSGSLDMRGILSLPFASVMTTSALEIPRPSFSTPPVPPSAVLASGSPSSSSHPNVSLDKIYSSRDVDSLWGLPPKKSGDFGGKWTTTLGSSEATTQNVWRVEHPKVANAIVALVEVVSSNHRLLFKVGNVLVKLLRTRLDGDELLRRCKGLQREKNDLTDKVESTAIEKDELAKVVADLQAQLKESESRLEEFELRASKEREASKKLEEELLVYKKEVMEKHEKGFHKAVRQDVKDDVLLEEREIVVEEEDAGEEQGIGMTRDNLVFDFDLLKGLVTHLGDASFFFAKLFPLCLSDLTKGVPYIFLRVCTKGAPWVSCIPIEIKFKNMKACEGDAFVLGFGEANLGFVQPLEKRDSPRVYLGFDKPLEKRDSPRVDLGFYEPLEKRDSSRENLGADLGFDEPLEKQDSQRADLGFDEHAKMRPGMPSSWACYDPEWAFPVGTKLSCSGIFSGFTLDSPYKGFKDDSVGCLRLTVGLGVFDRVYKAILAYEVFSGELLYLDGWNFFISIPYMAKGQGEIMLWMLSGGVTQSGLLLLSCHDLLGVYGWCLEGLLDDGLEVFSLLSACQLGEQVYPCVFSLSM

SEQ ID NO: 108808 - protein, 91 aa, Glycine max
  Coding DNA Sequence Number=SeqID_17123
MLVFNSALKGLDNTQQSKSKSPARWIVVKYFTDPRPLEPERLKTLRNQWAKIEQDIKTILLILEALAPLDLSGWIASVGAPIYTTEQIVTP

SEQ ID NO: 108809 - protein, 219 aa, Glycine max
  Coding DNA Sequence Number=SeqID_17124
MTTPPRPPPPPTDAASHSPHTLKRIERPLVHVHPTTWKADDSHRKKLRTYFGIIVRDKVDVTYENWKQVPTAQKNLIWEDIKYDISKEKWTQFCQSHRDPSWEAHAIQKQNTASHVLSRVGFKFLEKKLMDEKKKKQMEEAAQSGSTDTVIDPSSPIRRHKKWKMARTKKTRQMTYEAAKEIANKIGLALPLEPKVGPSAGRVSTKESCVDPSGNNSDT

SEQ ID NO: 108810 - protein, 220 aa, Glycine max
  Coding DNA Sequence Number=SeqID_17125
MAGYISLLQCWIYEHFLSVHRCVIDTYAEASPRACRWLTGKAQMTGIKGAPYRARIDALTVTNVCWMPYAEHRGVRGYELLVHGASTDIDDRWVHFSDHLVPTGELYVVPGQVAPDYMEWFFQILYPFVTPTEEIAEPRPAPPPPPHDDDFVEPPIPEVLVVSDLPKHSVVDCTGCVRIVEHLEQVINLRMVTEGTDLYDIMDLCLRIARVFLFVFVKTH

SEQ ID NO: 108811 - protein, 271 aa, Glycine max
  Coding DNA Sequence Number=SeqID_17126
  Homolog annotation: Hit_ID=Q2HTA0; Match level="QueryCoverage=63%, HitCoverage=26%, E-value=1e-20, Identity=37%"; Hit description=IMP dehydrogenase/GMP reductase, related
  Pfam annotation: Domain name=DUF1723; Domain location=171-220; Score =51.2; E_value=3.6e-12; Accession=PF08330.1; Description=Protein of unknown function (DUF1723)
MDKSEERSSAPVASVHFLPAEEPSSAAIRGRTFFHEPTTSARRQRVPVPEDVTQRVEDVPQLPGDVPHVSDGWPEMTGVADGVETDRVASDGSLGAPADHEGFPGGPRYPFVLIGFADHVAHSIWSGQELPDLKLVSHGRKVDKFGRPAAEIEGMIAATGLDPLIRCSVITTDPGLIFAFVERWHRETSSFHLPVGELMITLDDVSSLLHIPITSALHSFESLVTSDVVALLTELLKVNPDEAIAETRQAGGPHVRLSWLRDMYQSRCQAR

SEQ ID NO: 108812 - protein, 275 aa, Glycine max
  Coding DNA Sequence Number=SeqID_17127
  Subcellular localization annotation: CTP_CleavageSite=64; ConfidenceScore=5.62e-01
MKQLIYYNMIPSLTTPFLPHAATTTSSTSSGASSLSPLSQNPPSIEKIRGFSFEWSRQRRFWVLVEKGVGFDLEAHMFMVLFKLTNFETSYSHPSHLNAFTLSFATSCDTKTSSPSALQPLVVLQHHVGVTHDAATSLSLSRFCNLSVGDKSVTHDVAASLSLPWFYNLNVGDKRTRIISFLLILRVTLTGCNIKEGRGKVYEKKREMKAVANAAKCGRACIAIGSSGTKAVSPVAPARQLHRLLASHSSLGHYLQARAWHAEGSHGYSFIFTCA

SEQ ID NO: 108813 - protein, 361 aa, Glycine max
  Coding DNA Sequence Number=SeqID_17128
MGDGTGREKGQRFTKYIRELVDDGSDYRRGRLVEGGECVSLDKNGYLRRRGVTIQYATVAHHYLELGHLGCRQIQKPSHTRLDKIMSTVVVDEDHDTMMTNKAIHSKGFWCRHPCRRVKANLRWRIRVVCGSWVVGHKWVGGVTVAQLASVIEDPFLVTMIAGAFVSSRGVGGSHYVWLWAKSGKEQCDGAGTAASIIELVFLEFGPGSRLGQRIMIEEPEPPKVRHLEDFRRMKEQSRTLRPGALSTTMYTLIIKELGNFKDPSHWILAVKSRNFELYVRPRLSDRIWCLWRFWGCGGGGDGCEEVSGGFSVVLVGHGGWGVKVEAVLEVVRPLSDPYGSASGYRGVEVAINFSLYTFFL

SEQ ID NO: 108814 - protein, 104 aa, Glycine max
  Coding DNA Sequence Number=SeqID_17129
  Homolog annotation: Hit_ID=A2Q6C5; Match level="QueryCoverage=48%, HitCoverage=45%, E-value=3e-08, Identity=46%"; Hit description =Putative uncharacterized protein
MTDLKSTFHPALAVSNIKNHVPIILEMENVQYATWAELFKIHARSHRVIDHIIPPQDGKQKTPPTEEETELWLTLDATILQWIYATISHDLLHTILEPDTTAME

SEQ ID NO: 108815 - protein, 77 aa, Glycine max
  Coding DNA Sequence Number=SeqID_17130
MLQCEGFSSKLRYDFEFPNGENVRNWVVNVILKFHDDPTVNEYEIVVFLRQVWWAAGKRKGVERRRGKTKMRPKRGT

SEQ ID NO: 108816 - protein, 47 aa, Glycine max
  Coding DNA Sequence Number=SeqID_17131
MWTTTGEELATQLAQASKVASSRSNNLLEEGSRRPKWARLLFVPPFY

SEQ ID NO: 108817 - protein, 146 aa, Glycine max
  Coding DNA Sequence Number=SeqID_17132
  Gene Ontology: Mol. function=microtubule motor activity; Cellular component=microtubule associated complex; Biological process =microtubule-based movement
  Homolog annotation: Hit_ID=A7Q9E6; Match level="QueryCoverage=47%, HitCoverage=6%, E-value=1e-22, Identity=74%"; Hit description =Chromosome chr19 scaffold_66, whole genome shotgun sequence
MNNNVADALLVPVTCSQDVLDLMRIGQKNRVVGATGLNERSTRCHSVLTVHVRGRGLVSNSIVKGCVDVVDLAELDQCIFVSNCGANSVTESVCGGVPMICRPFFGDQGVVGRLIEDVWEIGVVMEGKVFTKNGLLKSLKDKQHRI

SEQ ID NO: 108818 - protein, 98 aa, Glycine max
  Coding DNA Sequence Number=SeqID_17133
MKGCLTTYLRTPYIAKNLRPVVVGSFDRDYLTVCYKTSSFDRDFNGYRTDGFVTEFKFNLNRYQNNHLRFGKRGLLLLLQQNLFLPSLRMNLLLPTVT

SEQ ID NO: 108819 - protein, 246 aa, Glycine max
  Coding DNA Sequence Number=SeqID_17134
  Gene Ontology: Mol. function=identical protein binding; Cellular component=extracellular region; Biological process=negative regulation of catalytic activity
  Homolog annotation: Hit_ID=Q9ZUF6; Match level="QueryCoverage=98%, HitCoverage=34%, E-value=3e-94, Identity=65%"; Hit description =Subtilisin-like serine protease, putative
MVTRQILKPNVIGPGVNILAGWSEAIGPFGLSDDTRKTQFNIMSGTSMSCPHISGLVALLKAAHPGWSPSAIKSALMTTAYVHDNTKFPLRDAAGGAFSNPWAHGACHMNPHKALSPGLVYDATAWDYVKFLCSFGKFSDPGQLNYPSFSILFGGKRVVRYTRVLINVGETGSIYNVTVDAPSTMTIKIKPTRLVFEKVGERQRYTVTFVSKRGVGDSTRYGFGSIMWSNAQHQVRSPVAFSWTLL

SEQ ID NO: 108820 - protein, 52 aa, Glycine max
  Coding DNA Sequence Number=SeqID_17135
MQCGTMLVKNLVRRLGVHDKTDHTLGDQSGSLCFERMLQPYGIGIGFKEHSN

SEQ ID NO: 108821 - protein, 268 aa, Glycine max
  Coding DNA Sequence Number=SeqID_17136
  Subcellular localization annotation: CTP_CleavageSite=41; ConfidenceScore=5.54e-01
MTKSSKKRKGTSTSIVAVGHRRHGTSGAPTAPVSPSLSSLRSSTLFSLDDQCLRQGVPFEDTIVDDWKFDYFSHDARRMVCNDQANMTSRLLARSLTFDCHIMHYIIVRILLPCSSNPAQAFEEDLILMYRMHKALWTNAHLPYPQLVTLFLRHFQIPLDDESFVQVKRSFVIDAGAVTSFGYRKDHNGQWLRKQDLSHERIPSPPSQQDVSSAFMNDVLSELRGLRAFVGDCFDVMDARFTGMDTCITRLEDDMGFIRHCFDPPADP

SEQ ID NO: 108822 - protein, 124 aa, Glycine max
  Coding DNA Sequence Number=SeqID_17137
MNAKRREGIVGVLVLLKKRILMRHEKLGNQNTVAYTAALNHDIQPTTQGMVQALRAGEHLHCVMEDHRHEGRVASSRTRFQKLSGGREDKAPMAMKRVNINERKGSTDILQATSCHKEGKMNKR

SEQ ID NO: 108823 - protein, 77 aa, Glycine max
  Coding DNA Sequence Number=SeqID_17138
MMTKVMTKSSKINQRTTQVNQEKSRVQDKNQEEFKTQEESLESRMKIQGSRSQESRSRFKTQDSRIKRRLNQDKYEK

SEQ ID NO: 108824 - protein, 115 aa, Glycine max
  Coding DNA Sequence Number=SeqID_17139
MDEDQWMHDGIMSEEVDMDDENKEECDVNEQYVNCSNAFNTSQWARSVAHENGYVAVIMRSDTNTGIRGKTSFVLIGCESSDQYRSRKKDFVRRDTGSRKCECPFKLHGKPVVGG

SEQ ID NO: 108825 - protein, 167 aa, Glycine max
  Coding DNA Sequence Number=SeqID_17140
  Gene Ontology: Mol. function=transferase activity, transferring glycosyl groups; Biological process=metabolic process
  Homolog annotation: Hit_ID=Q8S9A1; Match level="QueryCoverage=53%, HitCoverage=17%, E-value=2e-19, Identity=57%"; Hit description =Glucosyltransferase-8
MHIVHGINISKFTCNHDVRTRITGFRVVRDFEGGLIVSALEGEFLAGANLVEDVPILLLQPSDLLHELILVEIELEFRLDLVIEQSGVVVVRGSSLRYVVEEPLQELDLLVVGPQPLKQSPRVIQRQRRRLFLRKSSSSTCILSNFTISAAPRGLCPAVGTGGVFTN

SEQ ID NO: 108826 - protein, 803 aa, Glycine max
  Coding DNA Sequence Number=SeqID_17141
  Gene Ontology: Mol. function=protein binding
  Homolog annotation: Hit_ID=A7PB60; Match level="QueryCoverage=41%, HitCoverage=75%, E-value=1e-42, Identity=36%"; Hit description =Chromosome chr16 scaffold_10, whole genome shotgun sequence
  Pfam annotation: Domain name=WRC; Domain location=50-95; Score=97.9; E_value=3.2e-26; Accession=PF08879.1; Description=WRC
MASGISIPPDLLFTIKRSYFDSPLSSRLLPNQPQHFGWNYLQMGLGRKIDPEPGRCRRTDGKKWRCSKEAYPDSKYCERHMHRGKNRSRKPVEVLKSTTTPSSSTTNSNASSTQQAISSITKINSTLSPLASSETHQHHHYPQHYGSFLYHHHPPSRSSGIGLSFEDNSAPLFLDTGSCSQSNTDCRSRYVYGEKEEVDEHAFFTEPCGVMKSFSASSMDDSWQLTPLTMSSSSSSSKQRSSFGLSSDYSCLQLQSHSKQQQQEHHQDQGCYMFGAGQVVKEEPQKTVHRFFDEWPHKGREGSWLDLDDKSSTTQLSISIPTSSHDFSTFSSRTHHEFCLTGLDCLCNNGSSSSDSDNACLRRAMLEEGRASVRDGGSTNLAKKVELPAFTRTDPIGWIVRAEKFSKVQEIPSFHKLQYAFMSMEGAATHWFYIWRKKTPNSDWGSFSTTLIKRFGDFYGNPHQKKGDFSTKFLKERTNTSKLKHRLRKILNEVDSRASQQGKNSMEGNASECSDAKASSWTRKVELPRFDRSIEGGTDLKGSSFDCDSDPLQFLKSENRSKEGSVIKYHTLCRGEETKNDEAKLAREKKIEKIILDKPITDLIKKSKLMMQPSLIVFKIQISIKKIVMMKQKSFMKLKNGAKAEGRYRDSHDDSIDPPWRDTKEAHLVSVNDSVLKDEKEEGEVLEFYQVCSTFYIMAFGRKAPQCYHKRQMKIMVMKMRQGIQLPQFQPETCSLNWMAGFISLNLDAGVANDMIIEKGWKEIVASPMEVKINQNLLSSLPPPEPPNSTRVQGSGSFPAELQ

SEQ ID NO: 108827 - protein, 697 aa, Glycine max
  Coding DNA Sequence Number=SeqID_17142
  Homolog annotation: Hit_ID=A7PDY4; Match level="QueryCoverage=84%, HitCoverage=75%, E-value=0.0, Identity=61%"; Hit description =Chromosome chr11 scaffold_13, whole genome shotgun sequence
MAGVTKEDESGSPSWGASFFTQTTEDVARAVAAAMNSPRPSVVYSSKNDHGGSQLQKLQYQVTKMIKGFSRPTEVKYTNYNPEILTTQKRQWAANFQLQYMDHKSWKEPTRLFESMVVVGLHPNCDIQALQRQYFLRKSEGPGKLRSALGYQNQSRVEAEPNLEPQVLFVYPPEKQMPLKDKDLLSFCFPGGLEVNAVERTPSMSELNEILFGQEHLKQRDLSFVFRLQGADNSTLYGCCVLVEELVQKPSGFLSLISDKQATYSPLKRQRHILTTQRCYCILSRLPFFELHFGVLNSIFMQERLERLTRIGGDLNLEYAEDSCEEENLEEKSECMLVNDRLEDRHDDNPMISQSSLRNSSPENIENDSNYPKKQMVNGDLHTFKERVNDDNAVPSDPETDRKTVREESGPTNAEESDLYGDAFVTNKQSEDRRLPNAILPLLRYCQYESSESSCSFQGSPCDDRNFRSDADDTETEDASFSGQEDLNDLQDILEWAKANNCGPLQIISEYYRLTCPARGSALRFHPLEHLHPLEYHRPDETILHLAGSTVDLKSCSTGLEFAEAHNSLLAEEEATALSIWAVACMCGTLRLENVLAFFAGALLEKQIVFVCSNLKLKVVRWRCVTRQGPAWVHVQQCFELAVHVYGMAVFNGDDGHCSPMKKTEMSTRDAFLVEGEKTSVTLAGDASCVVCVNFTR

SEQ ID NO: 108828 - protein, 163 aa, Glycine max
  Coding DNA Sequence Number=SeqID_17143
  Homolog annotation: Hit_ID=A5BSR3; Match level="QueryCoverage=49%, HitCoverage=25%, E-value=5e-10, Identity=44%"; Hit description =Putative uncharacterized protein
MGPCSRSGRCRGHCTGHPEAEYCPPRFSRGGYDYLEQKLLAEKTKKKLEEAGQSGSVDGVIDPPSPVRRHVKWKMVRTKKTGEMTTEAAKEIAEKIDSFEEQAIQGSFVPHGRQNVLAAAIGRPEHPGRVPTAGAGVTIKKYFGSTPQTSRSSSSLLLMNCSN

SEQ ID NO: 108829 - protein, 180 aa, Glycine max
  Coding DNA Sequence Number=SeqID_17144
MNFFRIWNFLRFSKGFCELANEGSNTETLPPVELLMFELKRVEISQLTCSKTLLHSLFSFSSHLKSAGNHSVDTHIAPHSFQYCRKPLAGTHRTSYRRKVEENPTLLLELWVEENPTLLLEQSWVLKAQSFLRCQLTRYELYLSMLLFLLIVLYVVFKLHESYTPNKVSIRAGDGFHNLK

SEQ ID NO: 108830 - protein, 125 aa, Glycine max
  Coding DNA Sequence Number=SeqID_17145
MVKFGSLPRGSNPSSITLIPKRFKSVLRAVIDGRQGVFLWRSMLDGVIIANEVVEEVIRKKSNFPIAVFAIIGNNGGKNKTRRRNLPRRRSRNAKKKQTHTFLLITTTMATMAWEVHLGGEEEEE

SEQ ID NO: 108831 - protein, 744 aa, Glycine max
  Coding DNA Sequence Number=SeqID_17146
  Gene Ontology: Mol. function=calcium ion binding; Cellular component =integral to membrane
  Homolog annotation: Hit_ID=A7PE01; Match level="QueryCoverage=98%, HitCoverage=98%, E-value=0.0, Identity=58%"; Hit description =Chromosome chr11 scaffold_13, whole genome shotgun sequence
  Pfam annotation: Domain name=MS_channel; Domain location=527-718; Score=25.0; E_value=2e-07; Accession=PF00924.9; Description =Mechanosensitive ion channel
MEEDKGVADKKVTKNEVLLRISDSEEAMHAEKDQRESRSSLEAESSSLSPQHSTHIGKGFTDSHGELTELENLRNKGQVSTELVTTTKRLMGRSEFSRPKSRMVEPPCPKDANFVEEQAQMTSSNSSAWNSPNKNAPEATIVTPRTPLPGTPGEEEDDDEEVYKTAHVEMRKRSGKKCRVLGFVEWYAFVCIMGFLIASLTVHKLQHREIWGLELWKWCVLVSVILCGRLVTEWFINVLVFLIERNFLFKKKVLYFVYGVQKSVQGFIWLSLVLLTWVLLFHHGVERTRNVSRILNYITRAFVSCLIGAAIWLAKTLFIKLLASNFQSTRFFDRVQESIFHQYILRTLSGLPLMNMSAKVGKTSSSGQLSFKTMINENEGKEEQVIDVDKLKKMKQEKVSAWTMKGLIDVIRSSGLSTISYTPESADEDESDQKDNEITSEWEAKAAAYRIFRNVAKPGNKYIEKDDLLRFMKNEKVENVLPLFEGAVETGRIKRKSLKNWLVKVYLERRSLVHSLNDTKTAVDDLNMLASVIVLIVITIVWLLIMGFLNTQVLVFISSQLLLVVFMFGNTAKTVFEAIIFVFVMHPFDVGDRCVIDGVQMVVEEMNILSTIFLRYDNEKIFYPNSVLATKPISNFYRSPEMSDSVEFAVDVSTSIESIGALKTKLKAYLESKPQHWRPNHSVLVKDIENNYGDKNNRRSELVLELKKILEDLNIKYHLLPQEVHLSHTNGFPHSLSSLRSKMV

SEQ ID NO: 108832 - protein, 90 aa, Glycine max
  Coding DNA Sequence Number=SeqID_17147
MAREEEEPNWMSPYKNFLVRGVLPSNEDETMCLKWKASYYAILDGESRHMRLASNILQARHAAHLVCWETLEEDQSGMHSPNVSPARPAS

SEQ ID NO: 108833 - protein, 158 aa, Glycine max
  Coding DNA Sequence Number=SeqID_17148
MLGPLTEILDAIKNRIRVYIKYSAEFPNNGFSLPSQGSTFYKQEKGFESNSQIHNGEDVSSTSKDRKIAKKPRIYLKAKVFALLLYSAPLFSIFLYSPPSSCLFFHSRLKKDFLTSKAHLAPYSHLARVSEHPLSELDALRAGRDKCIAERADDVLNV

SEQ ID NO: 108834 - protein, 461 aa, Glycine max
  Coding DNA Sequence Number=SeqID_17149
  Pfam annotation: Domain name=zf-CCHC; Domain location=122-139; Score =22.6; E_value=0.00058; Accession=PF00098.14; Description=Zinc knuckle
MSLHSSSSVNGEGSTPKDPLYKILDELRSLKLWKEKQERKEKGRHRAHPRPYSHWREKERKPQEANINLLYFHGKDNVEANLDWEIRVKQQLKRKSTSKSYGSHSYPKKDQGRGILGNTSSIKCFKCLGRGHITSQCPTNKTMIMRGQDIYSSQDETTTSPSSSESEEAKQEESIKEIYPQEEGQLLMVKEECKKASVSSKRLAKKERHFEIKTNIKEISPLRQPPHFLLCKKTLVSIATPLRLEFIPQVKELLDEGLVRKSLNPCALLVPKIGIIRHQIPMIGGMMNVLSGATLFRKITHAPNIFMICVHRDSLGLPMDPKRIKVIPEWPTPPTPLIELVRNYILSWEDGQERGAKESIDEEDPRPTSSNGAYITGAIAIGRGPTEVTREATPRTSPAMTPLVEVSEEKDGAADTNYVADMVEAHSTWDPWPATAQETSQPAQDAPSSLQDEPAPAQEEP

SEQ ID NO: 108835 - protein, 257 aa, Glycine max
  Coding DNA Sequence Number=SeqID_17150
MASRKRKVTTSRPREPYDTTRFTSEGVWERYEQNIHFRNILPERNVVLYISEYDEFRRELQRRCWHKALTRLLDGHIDVTLVKEFYTNLYDREDKSLRQVRVRGKLVKFDVESLNAFLETPPVLELGEQYTTYTRFYHSHPDPQEFAAGLCIPAHGFVLNAEGAPWKLLRKDLTTLAQTCSVLSYSNLAPTSHMYDLNMDKARWPSPTPLGSASQLSSSPCAWPEESYPTLLPSSPCALPLIWHTSGRTAGTRMIPR

SEQ ID NO: 108836 - protein, 66 aa, Glycine max
  Coding DNA Sequence Number=SeqID_17151
  Homolog annotation: Hit_ID=UPI0000ECBAF8; Match level="QueryCoverage =62%, HitCoverage=48%, E-value=1e-16, Identity=100%"; Hit description= UPI0000ECBAF8 related cluster
MGIVDRGGAWASEGMQAWHWPSFYNVVTGKTLALPNLIALQHIPLSPAGVIAKRPAPIALPNSCAA

SEQ ID NO: 108837 - protein, 67 aa, Glycine max
  Coding DNA Sequence Number=SeqID_17152
  Subcellular localization annotation: CTP_CleavageSite=53; ConfidenceScore=5.08e-01
MESPTVATYPSAVGRRGAHGCVFHRRKMRGVATNVYSRKTSEKPEKAWSTNFKCERFGSCIYARGRY

SEQ ID NO: 108838 - protein, 148 aa, Glycine max
  Coding DNA Sequence Number=SeqID_17153
VVVSPPKPPPKPDPEVDDPLYLMTLTILELFLRPYQVRWDATVFGVVNPDFPLYIKHEDLSKIAHDGQCLSISVLQLWILFHCSGHWKMVVILPKEHLVVWFCSLHNRPDNYLKGIINRQKGSTKCGYYVMHWMSTIILGTFRNNWEA

SEQ ID NO: 108839 - protein, 184 aa, Glycine max
  Coding DNA Sequence Number=SeqID_17154
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMDNFVYLDIFGGARRTKKGMQAWHWPSFYNVVTGKTLALPNLIALQHIPLSPAGVIAKRPAPIALPNSCAA

SEQ ID NO: 108840 - protein, 107 aa, Glycine max
  Coding DNA Sequence Number=SeqID_17155
  Homolog annotation: Hit_ID=A2ZIV7; Match level="QueryCoverage=95%, HitCoverage=12%, E-value=6e-10, Identity=38%"; Hit description =Putative uncharacterized protein
MVHLVIHLAHEARVGGPVHYRWMYPIERYLSRVETHFNQFARNDDSCFAENVSVLNPRGRPLGRKKQVGFNVKKRKRASRISLDKKALVQAHTYVLFNSNNVHHFPK

SEQ ID NO: 108841 - protein, 173 aa, Glycine max
  Coding DNA Sequence Number=SeqID_17156
RPVYPLKVTARASKKERRIGTNSWLAWGGVVIGSLARRKEESRFYLHAKDVKCPLMGKRGCINYNPVLAIRQLGYPMRGVPSNESITPFIARGFSDHNARDRELRGSSNGIIGGYHKWLRVRTQGLDWLPNLKTVRDDEVKASEESDEVQALKAELERARVVEEKFKSIAIKV

SEQ ID NO: 108842 - protein, 102 aa, Glycine max
  Coding DNA Sequence Number=SeqID_17157
  Subcellular localization annotation: CTP_CleavageSite=31; ConfidenceScore=5.75e-01
MGSPPASTPPPPPPPTSDASASPSAMKRTRKASRLRSLSTRPPGSERPVVHVDPATRKADGPHRKKLRTYLGIVARDKVDITYENWKEVRTAQKDLIWEDIQ

SEQ ID NO: 108843 - protein, 247 aa, Glycine max
  Coding DNA Sequence Number=SeqID_17158
FSVHQYPKFVNINQCTLRVRLIASEPNLRSCLMDEGLTGEGPNVRTNPLASHGGASVNVVEEDGPSRAKRLGEVATSRRFIYQSLQAACMVSRGGGEGDECLFHLGESHDMETCPAVEELLQRLMDWGQLEVSIGGREEPQICMQSEEKRVPLIPKALVICFTRKGTGSTPIYPGAAPKPTPFAYQSNKAIPWKYTPPASSERVATEVDSLSAKVTNITGLSGVTRSGRVFAYPHPAELPSKGKAPM

SEQ ID NO: 108844 - protein, 317 aa, Glycine max
  Coding DNA Sequence Number=SeqID_17159
  Homolog annotation: Hit_ID=Q6WAY6; Match level="QueryCoverage=85%, HitCoverage=47%, E-value=3e-15, Identity=24%"; Hit description =Putative uncharacterized protein
MVGSHLFRQEVRHACPLESHHSCTEKGGANWDQLLANKEGASIKWFPRWKEGRTRVLISCKGFPNVPSMGTRGCISYNPVLAIRQLGYPMRGAPLEEEIAPKVRKAWEVVRKKDKELRGSKNGPIRGYSKWLRAHVQGLDWLPSLRTAKREEVEAPEEDEEVQALRAELEQAQIVKERFKSVALKIRKENAELRDINIATTKALEQEIKRARREEHGRNKFRGALWGSNSELKLRREERDQSRVDSLILKDELKVCSRSKRNLSQWLCEIETNMLAIISKYQEELNLATAHEHRVADEYAQVYAEKEARGWTNLLLP

SEQ ID NO: 108845 - protein, 274 aa, Glycine max
  Coding DNA Sequence Number=SeqID_17160
  Gene Ontology: Mol. function=binding
  Homolog annotation: Hit_ID=A7P1Y9; Match level="QueryCoverage=29%, HitCoverage=11%, E-value=4e-19, Identity=58%"; Hit description =Chromosome chr19 scaffold_4, whole genome shotgun sequence
MPGARQARQGASAVVDGCRDWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPCVFIVVLFSGVDSLSFLRCMILLQLERWSEVVKDYQALKRELPNDNEVAESLRQAQLALEKSRQMVYGTRFGVEVEQICSLDKFKAALASAGISVVYFKEASNELCGLRIGRSSASSLTDSLRSVVRLRRAVSAHSKAVIRLSTESGDNAGKNM

SEQ ID NO: 108846 - protein, 154 aa, Glycine max
  Coding DNA Sequence Number=SeqID_17161
MKTKGHFGLEIMLGMICYHIGMHLSIVPNEDFQQTHLQKDIGRFIDDRSRQTHTLLKNIDLGVGVGIQLRGQSVRDAFIVRVCGLSSFVPHRLVCKTCVVLVPHRLFSGGSGSNGIRRGEGEDREVRWQRFQLLEDADRGLSISEEAVLAFIRG

SEQ ID NO: 108847 - protein, 147 aa, Glycine max
  Coding DNA Sequence Number=SeqID_17162
  Homolog annotation: Hit_ID=A0ST23; Match level="QueryCoverage=21%, HitCoverage=65%, E-value=1e-11, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPETKKDTVDKSICQALWGDPGYRARIRNHVGKPVVPAALMNRPTRGERRFAYWALFRFLAH

SEQ ID NO: 108848 - protein, 93 aa, Glycine max
  Coding DNA Sequence Number=SeqID_17163
MIDQWNNRHAFRVDAYPRQEGLLSFNSDYMVWYRRKTKMFVDPQNANTTALAEVAETLQYMVSPQGRNTWTVDDLVPYVEKITILSGRARENH

SEQ ID NO: 108849 - protein, 34 aa, Glycine max
  Coding DNA Sequence Number=SeqID_17164
MADQQATKSKAKAQDVKEALLGGNLVPFKFLPAI

SEQ ID NO: 108850 - protein, 163 aa, Glycine max
  Coding DNA Sequence Number=SeqID_17165
  Homolog annotation: Hit_ID=Q6L477; Match level="QueryCoverage=61%, HitCoverage=15%, E-value=5e-11, Identity=31%"; Hit description =Putative uncharacterized protein OSJNBa0009L15.8
  Subcellular localization annotation: CTP_CleavageSite=32; ConfidenceScore=5.76e-01
MGSPPASTTPPPPPPPSPSPPRPPPTSDASTSTSAVKRTRKASRLLVHLVLRDQWCMLILLQGRPTVDITYENWKEVPTAQKDLIWEDIQAKFDIPEASNSRTKRKLLQTVGERWRQFKSDLTRKWTLAADQDSVEDTVCDKYDISKEKWAQFCQTRRDPSWE

SEQ ID NO: 108851 - protein, 68 aa, Glycine max
  Coding DNA Sequence Number=SeqID_17166
MVVRLKEEKVQAVDVSLSEAYALRGGHPLSETCSSLSMLGNPRRGSVTDVCAQHAASLPNESFVPSRA

SEQ ID NO: 108852 - protein, 277 aa, Glycine max
  Coding DNA Sequence Number=SeqID_17167
  Gene Ontology: Mol. function=signal transducer activity; Cellular component=membrane; Biological process=signal transduction
  Homolog annotation: Hit_ID=A1JT71; Match level="QueryCoverage=92%, HitCoverage=46%, E-value=7e-19, Identity=26%"; Hit description =Methyl-accepting chemotaxis protein precursor
  Pfam annotation: Domain name=HAMP; Domain location=194-263; Score =50.4; E_value=6.1e-12; Accession=PF00672.16; Description=HAMP domain
  Pfam annotation: Domain name=TarH; Domain location=40-179; Score=2.2; E_value=0.02; Accession=PF02203.6; Description=Tar ligand binding domain homologue
  Pfam module annotation: Pfam domain module=HAMP::TarH; Domain location=194-263::40-179
MKIATWLMLMLLLLGLMPMGTGAIAFYFMQQNGNSIGRMSTFSDEEAALNRSWRALLQTQTLIDNMAFERMAQTDAADIRKGITEARNELRSADVAFNLFWETPGLTVSRPDLGEAMKTVYLAQQAVLKQELTLLADTPQAALIERLHAMAAEKRQVRQRLDSQFADYMRATVAAHRLAVEAAVQTQKVFARLLSGTLAAILLLLVAVQRDFRRRLILPLRQIAEHLQKVGRGDLRSEIAVRNSNEIGMLFASLRTMQHELSATVQHVRDGVESINH

SEQ ID NO: 108853 - protein, 84 aa, Glycine max
  Coding DNA Sequence Number=SeqID_17168
  Subcellular localization annotation: CTP_CleavageSite=35; ConfidenceScore=5.33e-01
HKKLKSCSAKRSSRAKRNLWAQLASITKRNYSMLSVMRKSGRAQESRPCAKQDIRLLPGSTHDWHQAQIHLLVLSAMVALSVIS

SEQ ID NO: 108854 - protein, 132 aa, Glycine max
  Coding DNA Sequence Number=SeqID_17169
MVAWPGAQPSLHGEDEGPTAQVPQHVEDEPYEATIPEPFIIEEEAGETQVRQVGAATPKRSLEVTSKPPAPVVDLSSPQHAADPSTPILEIHEDPTTPVLTLDTSPPATLVLHLTDEEDVQTQDTQDQSQEF

SEQ ID NO: 108855 - protein, 154 aa, Glycine max
  Coding DNA Sequence Number=SeqID_17170
MGSLNFANETIGKEKWYKESVNDSSPILPISTPSPCHTVHHNKNLINSHKDMKLHHNKGKDNNLNLHKQSSIHGSSNLRRHVYQQCKKNPHRHVDKKQKTTFFGSDSESDPNKVNMKLVDFNQEQTLTTLANMIIIDELKFVQNKGFRKFIEDA

SEQ ID NO: 108856 - protein, 71 aa, Glycine max
  Coding DNA Sequence Number=SeqID_17171
MALLVSFVVSVRKNLEEDELSGSLSALLQVIKRTASAHPLSERSTLNQNPLMCAKRFKFALSSRARTNPPI

SEQ ID NO: 108857 - protein, 99 aa, Glycine max
  Coding DNA Sequence Number=SeqID_17172
MEHFLEQVAWPEAQLPLVNPEPADPQSPVVNPPSSPELEAVPPSPPLIVICDASSDEAAAPPDSLAAETTNPPISPIGGIADHSDSSSGEAVALTNSLV

SEQ ID NO: 108858 - protein, 140 aa, Glycine max
  Coding DNA Sequence Number=SeqID_17173
  Subcellular localization annotation: CTP_CleavageSite=74; ConfidenceScore=5.42e-01
MAEPSKKRKGTSSRSQRHSGSQETPIPSSIPSGSLFSSKEQRIQYTNLFSSRSIINPKFIDMDFFSNESFECFQAFENSNLIPFMSLKLPIYSDLVKVFYSNLEIQEGPLMSEVYGIKMVIDQSLFYDLTQLPSEGVPFE

SEQ ID NO: 108859 - protein, 223 aa, Glycine max
  Coding DNA Sequence Number=SeqID_17174
MERSMIDAVSGGALGDMTPAEARNLIEKMASNSQQFSARNDAIVIRGVHELALNQKSIPVARVCGLCSSADHHTDLFPSMQQPGAIEQPEAYAANIYNRPPQPQQQNQPQQSNYDLSSNRYNPGWRNHPNLRWSSPQQQQQQPAPSFQNAAGPSRPYIPPPIQQQQQPQKQPTVEAPPQPSLEELVRQMTMQNMQFQQETRASIQSLTNQMGQLATQLNQQQS

SEQ ID NO: 108860 - protein, 54 aa, Glycine max
  Coding DNA Sequence Number=SeqID_17175
MGIQKNSQAGDTKEFRRLVLRSFGKGRRETQKEFRQLVLGKFFLAKGEGNEKDE

SEQ ID NO: 108861 - protein, 91 aa, Glycine max
  Coding DNA Sequence Number=SeqID_17176
MAAKFIEETGLISVQQQGADSWIWKQHSSGIYLTNTAYKFLMEEIRGDPMDGSFVFLWKLKIPPKAKIFTWRLIKDRLPAKFKIYMYSQYL

SEQ ID NO: 108862 - protein, 287 aa, Glycine max
  Coding DNA Sequence Number=SeqID_17177
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIACHIISTTDGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108863 - protein, 41 aa, Glycine max
  Coding DNA Sequence Number=SeqID_17178
MVMDMADTFGEDFGIHFNQWSSNIRAGFNHIVLSRADLTDS

SEQ ID NO: 108864 - protein, 133 aa, Glycine max
  Coding DNA Sequence Number=SeqID_17179
  Homolog annotation: Hit_ID=Q6UUU1; Match level="QueryCoverage=45%, HitCoverage=40%, E-value=9e-19, Identity=78%"; Hit description =Putative uncharacterized protein
HILGGEAWIGCFNGGKVKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108865 - protein, 137 aa, Glycine max
  Coding DNA Sequence Number=SeqID_17180
  Gene Ontology: Mol. function=phosphotransferase activity, alcohol group as acceptor
  Homolog annotation: Hit_ID=A7QDY4; Match level="QueryCoverage=29%, HitCoverage=1%, E-value=1e-13, Identity=80%"; Hit description =Chromosome chr4 scaffold_83, whole genome shotgun sequence
  Pfam annotation: Domain name=FATC; Domain location=105-137; Score =17.8; E_value=0.0027; Accession=PF02260.11; Description=FATC domain
IEHQVDLLPRASLPNRPTYNSKPQETQHKDAHAKVEYVKRLYDQVKVQIAKKNESYAKQAHKKRKELVLEPGDDPGHLRANVFQEGGNDENHETGQIDEENVMDPPQPVQRGVTELGEAALNPRNLCMMDPTWHPWF

SEQ ID NO: 108866 - protein, 52 aa, Glycine max
  Coding DNA Sequence Number=SeqID_17181
MAKLSYYHEGSGSPTSTLVPLDLEIKATLRRNRAERRRKLLQDKTVASILEE

SEQ ID NO: 108867 - protein, 176 aa, Glycine max
  Coding DNA Sequence Number=SeqID_17182
QGVPFKGTLAANWKFDYSSYDAHRMVCNDQASMTGRLLAGCHIDWAHLVRYRMRKALQANAPLPYPHLVTLFLHHFIVPLDDEPFVKVKRSFSIGAGEVTSFGYRKDVDGQWVYKHDLPLPIPDERTPSPPPQWGDSTSLLTEVLTELHGLRAFMGERFNTMDTRITRLEDDMNFI

SEQ ID NO: 108868 - protein, 167 aa, Glycine max
  Coding DNA Sequence Number=SeqID_17183
ASVNAIEKDRPSRSKRLEDVGESDECLFHLGESHDMETCPAVEELLQRLMDWGQLEVSEGDREEPQICMESAERKAAPWKYTPPAFGETAATEVDSLLAKWPGVRSPSLGGIALQGESTHDPRAADTVTPSKEVDPPMVKGAEKKEGLQGKVVTLQKAHEFLRLIQQ

SEQ ID NO: 108869 - protein, 246 aa, Glycine max
  Coding DNA Sequence Number=SeqID_17184
MADGFDEEAIAQLLCTPGHDFARTTAGRRVRIMRSSMTTLTQMWMTLLLSNVLPRDHNSDLPLPKCQLVYAILTRMSIHVAQLIADAIYLFAGMPPTRHPLNPDKSNRALGFPGLITGLCQSFGVPVTPSKVIRPPITRAFIEKYCTPRQAQGDAPQGAGAPPPPPQAGPTGSLGMERYLQHLGQSSTPFVCPTPEQFAAEVAWPGDWPDAQAGEEPAGSPGRMDEPRMDKDMTDLFDFLGGSGAT

SEQ ID NO: 108870 - protein, 147 aa, Glycine max
  Coding DNA Sequence Number=SeqID_17185
MYYGTQSDIGVKSHGRLNWLKGSTSIWSVSVYYGTQSDIRSKTLYSFELAHRFNIQFSSVSIYYGDSIRHPSKSVSIYYGTQSDIRVKSYCRLNWLKGSTFNFERLDILRDSIRHPSKKLLSFELDQSFNIQFRASRYITGLNQTSE

SEQ ID NO: 108871 - protein, 65 aa, Glycine max
  Coding DNA Sequence Number=SeqID_17186
MEASKMKFFLVLVIAMLAMVATGVSAAEAPAPGPSSDATTFFVPTALASLFDALNWRFGVREEEK

SEQ ID NO: 108872 - protein, 270 aa, Glycine max
  Coding DNA Sequence Number=SeqID_17187
KECALQCSYRMRSKARVMSEIEKVQEQMKADMEAMKEQMATMMEAMMSMKKMMEVNATTVVSASTAIEVDPTRPSSLNQVSPPVSMTFFPPYDLPPNYTPPNVAHAPDEDVDNSTPILIENQQPQFDHAHVSQPIEETHEAPRDHNLVDFEPHLGYATEGQAVGGRVPLAMVERRKFDHIEERLRAIEGGRDYAFADMTELCLVPDVIIPPKFKVPNFDTKVLLGQLDVSSIGACRPRIFFINGFLCFLEDEWQRNGEGRERGDATSRRR

SEQ ID NO: 108873 - protein, 360 aa, Glycine max
  Coding DNA Sequence Number=SeqID_17188
  Homolog annotation: Hit_ID=Q6Z8F0; Match level="QueryCoverage=19%, HitCoverage=61%, E-value=4e-17, Identity=68%"; Hit description =Putative uncharacterized protein P0459B01.18
SFAPIPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALTSFSSFPRGTCSLSVSRQYLALDGIYRPIGGCIPKQPDSPTAPRGATGSGHDGALTLSGAPFQGTWARSATEDASPDYNSDAEGDRFSWWAFPGSLAVTKGILRACTQRVVDGSRTDRLARDWSRAWLIHHFITAKSAMNPDFNQPRGGRALGLMASGATCVQRLDGSRDSAIHTKYRISLRLSSMQEPRYPLPRVIVCKCCVVTTPAGHRLRYEQGVAHDRFEFLGARSVG

SEQ ID NO: 108874 - protein, 226 aa, Glycine max
  Coding DNA Sequence Number=SeqID_17189
MELIENMTTSDHAILRDRTHIPTKRSLLELSSQDALLAQNKLLAKQLESLTVTLSKLPTQLQAAQPTHSGVMQIEGCSICGGAHESGGCMAQDDAFKEVNYMANHNRKGFHTGGFSGYQQGGNFNHNQGQGWRSHLGNQFNKDQGGSSNRPLNQGPNLYDRTTKVEDILTQQLKTWKSKWDIFSEKPLEKASQRSLLRKLLKEATRELLEEASYEASRESYMKLPR

SEQ ID NO: 108875 - protein, 24 aa, Glycine max
  Coding DNA Sequence Number=SeqID_17190
MHIRDLGNGPKEACLKEIQERQGG

SEQ ID NO: 108876 - protein, 186 aa, Glycine max
  Coding DNA Sequence Number=SeqID_17191
  Homolog annotation: Hit_ID=UPI00006A2D9E; Match level="QueryCoverage =77%, HitCoverage=69%, E-value=3e-09, Identity=21%"; Hit description =UPI00006A2D9E related cluster
MSKSCEFGMIGPLDESISCFLIRLDPSVLVPITFRGLHALAFRGLHVLAFRGLHVLTFRGLHALAFVGLHAFTFRGQHVLTFRGLHVLAIRGLHALTFRGLHVLAFRGSCTFTFRRLHVLASRGLHVLASRGTTCPRLQRAARPHLQRTTRPCLQRTTCPRLQRAARPHLQRTTRPRLHRTTRPHL

SEQ ID NO: 108877 - protein, 226 aa, Glycine max
  Coding DNA Sequence Number=SeqID_17192
  Subcellular localization annotation: CTP_CleavageSite=84; ConfidenceScore=5.78e-01
MLRNSPASSSDTSFLPQPSLFSERPFIGTSSFGVGITLSFCPSAIFAFPLAFAGCVGRSGGVNMQPLQVMPLSPMILVTLADSELMSAASSFLSLGGVYLHGTAWLFLYENGIGLTTKGYRGVWGVASLARHCSVEWLGVFPWYAQVALGLYHFGKGGWDGKRSPYVIGIGVNSGVGLGGKFLIALEPVPKWALPAGRVGRRTRLELRRTGDVVYTDGYRRRFAAA

SEQ ID NO: 108878 - protein, 234 aa, Glycine max
  Coding DNA Sequence Number=SeqID_17193
  Homolog annotation: Hit_ID=Q2HW90; Match level="QueryCoverage=94%, HitCoverage=42%, E-value=6e-24, Identity=34%"; Hit description =Putative uncharacterized protein
MFGSKGENLGKSRRMGPFMDVLALLIFGVVLFPNVDGLVDWAVIDAFLAFYNHKESPVVAILANLYDTFDRRCEKNCARIVCYTPALYVWLVSHLFRQKVRHVCPLEGHRSCTEIKEANWDRLLASKEEASVNWFPRWKEGRTGILISCGGFPNVPLMGTRGCINYNPVLTIRQLGYPMSGAPLEEGLAPFIARGFNNTNTRVLQRVHKAWERVQKKDEELRGSSNGPIGGYRR

SEQ ID NO: 108879 - protein, 91 aa, Glycine max
  Coding DNA Sequence Number=SeqID_17194
MVARVMLRNGFEPGMGLGKDGLENADVVDVATDPSVGGRRVTRGMRVPRKEYARSRHQHLFEENVGKTGKDAIYELLSERFGSCIYARGRY

SEQ ID NO: 108880 - protein, 150 aa, Glycine max
  Coding DNA Sequence Number=SeqID_17195
MAPKRLSAKRSRRDAAVEGTSATPEFDSHRFRSVEHQQRFEAIIGWSFHRERRKEIAHRHWTSLVTPIAKFDPDIVLEFYANAWPTEEGVRDMRSWVRGQWIPFDANALSQFLGDPLVLEEGQECEFSQRRNRADGFDEEAIAQLLCTPG

SEQ ID NO: 108881 - protein, 88 aa, Glycine max
  Coding DNA Sequence Number=SeqID_17196
MVAFVRQYQYNFDMVPDRMQLQNICKKGDGSFKEHAQKVEGSGGPGGTPNDGKGDDDRDGRHIIDTILYYEKMVGYAPSKLCGFGLRQ

SEQ ID NO: 108882 - protein, 273 aa, Glycine max
  Coding DNA Sequence Number=SeqID_17197
RSWVHGMILKEKLAACARSKRSLAQHLEATEQNMLAIIGQYKEELNQSVAHEQKLVEDFAQVYAEKEARGRVIDALHQEATMWMDRFALTLNGSQDLPRLLAKAKAMAEEQMKVDLSALKDQMASISEVMLKLQKTIEDKATTTASSTVREAEPVLQPTLNPGLDRNTAVFGGRYSPQAYPYGLPPDFTPRATPEDLSQVPTFEGQLPPYEDYPGQDDGEGDTHLGPLLHLKDPSPHELPQPNIVRHIPASPTPVKESVPFAEDKRKIEALEE

SEQ ID NO: 108883 - protein, 86 aa, Glycine max
  Coding DNA Sequence Number=SeqID_17198
  Subcellular localization annotation: CTP_CleavageSite=32; ConfidenceScore=5.25e-01
MGVQIAILKFSNLSLPGHFGSGVAYGGSNPARLAVLGEKNCFREENPSRGTSVKLPRCFREQIDEGFSSFFTVFHPFFVRSSFFNR

SEQ ID NO: 108884 - protein, 244 aa, Glycine max
  Coding DNA Sequence Number=SeqID_17199
  Homolog annotation: Hit_ID=Q6WAY6; Match level="QueryCoverage=67%, HitCoverage=27%, E-value=9e-15, Identity=33%"; Hit description =Putative uncharacterized protein
MGWWTLAAIDAFLAILANLYDTFDRRCEKSNTRIVCCTPALYVWLVSHLFRQEVRHACPLESHRSCTEKRGANWDGLLASKEGASVNWFPRWKEGRTGILISCGGFSNVPLMGTRGCISYNLVLAIRQLGYPMRGAPQEEKLAPIIARGFNKTNVEPLQKVRKAWEMVQKKDKELRGSNNGPIGDYRKWLKVHMQGLDWLPSLRTTKGEEVEAPEEDEEVLALRAELEQAQTVKERFKSAALKI

SEQ ID NO: 108885 - protein, 292 aa, Glycine max
  Coding DNA Sequence Number=SeqID_17200
  Gene Ontology: Mol. function=homoserine O-succinyltransferase activity; Cellular component=cytoplasm; Biological process =methionine biosynthetic process from homoserine via O-succinyl-L -homoserine and cystathionine
  Homolog annotation: Hit_ID=Q57H45; Match level="QueryCoverage=100%, HitCoverage=94%, E-value=1e-147, Identity=84%"; Hit description =Homoserine O-succinyltransferase
  Pfam annotation: Domain name=HTS; Domain location=2-292; Score=638.8; E_value=4.7e-189; Accession=PF04204.7; Description=Homoserine O -succinyltransferase
MPIRIPDELPAVNFLRNENVFVMTSSRASVQEIRPLKVLILNLMPKKIETENQFLRLLSNSPLQIDVQLLRIDSRESRNTPSEHLNNFYCNFDDIANDNFDGLIVTGAPLGLVDFNDVAYWPQIQRVLHWAKEHVTSTLFVCWAVQAALNILYGIPKQTRQNKLSGVYEHQILHPHALLTRGFDDNFLAPHSRYADFPSQLIRDYTDLELFAESESTGAYLMASKDKRLAFVTGHPEYDALTLSGEYHRDYEAGLHPEVPFNYFPQDNPELPPRATWRSHGNLLFSNWLNYY

SEQ ID NO: 108886 - protein, 108 aa, Glycine max
  Coding DNA Sequence Number=SeqID_17201
MWTIIDQYKEKLNLVANHEQRLKDEHAKVSALQAEKETRERVIDSLHGEAMMWMDKFDFTLNGSQELPRLLAKAKAMADVYSAPVEVHGLFDYCQHMIELMSHIIRNR

SEQ ID NO: 108887 - protein, 198 aa, Glycine max
  Coding DNA Sequence Number=SeqID_17202
  Subcellular localization annotation: CTP_CleavageSite=33; ConfidenceScore=5.56e-01
MNAGALISGQITSMAQSNSSRLKFPALITALCRTRGVASNSLVFERLSPIINLAYITPPPARIAAAPSTPPPTDFQHFKAMLRSIHQGKIILLQSLQLIAPPDSIPTVEQFNEWVAWSGTQPPPHRDDEDPAAQVPHQPTDESLESSTPEPLIRKRRVVVTQEAAATPEKSPEAIPEPLAPKADTTSPQQAADPSTLE

SEQ ID NO: 108888 - protein, 65 aa, Glycine max
  Coding DNA Sequence Number=SeqID_17203
MVTSILQLNSMNLFVKARAWFYPITQRKALLIANSSSTFHRDERLGNTHAVHGKYGFMIPTWLAH

SEQ ID NO: 108889 - protein, 251 aa, Glycine max
  Coding DNA Sequence Number=SeqID_17204
  Subcellular localization annotation: CTP_CleavageSite=32; ConfidenceScore=5.66e-01
DHFLVTAFSCLFDSGTASITPPRLQRTTRPPLQRTIRPLLQRTTRPPLQRTSRPCHQRTTRPHLQRDTHPHLHRITRPPLQRAARPRLQRTTCPRVLAIKGLHALPFRGLHAITIRGLHVLPFRGLHVLTFRGLHALAFRGLHALVFRGLLALAFRGLRVLTFKEDYMSSPLEGYTPSPSESYTPSPSKDYTSSPSKDYTFSPSEGFSPTPSEDYTSSPSEGYTLSPSEGCTPSPLEDYTSSLSEDCMSSP

SEQ ID NO: 108890 - protein, 351 aa, Glycine max
  Coding DNA Sequence Number=SeqID_17205
  Gene Ontology: Mol. function=transcription factor activity; Cellular component=nucleus; Biological process=regulation of transcription, DNA-dependent
  Homolog annotation: Hit_ID=A7PFK0; Match level="QueryCoverage=89%, HitCoverage=89%, E-value=1e-106, Identity=63%"; Hit description =Chromosome chr11 scaffold_14, whole genome shotgun sequence
  Pfam annotation: Domain name=AP2; Domain location=143-195; Score =62.5; E_value=1.5e-15; Accession=PF00847.11; Description=AP2 domain
  Pfam annotation: Domain name=AP2; Domain location=44-101; Score=49.1; E_value=1.5e-11; Accession=PF00847.11; Description=AP2 domain
  Pfam module annotation: Pfam domain module=AP2::AP2; Domain location =143-195::44-101
  Subcellular localization annotation: CTP_CleavageSite=31; ConfidenceScore=5.70e-01
MAKQQTHEINASTNNNINTTKTVTTKVKRTRRSVPRNSPPQRSSIYRGVTRHRWTGRYEAHLWDKNCWNESQNKKGRQGAYDDEEAAAHAYDLAALKYWGQDTILNFPLSTYQNELKEMEGQSREEYIGSLRRKSSGFSRGVSKYRGVARHHHNGRWEARIGRVFGNKYLYLGTYATQEEAATAYDMAAIEYRGLNAVTNFDLSRYIKWLKPNNNNNKVNSNNLIVSIPNCATNFTPNSNQQQGFNFFNSQESFNNNEEAAMTQPRPAAATSALGLLLQSSKFKEMMEMTSAIDLSTPPSESELPPCTFPDDIQTYFECEDSHRYGEGDDIMFSELNGFVPPMFHCDDFEA

SEQ ID NO: 108891 - protein, 54 aa, Glycine max
  Coding DNA Sequence Number=SeqID_17206
  Subcellular localization annotation: CTP_CleavageSite=19; ConfidenceScore=5.61e-01
MTKEVIHDHNSAAPRLHFSSSSSSSSSSSSTTFFFGFRLLKKPSSAGETHPSKL

SEQ ID NO: 108892 - protein, 97 aa, Glycine max
  Coding DNA Sequence Number=SeqID_17207
  Subcellular localization annotation: CTP_CleavageSite=13; ConfidenceScore=5.54e-01
VRNGKSTAGQSALASVAVTLRVTTTPAALNAPLQGASHSPFRLRNCWEGRSGFPSHDVVKRRPVNCNTTHYRANWSSTAVAAALELVDPPGCRNSIA

SEQ ID NO: 108893 - protein, 247 aa, Glycine max
  Coding DNA Sequence Number=SeqID_17208
  Homolog annotation: Hit_ID=A5BSR3; Match level="QueryCoverage=42%, HitCoverage=33%, E-value=6e-08, Identity=36%"; Hit description =Putative uncharacterized protein
  Pfam annotation: Domain name=Transposase_23; Domain location=161-231; Score=-6.0; E_value=0.0053; Accession=PF03017.5; Description =TNP1ENSPM transposase
MARTKKTGEMTTEAAKEITEKIDSFEEQATQGSFVPHGCQDVLAAAIGRPEHPGHVRAAGAGVTIKQYFGSAPRTSRSTSSLPPDELQQLTQQIRDQLEESIIEKVTRQVMASFSHMQSQLQSQMQSQGLAVPPEPLVGPSGPRVCTKGSCVDPSGNDPETDDSDRCGLYIKADLAHLVVMGRVYEGSTVVHNTPLLLGQVKVSVEEVIDADAPVLVPTDEVSLVGHTLHTFLAWPTHLVKSLFHEQ

SEQ ID NO: 108894 - protein, 79 aa, Glycine max
  Coding DNA Sequence Number=SeqID_17209
LYAFALFCLAVIACAVGNKGWWVYARIVDVENLLCTIARPPPKWYLEICRGGHETLGTSGGVLLPKTKLDQSRPNPGIV

SEQ ID NO: 108895 - protein, 76 aa, Glycine max
  Coding DNA Sequence Number=SeqID_17210
MPSPSEDYMPSPSEDYTSSPSEDYTSSPSEGCTSSPSEDYTSSISEDYTSSPSEGCTLSPLEGFTLSHSVGSTSAP

SEQ ID NO: 108896 - protein, 185 aa, Glycine max
  Coding DNA Sequence Number=SeqID_17211
  Gene Ontology: Biological process=transposition, DNA-mediated
  Homolog annotation: Hit_ID=Q1J7G7; Match level="QueryCoverage=22%, HitCoverage=71%, E-value=4e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNAKKYYFGKLFSIKLIDTVDLEGGPVGKPVVPAALMNRPTRGERRFAYCALAECILAYYVGTDEGVSEVLHV

SEQ ID NO: 108897 - protein, 71 aa, Glycine max
  Coding DNA Sequence Number=SeqID_17212
MVNTGMMYTITMYKDMHDKIKETRHRLPTTMHHQKRKTLDKALLSSSKSETQHDHRSTSTSYVSHRPGYRA

SEQ ID NO: 108898 - protein, 108 aa, Glycine max
  Coding DNA Sequence Number=SeqID_17213
MTRGNPGDLQPFNPKLDRTFHRLVRHIVHPGHFVHSVEGDSEYSDFEHSTTNFHTENMAQPPPRERTLREMVALDFTYESLCIQYPDEGVPYVLKTGLIHLLPKFHGL

SEQ ID NO: 108899 - protein, 85 aa, Glycine max
  Coding DNA Sequence Number=SeqID_17214
LSLSQSAGLARHPLSAPLLSAEREERSGRRMSCACSLSEGKLPSYGCGQRIKLNVLMMPKFHMRLKALFKTKKLKIFKMDDQDNL

SEQ ID NO: 108900 - protein, 148 aa, Glycine max
  Coding DNA Sequence Number=SeqID_17215
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=71%, E-value=1e-24, Identity=69%"; Hit description=LacZ protein
  Subcellular localization annotation: CTP_CleavageSite=42; ConfidenceScore=5.43e-01
MTMITPSSKLTLTKGNKSCKRYSTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 108901 - protein, 93 aa, Glycine max
  Coding DNA Sequence Number=SeqID_17216
YIKQKGNRNEEKEGVLKQAQPNTGAKRASGAKRAKKTGAKRGVELEDAESVTRAKPQLCAKRAIQQKHRLSLQGALSVRSERAKREVSRLAQI

SEQ ID NO: 108902 - protein, 140 aa, Glycine max
  Coding DNA Sequence Number=SeqID_17217
  Homolog annotation: Hit_ID=Q6UUU1; Match level="QueryCoverage=42%, HitCoverage=40%, E-value=1e-18, Identity=78%"; Hit description =Putative uncharacterized protein
MATIELSSRYGSKLAYDTGIWGRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108903 - protein, 127 aa, Glycine max
  Coding DNA Sequence Number=SeqID_17218
MTRGNPSDLQPFDPKIDRTFHRLVRHHFIPFDHSEHSITGESVHFVIGDFEHPDLEHYNFEHSDSEHSDFAHSENMAQPPPRERTLREMATPDFTYESLCIQYPDEDVPYVLKTGLIHLLPKFHGLA

SEQ ID NO: 108904 - protein, 306 aa, Glycine max
  Coding DNA Sequence Number=SeqID_17219
  Homolog annotation: Hit_ID=Q9SWB3; Match level="QueryCoverage=51%, HitCoverage=35%, E-value=7e-72, Identity=87%"; Hit description=Seed maturation protein PM39
  Pfam annotation: Domain name=DUF821; Domain location=56-240; Score= -205.4; E_value=1.7e-08; Accession=PF05686.3; Description=Arabidopsis thaliana protein of unknown function (DUF821)
  Subcellular localization annotation: CTP_CleavageSite=37; ConfidenceScore=5.55e-01
RMFSGASSSKSAQSTTPYGTSPFTVSIRKPIAPLNCTAYNLTGTCPTNLQDHQSTPATATCPDYFRWIHEDLRPWARTGITQDMVERAKQTANFRAEINIKPWHILLGELKEGTTRIPWLNREPYAYWKDTLESSGSQSWKSKVSGTQTSSVGVEQDKGVSVKDYLVDKLRPGDEDRALSEVISETLHKKELPPVEVTEEGVRKVVSDAVHKRDDDPERRMEHQRILGKVTESEEVKRRLGGESVVTEKKYQEMYVNSPGKGVVDKLKGMVGTWFTNPAENQSSQDSSMNYEAGRAEVEQVNQGAA

SEQ ID NO: 108905 - protein, 223 aa, Glycine max
  Coding DNA Sequence Number=SeqID_17220
  Homolog annotation: Hit_ID=UPI0000ECBAF8; Match level="QueryCoverage =18%, HitCoverage=48%, E-value=3e-16, Identity=100%"; Hit description= UPI0000ECBAF8 related cluster
ATLPEGRKPDRYPVSARVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLCQLSHLDFKARHLLLRPIKWSTLVLVELISQMGPPLPLLLSRPAGMQAWHWPSFYNVVTGKTLALPNLIALQHIPLSPAGVIAKRPAPIALPNSCAA

SEQ ID NO: 108906 - protein, 163 aa, Glycine max
  Coding DNA Sequence Number=SeqID_17221
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPRSARPLRLI

SEQ ID NO: 108907 - protein, 51 aa, Glycine max
  Coding DNA Sequence Number=SeqID_17222
MEDRVTTDRSSSLPGVGQAENVAVRCRIGSKMPLAIYTFGYGSKMLGFVYM

SEQ ID NO: 108908 - protein, 53 aa, Glycine max
  Coding DNA Sequence Number=SeqID_17223
MDVPLLELIHKRCTLSCSQYYSPTRWKRKNPKNSQAVNPLNLLARERRNEEEE

SEQ ID NO: 108909 - protein, 318 aa, Glycine max
  Coding DNA Sequence Number=SeqID_17224
  Gene Ontology: Mol. function=RNA-directed DNA polymerase activity; Biological process=regulation of transcription, DNA-dependent
  Homolog annotation: Hit_ID=A5B687; Match level="QueryCoverage=81%, HitCoverage=58%, E-value=2e-43, Identity=39%"; Hit description =Putative uncharacterized protein
  Pfam annotation: Domain name=MP; Domain location=73-237; Score=-14.2; E_value=0.0012; Accession=PF01107.9; Description=Viral movement protein (MP)
  Subcellular localization annotation: CTP_CleavageSite=25; ConfidenceScore=5.35e-01
MRAKILENIVIMSRLLRSFSRISFRSNSSSSSSSRNSNLLNDQDNQTQEVAPKHNLFDEEVRFEDINQNMDDWNILEIPQDQLYVPETIKDKHNFDYIIKTVENNIPLGQDIGEEFHLLSINSIYEHSPIKPLIDMGIDAAVLMCLRDIRHNQFEDSLIGTVETSLGQGPIYFNCYPNKTVSLMNINILDSLFLNIHFHGLDMKEGSIPAALIYRIQYKVMNTCASRVLLKPQKGETTFFITDMTKANVSLPRKIKWDEVTLPERWVMDKATPSIPRPAPTIEHIKQDNSGKVEITFNRRNSFSSRIEASRSEYESAR

SEQ ID NO: 108910 - protein, 250 aa, Glycine max
  Coding DNA Sequence Number=SeqID_17225
  Gene Ontology: Biological process=transposition, DNA-mediated
  Homolog annotation: Hit_ID=Q1J7G7; Match level="QueryCoverage=18%, HitCoverage=78%, E-value=3e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARGGPLGTSTLTFRGLHALAFRGLHVLAFKGLHVLAFRGLRALTFRGLHVLAFRGLHILTFRGLHVLAFRGQHALTFRGLHILTIRGLHALTFRGLDVLTFRGLDVLTFRGLHVLAFRGLCVLTFILASLPDIGGRPTVLAQPEREAITQLLCIPGQDFTRVGAKRR

SEQ ID NO: 108911 - protein, 143 aa, Glycine max
  Coding DNA Sequence Number=SeqID_17226
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=72%, E-value=2e-24, Identity=70%"; Hit description=LacZ protein
MRPYPIFCNPSGNSLRVYISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 108912 - protein, 102 aa, Glycine max
  Coding DNA Sequence Number=SeqID_17227
KFHELVKKRRIEWRQNFNHGKRFQEDSTTLRCYKRNQLGLIKANCPSNKQWPEKNEKKSHEERRFKKAYIAWDDNDSSDGSEKEINLLYKDYESNKNISQED

SEQ ID NO: 108913 - protein, 114 aa, Glycine max
  Coding DNA Sequence Number=SeqID_17228
DAGSRQARQGASAGVGGCRGWLNYAASEQIVLRVHHMRAIGAGLFAITPAGERGMCCKAIKLGNARVFPVTTLSTLEDPRFGVKANPNKKHLVLNLPGFILKVDSISDVIVLGE

SEQ ID NO: 108914 - protein, 130 aa, Glycine max
  Coding DNA Sequence Number=SeqID_17229
  Gene Ontology: Mol. function=nucleic acid binding; Cellular component= ribonucleoprotein complex; Biological process=mRNA processing
  Homolog annotation: Hit_ID=A9PGS9; Match level="QueryCoverage=62%, HitCoverage=40%, E-value=6e-23, Identity=69%"; Hit description =Putative uncharacterized protein
  Pfam annotation: Domain name=RRM_1; Domain location=37-97; Score =31.5; E_value=3e-06; Accession=PF00076.13; Description=RNA recognition motif. (a.k.a. RRM, RB
SVVRYPLILWITVLPPLSELIPLAAAERPSAARNSYDHDYEFELGTQPGVLSAKVIYERDSGRSRGFGFVSFETAESAQAALDIMNGVEVQGRPLRLNLAEARAPSSPPVIQKNVGSNVESSELVSSAST

SEQ ID NO: 108915 - protein, 174 aa, Glycine max
  Coding DNA Sequence Number=SeqID_17230
  Subcellular localization annotation: CTP_CleavageSite=23; ConfidenceScore=5.15e-01
MVIGDFISRLSFPVGIFVSLAKACSHFSGVNTETFSSLTSYPELRRSEFLIGGYVGARASLLSTAPLFVAMTQELVTRGDTLRLSAPRHSVTPSVIDEQRPIWSSAPFPEMSAFSDGDFSSLTSYPELRRSEFLIGGYVGTKSLAFVGRPIIFVILTLRSGDVHPCIIQRRRAR

SEQ ID NO: 108916 - protein, 70 aa, Glycine max
  Coding DNA Sequence Number=SeqID_17231
  Homolog annotation: Hit_ID=UPI0000ECBAF8; Match level="QueryCoverage =58%, HitCoverage=48%, E-value=1e-16, Identity=100%"; Hit description= UPI0000ECBAF8 related cluster
MESPINGVGSLSESRPAGMQAWHWPSFYNVVTGKTLALPNLIALQHIPLSPAGVIAKRPAPIALPNSCAA

SEQ ID NO: 108917 - protein, 705 aa, Glycine max
  Coding DNA Sequence Number=SeqID_17232
  Gene Ontology: Mol. function=methyltransferase activity; Cellular component=cytoplasm; Biological process=methylation
  Homolog annotation: Hit_ID=A7MEX5; Match level="QueryCoverage=100%, HitCoverage=100%, E-value=0.0, Identity=77%"; Hit description =Putative uncharacterized protein
  Pfam annotation: Domain name=Cons_hypoth95; Domain location=520-685; Score=-58.2; E_value=0.0074; Accession=PF03602.6; Description =Conserved hypothetical protein 95
  Pfam annotation: Domain name=MTS; Domain location=508-684; Score= -83.8; E_value=0.017; Accession=PF05175.5; Description=Methyltransfera se small domain
  Pfam annotation: Domain name=Methyltransf_11; Domain location=543 -654; Score=0.4; E_value=0.077; Accession=PF08241.3; Description =Methyltransferase domain
  Pfam annotation: Domain name=THUMP; Domain location=56-154; Score =53.6; E_value=6.7e-13; Accession=PF02926.8; Description=THUMP domain
  Pfam annotation: Domain name=UPF0020; Domain location=162-377; Score =284.7; E_value=1.8e-82; Accession=PF01170.9; Description=Putative RNA methylase family UPF0020
  Pfam module annotation: Pfam domain module=Cons_hypoth95::MTS::Methylt ransf_11::THUMP::UPF0020; Domain location=520-685::508-684::543 -654::56-154::162-377
MNSLFASTARGLEELLKTELDALGAQDLQVVQGGVHFRADDRVMYQSLLWSRLASRILLPLGEFGVWSDLDLYVGAQSIPWSELFDSNTTFAIHFSGTNEVIRNSQFGALRIKDAIVDSFTRQNLERPSVDREQPGIRINAWLNKDRVSIALDLSGTALHQRGYRQQTGQAPLKENLAAAIVMRSGWQSGTPLVDPMCGSGTLLIEAALIACDRAPGLLRSHWGFSRWKRHNNALWQEVRSDALQRARAGTAATTSRFFGYDNDGRVLEWARANARRAGVFDLFTFAQQDVLQLKNPLAGEAMRGTVLSNPPYGERLESEPALIALHSQLGRIMKQQFGGWNLSLFSASPELLSCLQLRADRQFKAKNGPLECVQKNYQLAENSAEGGAQIAEDFANRLRKNSKKLDKWARQSNIDCYRLYDADLPEYNVAVDRYADWVVIQEYAPPKTVDATKARQRLFDVIGATLSVLEIPANRLVLKTRERQKGKNQYQKLSEKGEFFEVQEFNARLLVNLTDYLDTGLFLDHRIARQMLGQMSQGKDFLNLFSYTGSASVHAGLGGAKSTTTVDMSRTYLEWAERNLRLNGLTGRQHRLMQADCLSWLRESDEQFDLIFIDPPTFSNSKRMEDDFDVQRDHLMLLQNLKRMLRRGGTIMFSNNKRGFKMDLDGLQRLGLQAQEITQKTLSQDFARNRQIHNCWLVSHAGKE

SEQ ID NO: 108918 - protein, 47 aa, Glycine max
  Coding DNA Sequence Number=SeqID_17233
MGGRCEGSRVRLPREENVRSRHQRLFEENVEKTGKGVSLAPTYPQLR

SEQ ID NO: 108919 - protein, 45 aa, Glycine max
  Coding DNA Sequence Number=SeqID_17234
MVLVLCKDMKSCTSYLQTGLSVELQRKEKATKERKGSPILSSSFD

SEQ ID NO: 108920 - protein, 37 aa, Glycine max
  Coding DNA Sequence Number=SeqID_17235
MAMTCIQFHAKMALQTSRALESFWFSSMLKMIKGTIE

SEQ ID NO: 108921 - protein, 79 aa, Glycine max
  Coding DNA Sequence Number=SeqID_17236
MKVPQPRSREVTSDPPIPVVDLSSPQHAIDPSTPILEIPEDLTTPVLTLNTSPPATPVLHLTDEEDVQTQDTQDQSQEF

SEQ ID NO: 108922 - protein, 102 aa, Glycine max
  Coding DNA Sequence Number=SeqID_17237
  Gene Ontology: Mol. function=strictosidine synthase activity; Cellular component=endoplasmic reticulum; Biological process =biosynthetic process
  Homolog annotation: Hit_ID=A7QJJ7; Match level="QueryCoverage=89%, HitCoverage=24%, E-value=9e-33, Identity=74%"; Hit description =Chromosome chr8 scaffold_106, whole genome shotgun sequence
MQLARQVSRLESGQSDCVRPFAPELEHICGRPLGLRFDKKNGDLYIADAYLGLKVVGSAGGLATEVVTEVEGQPLQFTNDMDISEDEEVIYFTDSTTIFQRR

SEQ ID NO: 108923 - protein, 107 aa, Glycine max
  Coding DNA Sequence Number=SeqID_17238
MKREERRTSCDLYWSFPLPAHYVQPINNPTLEIYPLSLDNAFLVFKNSPYKPRDSQSLNPFSEAFSTFTGIGCKPLVYLLKQPALLSVDFQDRSIRDYSSCTLVGLL

SEQ ID NO: 108924 - protein, 16 aa, Glycine max
  Coding DNA Sequence Number=SeqID_17239
MYTGLQELSMQKNLFQ

SEQ ID NO: 108925 - protein, 168 aa, Glycine max
  Coding DNA Sequence Number=SeqID_17240
MEVLYTKVSRIDRLTIAQSNSCRLRFPALIIALCRARGVVSNSLTFERLSPAINLAYIRKNCWNVDDLTVAFRGAKRARARPADIPSTSAAPAPTPASTSAAPSVPAHVDYERFKAMLQISVATYPSAGGRRGTHGMRVPQKEYARSRHQRLFEENVGKTGKGAIYEL

SEQ ID NO: 108926 - protein, 116 aa, Glycine max
  Coding DNA Sequence Number=SeqID_17241
MGLGKDSHGNADVVDIWGNPYKYGLGYEPGRPGRRNAPSRLRADRAWPGHVSQCFTSAGTMFEEEVAAIGEESPQDPTSFVCEGRFFEDPNNEGLIINFDREVSLTMNEGGEEDVL

SEQ ID NO: 108927 - protein, 48 aa, Glycine max
  Coding DNA Sequence Number=SeqID_17242
  Homolog annotation: Hit_ID=A0ST23; Match level="QueryCoverage=93%, HitCoverage=91%, E-value=1e-11, Identity=73%"; Hit description =Putative reverse transcriptase
MAGTELEFVIMVIAVSFGKPVVPAALMNRPTRGERRFAYWALFRFLAH

SEQ ID NO: 108928 - protein, 160 aa, Glycine max
  Coding DNA Sequence Number=SeqID_17243
  Homolog annotation: Hit_ID=Q2HTA0; Match level="QueryCoverage=47%, HitCoverage=11%, E-value=1e-15, Identity=53%"; Hit description=IMP dehydrogenase/GMP reductase, related
  Pfam annotation: Domain name=DUF1723; Domain location=36-85; Score =62.7; E_value=1.3e-15; Accession=PF08330.1; Description=Protein of unknown function (DUF1723)
YKSISSTALIGTPVPEIEGLVPTTGLSPLIGCLVVTGDPGLISTFVERWHRETNTFHLPVGELTITLDDVSSLLHLPISGAFHSYEALSVDETIFLLMELLEVSGEEARAEIRLFATWVRVGAMPGELPRCVASRSTFRVCISASSMMRMRRRPHVPPGG

SEQ ID NO: 108929 - protein, 68 aa, Glycine max
  Coding DNA Sequence Number=SeqID_17244
MWYHVSEKPPWGAQKSLSLSKIIGRPVRVTMFCKNAPTIWDQHRLKGALKPGDPQGLHFKESVRASPS

SEQ ID NO: 108930 - protein, 16 aa, Glycine max
  Coding DNA Sequence Number=SeqID_17245
MEEAEKEILETFRTVE

SEQ ID NO: 108931 - protein, 147 aa, Glycine max
  Coding DNA Sequence Number=SeqID_17246
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPAANA

SEQ ID NO: 108932 - protein, 73 aa, Glycine max
  Coding DNA Sequence Number=SeqID_17247
MADTTSPQQAADPSTPEDQTTLVQSPNASLVSTPVLHLTDEEEYMSYPNFARGPSVNGMRPSFDHFEVLGTHR

SEQ ID NO: 108933 - protein, 136 aa, Glycine max
  Coding DNA Sequence Number=SeqID_17248
  Homolog annotation: Hit_ID=A0ST23; Match level="QueryCoverage=23%, HitCoverage=65%, E-value=1e-11, Identity=100%"; Hit description =Putative reverse transcriptase
DAGSRQARQGASAGVGGCRGWLNYAASEQIVLRVHHMRAIGAGLFAITPAGERGMCCKAIKLGNARVFPPHHTEELDPEKLEEQATVLEKELILKGYRARIRNHVGKPVVPAALMNRPTRGERRFAYWALFRFLAH

SEQ ID NO: 108934 - protein, 137 aa, Glycine max
  Coding DNA Sequence Number=SeqID_17249
  Homolog annotation: Hit_ID=A5ZQM3; Match level="QueryCoverage=52%, HitCoverage=99%, E-value=8e-23, Identity=55%"; Hit description =Putative uncharacterized protein
VEGKEGLLLGGPEPSVRYHSGRARILTLCQDLRAEGQSQVDSFYGAYASQKVTEACKGFLGPDGDWPSSAKAEGSLTARPTRRAGTKVGLSDPTVPSGRAVAQRIKGWAVRPLKRYVSWVQNVVRQFGPYPVWALEH

SEQ ID NO: 108935 - protein, 76 aa, Glycine max
  Coding DNA Sequence Number=SeqID_17250
  Homolog annotation: Hit_ID=A5AWE7; Match level="QueryCoverage=98%, HitCoverage=8%, E-value=8e-08, Identity=33%"; Hit description =Putative uncharacterized protein
MLISMLKKYTNGRDLVRPVLRSEKKNVSICLKAAAPLMVVLRLVDSDQQPAMGFIYVEMDCAKERIKSNFNNVKKK

SEQ ID NO: 108936 - protein, 83 aa, Glycine max
  Coding DNA Sequence Number=SeqID_17251
MQKGLWTRQYLNNTELSLSYPNFVRGPLLDDMRPFFGPSPRPTWALQNIPPEGCCFWRKQPGSPGRAELAWASWAATTSPILL

SEQ ID NO: 108937 - protein, 68 aa, Glycine max
  Coding DNA Sequence Number=SeqID_17252
MVFHLRLVMSFKIKKGEHRLKGAIKGINSRHVKKEVLTRVKPRLLCKQSMGQNTSNKIDDDGSNSHQG

SEQ ID NO: 108938 - protein, 121 aa, Glycine max
  Coding DNA Sequence Number=SeqID_17253
  Homolog annotation: Hit_ID=Q949K7; Match level="QueryCoverage=41%, HitCoverage=56%, E-value=7e-09, Identity=54%"; Hit description =Putative gag polyprotein
MPQPNIVGASQHRPLQPLRFSVGRLPPSVEGREKWELIEERLMAIEGFGDYPFTDMAKLYLMLDVVIPPKFKMGAYFRDEKLLMHFFQESLARAMVTWYTNLEASRIHSRKDLITAFIRHY

SEQ ID NO: 108939 - protein, 177 aa, Glycine max
  Coding DNA Sequence Number=SeqID_17254
VAVSPAKPPPKPDPEVDDPLYLMKLTIPELFLRPYQVRWDATVFEVFNLDFSLYIKHEDLSEIAHDGQRLNISVLQLWILPDNYLKGIINSAIKGLDDAPQPKSKASARWIVVKCNRQKGSTECGYYVMHWMSTIILGTFRNNWEAYFNDPRPLEPERLKALRIQWAQFYLRVRDQA

SEQ ID NO: 108940 - protein, 93 aa, Glycine max
  Coding DNA Sequence Number=SeqID_17255
MIGDLGQEYVQQAHAPMYETLQSYSKKPFVFGVQEVFVVVVSGVKSGGARYASKGKHVAKKLLSGEEDTVPNGYEDDDECSSDESPKKDPLAK

SEQ ID NO: 108941 - protein, 103 aa, Glycine max
  Coding DNA Sequence Number=SeqID_17256
MTVKEFICKDGPWDLNNLEQLLLRPLCEDISLLNPPKDDAVPLFGSIWRWKGTKRMRPLMWKIVNVDVAIRSSDNEVACSGIVRHHHGNFLHDFMADLDCVLF

SEQ ID NO: 108942 - protein, 139 aa, Glycine max
  Coding DNA Sequence Number=SeqID_17257
MPSTICRDRARKTPCGPGEVQQGPEVSNSGIAPARHPGDPEKSNRVLGFLALIKGLCQFYGVPVALNKVIRPPTNQAFIKKYCTPKQAQGETPQQPRDGRQWATDTPPPPPNPLSSSTKARVLPMTRGRPVDDQVQSQR

SEQ ID NO: 108943 - protein, 55 aa, Glycine max
  Coding DNA Sequence Number=SeqID_17258
AHMAQEEGTSRFQIPEPSPTPAPEETQPSTPVTEPEQPIQDSSAAPTLDLNEDQP

SEQ ID NO: 108944 - protein, 51 aa, Glycine max
  Coding DNA Sequence Number=SeqID_17259
MAEDQPRRVTLEDYSSFVVPQFFTSIVRPELYKAFISWPTDETHMHTGRLH

SEQ ID NO: 108945 - protein, 66 aa, Glycine max
  Coding DNA Sequence Number=SeqID_17260
  Homolog annotation: Hit_ID=A6FJQ2; Match level="QueryCoverage=57%, HitCoverage=84%, E-value=4e-10, Identity=86%"; Hit description=50S ribosomal protein L5
MRKEYIPHQAPFAIQAAQLLGRAIGSGLFAITPAGERGMCCKAIKLGNARGITKEDALIHLSIKFT

SEQ ID NO: 108946 - protein, 78 aa, Glycine max
  Coding DNA Sequence Number=SeqID_17261
MSELREIPFAPEKKESHEDSTSGDFNHFSVSLTFGNSIRAVGGKTEGILGNARDAAVTVGRHMSPLRGYEMMIQTVRM

SEQ ID NO: 108947 - protein, 140 aa, Glycine max
  Coding DNA Sequence Number=SeqID_17262
MTTLTQIWMTLLLSNIPLGDRNADLPLRKHQLDHTRKTPSGPGEVQQGPGVSSSSYGPLSVLQGARSPQQGHAILGVAPTRHLVDPKEPNRALGFPALVTGLCQTYRAPVPPASSSHRDIGTAPARHPVDLKKSNRVLGF

SEQ ID NO: 108948 - protein, 209 aa, Glycine max
  Coding DNA Sequence Number=SeqID_17263
  Homolog annotation: Hit_ID=Q6UUU1; Match level="QueryCoverage=28%, HitCoverage=40%, E-value=2e-18, Identity=78%"; Hit description =Putative uncharacterized protein
GTSYVPINVSFSPKVGPGLPGINRDTRIYLFCEVISVTAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 108949 - protein, 230 aa, Glycine max
  Coding DNA Sequence Number=SeqID_17264
MENQEEWVPFADILALLIVGVVLFPNVDGLVDLAAIDAFLAYHHSKESPVVAILADLFDTFDRRGQNNQLVSSMEGRKGGSSLLMWGLPQTRTRGCINYNPALSIRQLGYPMRGAPTEESLSPFLVRDFGAQSFKIVQRVRKAWESPLRKDKELKGIRNGVIGGYHEWLRVHTRGLDWLSKLKIINEENFEAPEEDEEVQALKTELGKARLAKEKFKLAATDIRKECAEL

SEQ ID NO: 108950 - protein, 140 aa, Glycine max
  Coding DNA Sequence Number=SeqID_17265
  Homolog annotation: Hit_ID=Q8U4W0; Match level="QueryCoverage=100%, HitCoverage=64%, E-value=1e-47, Identity=65%"; Hit description =Putative uncharacterized protein
MRLVLADIDAHAGDASPEADAMRLGFAETYMRHALSCLPANGDVWLRLAMVRSLRNASAMEIAVLTNFSQLYGPADANLIRGRFVIWQQFTKGALPQAEAAREADTAIVCGRQGEILRWSLRHVCSQELQTGMQSAKPRP

SEQ ID NO: 108951 - protein, 18 aa, Glycine max
  Coding DNA Sequence Number=SeqID_17266
MVQGKFVPNLGEVLSRES

SEQ ID NO: 108952 - protein, 118 aa, Glycine max
  Coding DNA Sequence Number=SeqID_17267
  Gene Ontology: Mol. function=aspartic-type endopeptidase activity; Biological process=proteolysis
  Homolog annotation: Hit_ID=A7Q2C1; Match level="QueryCoverage=100%, HitCoverage=58%, E-value=1e-23, Identity=39%"; Hit description =Chromosome chr1 scaffold_46, whole genome shotgun sequence
MVATAYQTSHECLEETIIDILVAGFSGQLKGCAVKTDLNGKVITNDDDKEIPDAVNTLIFTIAQHFIGDPSLWKDRTLADFRWYRDTFLTRVYTREDSQQPFWKEKFLAGLPRSLGDK

SEQ ID NO: 108953 - protein, 429 aa, Glycine max
  Coding DNA Sequence Number=SeqID_17268
  Gene Ontology: Mol. function=phenylacetate-CoA ligase activity; Biological process=metabolic process
  Homolog annotation: Hit_ID=A8GGE3; Match level="QueryCoverage=100%, HitCoverage=98%, E-value=0.0, Identity=96%"; Hit description =Phenylacetate-CoA ligase
  Pfam annotation: Domain name=AMP-binding; Domain location=15-360; Score=-1.6; E_value=2.9e-07; Accession=PF00501.19; Description=AMP -binding enzyme
MTINPQPLETIEFASRDEIEALQLARLKWTLHHAYDNVPMYKRKFDQAGVHPDDLKQLSDLARFPYTTKQDLRDNYPFDTFAVPMEQVVRIHASSGTTGRPTVVGYTQRDIDNWADIVARCLRAGGATAKDKVHVAYGYGLFTGGLGAHYGAERLGATVIPMSGGQTERQAQLILDFKPDIIMVTPSYCLTLIDELERKMGGDARGCSLRLGVFGAEPWTEALRHEIETRMGIKALDIYGLSEVMGPGVAMECLESGGGPTIWEDHFLPEIICPETGVALPDGEHGELVFTTLTKEALPVIRYRTRDLTRLLPGDARQMRRMGKITGRSDDMLIIRGVNVFPSQVEEQIMQFEQLSPHYQLQVSRSGHLDTLAVRVELKESALSLSHQQRCDICHQLRHHIKSIVGVSTDVSIANCGDIPRSEGKAQRV

SEQ ID NO: 108954 - protein, 98 aa, Glycine max
  Coding DNA Sequence Number=SeqID_17269
  Subcellular localization annotation: CTP_CleavageSite=56; ConfidenceScore=5.39e-01
MFTSGSLRNSQEKNKMKDCKKTSGEDVSFPTRFSRPLINSSQALKLAPTSSSGLCRSSHNKISQNSLELGPFSLETLDMQSSESQSKTPLTKSDFRIK

SEQ ID NO: 108955 - protein, 98 aa, Glycine max
  Coding DNA Sequence Number=SeqID_17270
MESYVFANAGTESSYGRAAKPKVYSGLPGNDNMDPIGQAIVGLVPLALSRTGQLATSRARSWRDAGGAVVGHPRRGEGNKSTKPSSTERAGAVVVAVK

SEQ ID NO: 108956 - protein, 173 aa, Glycine max
  Coding DNA Sequence Number=SeqID_17271
  Homolog annotation: Hit_ID=Q9AVH2; Match level="QueryCoverage=24%, HitCoverage=14%, E-value=6e-17, Identity=97%"; Hit description =Putative senescence-associated protein
  Pfam annotation: Domain name=LRR_1; Domain location=16-38; Score =13.0; E_value=1.1; Accession=PF00560.24; Description=Leucine Rich Repeat
  Pfam annotation: Domain name=LRR_1; Domain location=41-77; Score=5.2; E_value=34; Accession=PF00560.24; Description=Leucine Rich Repeat
  Pfam module annotation: Pfam domain module=LRR_1::LRR_1; Domain location=16-38::41-77
FTSSMILQWLSNVTSNLVELDLSGNLLEGSTSNHFGRVMNSLEHLDLSYNIFKGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQ

SEQ ID NO: 108957 - protein, 62 aa, Glycine max
  Coding DNA Sequence Number=SeqID_17272
MKNLIWCSTGKNVTLWFKKVSCWDTRFLEEELRWIRQRLRCCAGTAKGQNFSYHLLCQQSLE

SEQ ID NO: 108958 - protein, 218 aa, Glycine max
  Coding DNA Sequence Number=SeqID_17273
  Gene Ontology: Biological process=transposition, DNA-mediated
  Homolog annotation: Hit_ID=Q6UUU1; Match level="QueryCoverage=27%, HitCoverage=40%, E-value=2e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108959 - protein, 50 aa, Glycine max
  Coding DNA Sequence Number=SeqID_17274
SVQGRGRMAQRLAEAQAGEAPAEAPGDADEARMDEEMTNLLDFLGGSGAT

SEQ ID NO: 108960 - protein, 115 aa, Glycine max
  Coding DNA Sequence Number=SeqID_17275
  Homolog annotation: Hit_ID=A5BP71; Match level="QueryCoverage=65%, HitCoverage=19%, E-value=2e-09, Identity=44%"; Hit description =Putative uncharacterized protein
MVVIVNAEACGYMSMNYYQYIDVVYTNEHILKAYSAQWWPLGNEAAIPHSNDAWTLIPDPNTIRAKGRPKSTRIRNEMDWVEPFEHRQKYSRCGAEGHNRRRCPMQFERGSCSNH

SEQ ID NO: 108961 - protein, 59 aa, Glycine max
  Coding DNA Sequence Number=SeqID_17276
MTLRQHESKLGGLGSSSPMESFASRRSVTAEWRRRKGHWRCHFKEKMSQEQAHHYRSHG

SEQ ID NO: 108962 - protein, 156 aa, Glycine max
  Coding DNA Sequence Number=SeqID_17277
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=2e-25, Identity=57%"; Hit description =Putative uncharacterized protein
MTMITPSSKLTLTKGNKSCIEHREIQVFNGGRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 108963 - protein, 64 aa, Glycine max
  Coding DNA Sequence Number=SeqID_17278
MDNHQHRNHSDPTQARIKKKANIPDSSEDESFESTQGSASVSSPENQNYMSSANEPAINREGNN

SEQ ID NO: 108964 - protein, 98 aa, Glycine max
  Coding DNA Sequence Number=SeqID_17279
  Subcellular localization annotation: CTP_CleavageSite=72; ConfidenceScore=5.20e-01
GNGSLILPLGTGARTTTPNVTHPSPTYRLGGTSDIQLSRILSAADMRDFSWIRSFALTEAFGPSEKDFISLRASKRERSKQSRSFARSKTRKQSCRIS

SEQ ID NO: 108965 - protein, 91 aa, Glycine max
  Coding DNA Sequence Number=SeqID_17280
MSNQKSTESAIKNLEVQVGQLAKQLEDRPSSSFGANTEKNPKEECKAVMTRSKMVSINEGEKRICEEKQQLVTEPEIDPVVEPLSETEEEV

SEQ ID NO: 108966 - protein, 191 aa, Glycine max
  Coding DNA Sequence Number=SeqID_17281
  Subcellular localization annotation: CTP_CleavageSite=16; ConfidenceScore=5.30e-01
MCPPPSKVNTKGAPKKSMKRSQRSTKRDPSYCEYIDAFHFVQSSNSSVKRSASSSEPPKPTRIIPMLDQFAPFIQDFIHNVVDVKADGNCGYRSIVGLLERFEQLRLSLLVDGFFKVSVDKWMDITEMGYVIPSRYNIYLKDHCPLPPLALLWSTNCYSQAKQWPTSYVSRMQQYTSLMSFKRDYVDLNED

SEQ ID NO: 108967 - protein, 63 aa, Glycine max
  Coding DNA Sequence Number=SeqID_17282
MLVRMIHTRLFAAARVKFCPGIHSSCVIASLSGCACTVGRPPISGGEGMQPSEVQDVSPFEGE

SEQ ID NO: 108968 - protein, 51 aa, Glycine max
  Coding DNA Sequence Number=SeqID_17283
MSKGVRKQSEGGACHPARPGELGCFLQKAPPSRELPGRPKWAWLLFAPPGY

SEQ ID NO: 108969 - protein, 26 aa, Glycine max
  Coding DNA Sequence Number=SeqID_17284
MGLKFHDDPTVNESEIIVLLRQIGYS

SEQ ID NO: 108970 - protein, 145 aa, Glycine max
  Coding DNA Sequence Number=SeqID_17285
MAKGCGMTKFCLRVSSGPPPLDDKGCRMTNFCLCAPSDTVVSEMAKGCGMTKFCFRVSSGPPPLDDKGCMNDQFLSLHCHRTRLCLNGKGVRNDQICLRMSHDLRGSPRITNSWVMATKGGVVDKSEALAPTYPPMRNSDLRSSG

SEQ ID NO: 108971 - protein, 250 aa, Glycine max
  Coding DNA Sequence Number=SeqID_17286
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLDVISVVTTKVKISSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108972 - protein, 40 aa, Glycine max
  Coding DNA Sequence Number=SeqID_17287
MAPSLYRILGCLAATFYARPAPGRDDDRLVVTLSSICVRP

SEQ ID NO: 108973 - protein, 68 aa, Glycine max
  Coding DNA Sequence Number=SeqID_17288
MLRMMHAPDLNSQMQYGTYRIQYQGNRLSVLTPHLGNHAVFCRGHPVVHRNSPPPPPVISLGHKGVPY

SEQ ID NO: 108974 - protein, 89 aa, Glycine max
  Coding DNA Sequence Number=SeqID_17289
MPKLSPNMHVNQEVSTRVKPRLLSKQSMGKNTANKINDDGSKSYEGEKQGFQFTKFQETPISKTITHYLYITKNSKRNMQCCTQNIKPK

SEQ ID NO: 108975 - protein, 82 aa, Glycine max
  Coding DNA Sequence Number=SeqID_17290
MGGVACARQGDLNTYCLVFLSESVVWTHLSYFLGDGTTLHLRVEVSKAFQVNFDDAKDSSQESRVKQVSRIKESFNQESRLK

SEQ ID NO: 108976 - protein, 57 aa, Glycine max
  Coding DNA Sequence Number=SeqID_17291
MVFHLRLVVSFKTRKGKQGSKGLSKELIQELSQGYVQAINGAKHTNDYMMDGSNSHK

SEQ ID NO: 108977 - protein, 257 aa, Glycine max
  Coding DNA Sequence Number=SeqID_17292
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLAGAVFNGVADWGRIAFKVCFWGKGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108978 - protein, 54 aa, Glycine max
  Coding DNA Sequence Number=SeqID_17293
MFGMENAKHMATPMSTACYLDKDETGQLIDIKKYRDAKLIERALVKLVILLVPL

SEQ ID NO: 108979 - protein, 110 aa, Glycine max
  Coding DNA Sequence Number=SeqID_17294
QHQLDLAPYASEPYNAQWNAPGLLRDKHTLRSNRILGEMEVDEPWLGLFHCKIHFLVGVLVYAKGMAFVDDWVVGNEKGCYWLSNDIVGLVGNLVTHFDPFVGEDHIIKA

SEQ ID NO: 108980 - protein, 140 aa, Glycine max
  Coding DNA Sequence Number=SeqID_17295
LPSTLRGLHALALRGLHVLTIRGLPRPHLQRATCPRLERANTSSPWVLVTLTSRGLHVLALRGLHVLTIRGLHALTSRGLQVLALRGLHALTLGTSYPHRQRATCPHLERTTRPRQQRAARPHLQRTTPPRLERAARPHL

SEQ ID NO: 108981 - protein, 190 aa, Glycine max
  Coding DNA Sequence Number=SeqID_17296
  Gene Ontology: Biological process=transposition, DNA-mediated
  Homolog annotation: Hit_ID=Q1J7G7; Match level="QueryCoverage=24%, HitCoverage=78%, E-value=2e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIRRFLQKAVASGGSNPARLGELGGKHLPYFAINRGGSEVEKADALPKRFREEFREGFRPFFDVLHSFFIVLRSST

SEQ ID NO: 108982 - protein, 269 aa, Glycine max
  Coding DNA Sequence Number=SeqID_17297
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPWSDSSPEWTDRIKHKLKHVPQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 108983 - protein, 96 aa, Glycine max
  Coding DNA Sequence Number=SeqID_17298
  Gene Ontology: Biological process=transposition, DNA-mediated
  Homolog annotation: Hit_ID=Q1J7G7; Match level="QueryCoverage=31%, HitCoverage=42%, E-value=2e-10, Identity=100%"; Hit description =Transposase
ARNIQLKRVWILEYIEQLNWKCLKNVLYDAIGDISTGHQDLFILRSDLPSQWLLFLSAVPPVQLLTGWCVTAKAPPDISAGKCSGHAARNHHTRRA

SEQ ID NO: 108984 - protein, 149 aa, Glycine max
  Coding DNA Sequence Number=SeqID_17299
  Homolog annotation: Hit_ID=Q6Z8F0; Match level="QueryCoverage=46%, HitCoverage=61%, E-value=6e-18, Identity=68%"; Hit description =Putative uncharacterized protein P0459B01.18
SGHDGALTLSGAPFQGTWARSATEDASPDYNSDAEGDRFSWWAFPGSLAVTKGILRACTQRVVDGSRTDRLARDWSRAWLIHHFITAKSAMNPDFNQPRGGRALGLMASGATCVQRLDGSRDSAIHTKYRISLRSSSMQEPRYPLPRVI

SEQ ID NO: 108985 - protein, 47 aa, Glycine max
  Coding DNA Sequence Number=SeqID_17300
MMTKVMTDQSKNNSSDQVRIKNNSRVQDRIKKNSDTRGKLRVMNQDS

SEQ ID NO: 108986 - protein, 98 aa, Glycine max
  Coding DNA Sequence Number=SeqID_17301
  Subcellular localization annotation: CTP_CleavageSite=60; ConfidenceScore=5.20e-01
MYEYPRRTRALMSNHSFPNSYGCSCFVGKRKCLRRNSPRRGLEETPQRKGPVPPPSLIVTVSGAPSTSSASRPSKDGRSTERGASSSRRMSIQTFRRR

SEQ ID NO: 108987 - protein, 158 aa, Glycine max
  Coding DNA Sequence Number=SeqID_17302
MTARKCKSIDSRPTVQYDTRIFHSLDAWNRYTDNVLGRNILQERKVELYHTEFDDFKTELKRCNLHKRLTNLVDGSIDVALVKEFYANLYNSEGPSPKQARVRGHLVKINADSLNTFLETPVVLAEGETLSTYSRYCRLLQILGRLRLLYAYQAEGSS

SEQ ID NO: 108988 - protein, 66 aa, Glycine max
  Coding DNA Sequence Number=SeqID_17303
MEIVPWWGKNNRGRAFTGMNVKWARRLLDGVDKRRRGGGGLIYPKVSYILRLGLWSSSFGHQTLGA

SEQ ID NO: 108989 - protein, 146 aa, Glycine max
  Coding DNA Sequence Number=SeqID_17304
MGEVEEVQEEMKADMEAMKEQMATMMEAMMIMKKIMEASAVAVAATSTVAKVNPMPPSGLNQMNHPTSAMVGKDLGSMGGPHDVQIQNEHAFPPYGLAPNYTPPNTLPMRMSITPLLYPLRANNPKLIMHMSLKPWGRHMKFPTTI

SEQ ID NO: 108990 - protein, 91 aa, Glycine max
  Coding DNA Sequence Number=SeqID_17305
MKDAGEEQVRPEIATTPERSLEGTSEPPAPVVDLSSPQPAADPSTLVVDTPEDQTTPVLTLNTSPPATPVLHLTDEEDVQTQDTQDLSQDF

SEQ ID NO: 108991 - protein, 136 aa, Glycine max
  Coding DNA Sequence Number=SeqID_17306
  Homolog annotation: Hit_ID=Q6UUU1; Match level="QueryCoverage=52%, HitCoverage=48%, E-value=4e-27, Identity=83%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPAVRSKLDCMHELPRSVSTAAPYPVTIVLSPTRKDMQKHHWQQPLVIDLEELVLKSCAG

SEQ ID NO: 108992 - protein, 104 aa, Glycine max
  Coding DNA Sequence Number=SeqID_17307
DCHHQKGGDCGSNDFQDYFDDAEESKVKQVPKNQESKKLQESSFKESRFKNNQVSRFKIQDSRTIKFEESRFKYNQDQDSRLKIQESREDSIKISTEKVFQNIE

SEQ ID NO: 108993 - protein, 70 aa, Glycine max
  Coding DNA Sequence Number=SeqID_17308
  Gene Ontology: Mol. function=4 iron, 4 sulfur cluster binding; Cellular component=integral to membrane; Biological process=protein -chromophore linkage
  Homolog annotation: Hit_ID=Q1ACL3; Match level="QueryCoverage=100%, HitCoverage=14%, E-value=5e-29, Identity=66%"; Hit description =Photosystem I P700 chlorophyll a apoprotein A2
GNVSQFNESSTYLMGWLRDYLWLNSSQLINGYNPLELIETLAWAHERTPLANLIRWRDKPVALSIVQARL

SEQ ID NO: 108994 - protein, 54 aa, Glycine max
  Coding DNA Sequence Number=SeqID_17309
  Homolog annotation: Hit_ID=Q6WAY3; Match level="QueryCoverage=75%, HitCoverage=2%, E-value=1e-07, Identity=54%"; Hit description =Gag/pol polyprotein
MGRIARWQAIKGSALADYLAQQPLQDYRSMHPEFPDEDIMALFEEKRTHKDIDK

SEQ ID NO: 108995 - protein, 177 aa, Glycine max
  Coding DNA Sequence Number=SeqID_17310
  Homolog annotation: Hit_ID=Q2HW90; Match level="QueryCoverage=92%, HitCoverage=33%, E-value=7e-20, Identity=36%"; Hit description =Putative uncharacterized protein
MGPLQMQAFRKAYGKILDLTLAEISTEAVVSLTQYYDRPLRCFTFGDFQLVPTIEEFEEILGCPLGGRKPYLFSGFLPSLSKIAVVARGLDRVKQTRNGVVGLPRKYLEGKARDMTNQEEWVPFMDVLALLIFGVVLFPNTDGLVDLAAIDAFLAYHHSKESPIVAILVDLFDTFDR

SEQ ID NO: 108996 - protein, 79 aa, Glycine max
  Coding DNA Sequence Number=SeqID_17311
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=39%, HitCoverage=30%, E-value=1e-10, Identity=93%"; Hit description=LacZ protein
MHILRDTVGHSTHPPFASWRNSEEARTDRPSQQLRSLNGEWDAPCSGALSAAGVVVTRSVTATLASADVRRCFCRYAPP

SEQ ID NO: 108997 - protein, 158 aa, Glycine max
  Coding DNA Sequence Number=SeqID_17312
  Subcellular localization annotation: CTP_CleavageSite=94; ConfidenceScore=5.18e-01
NCISKFRERRATITAPPPSPPAPREPAAVLSPLTPATPLLLRIENAPRKSKQTRKALRRPGQPARVSPRGGWLLRVGATVERSSPPPPQFPLPPAASGRPSPCEGGRGAELNSRARKVAAAASGETGPPRRRASLARPLRGVGPNDTEGCWSMAGGAR

SEQ ID NO: 108998 - protein, 115 aa, Glycine max
  Coding DNA Sequence Number=SeqID_17313
  Subcellular localization annotation: CTP_CleavageSite=89; ConfidenceScore=5.01e-01
MLVRTIRTCLFAVARVKSCPGMHSSYVIASLSGCIRTVGALQHQGMWSPLKVRTRSPLKERTCNTLKLRTCRPLKVRACSPLKVRTYSPLMARACIPLKARTSSPLKVRMCSPLK

SEQ ID NO: 108999 - protein, 69 aa, Glycine max
  Coding DNA Sequence Number=SeqID_17314
MEDFLEGPLLGNHGTQLQLENVGHMNDNAFIHVAPEKMRMKDCLEGPLLGIMEHSSKLESGGHMNSPNQ

SEQ ID NO: 109000 - protein, 123 aa, Glycine max
  Coding DNA Sequence Number=SeqID_17315
MIYHFFIVPYLSASQALWGMGMGSVHNFVMHSIRCGFSYGGVSSLHMWELPGTPVTFGFAWQATPISRPVKAKTTAKGRTDATVNIPPTESMVHAKPLKIFTKVCPAIILANKRTPKLTARKQ

SEQ ID NO: 109001 - protein, 55 aa, Glycine max
  Coding DNA Sequence Number=SeqID_17316
MARKGALRKELMSFKNLWICGKILFKGEEMMQSYPPRVLDRRLRIEDSKKIGPKM

SEQ ID NO: 109002 - protein, 59 aa, Glycine max
  Coding DNA Sequence Number=SeqID_17317
MAPKKISKKRSRRDAAAKGSSVAPKFDSHRFRSTEHQQRFEAIKGWSFHRERRVQLKEN

SEQ ID NO: 109003 - protein, 173 aa, Glycine max
  Coding DNA Sequence Number=SeqID_17318
MSKSCGFGMTGPLDESISCFLIRVDPWVLVPITFRGLHVLAIRGLHILTITLIVERTTCPRHQRAARPHLQRTTCPRLERATRPHLGYKLPSPLRGLHVLAIRGLHAPTSRGLYVLALRGLHALTLVTLTVERTTRPRLERTTRPHHQRAERPHLQRTTCPRLERATRPHLGY

SEQ ID NO: 109004 - protein, 210 aa, Glycine max
  Coding DNA Sequence Number=SeqID_17319
MPVSQFLGDPLVLEEGQQCEFSQRRNRADGIDEEAIAQLLCTPGQDFAWTATGRQVRIMCTNKTTLTQTWMTLLLNNVLPSNHNSDLPLPKCQLVYATHQAPSRPDKSNRALGFLALITGLCQSFGVPVTPNKVIRPPITRAFIEKYCTPRQAQGDAPQGADAPPPPRQADPAEPLGMERYLQHLVRQQAANHRGQVQIHKCLYSFSHSQ

SEQ ID NO: 109005 - protein, 273 aa, Glycine max
  Coding DNA Sequence Number=SeqID_17320
  Gene Ontology: Mol. function=peptidase activity; Cellular component =membrane; Biological process=phagocytosis, engulfment
  Homolog annotation: Hit_ID=A4TP73; Match level="QueryCoverage=93%, HitCoverage=84%, E-value=1e-120, Identity=85%"; Hit description=SPFH domain, Band 7 family protein
  Pfam annotation: Domain name=Band_7; Domain location=21-193; Score =214.0; E_value=3.5e-61; Accession=PF01145.16; Description=SPFH domain  Band 7 family
MLTFIPIVIVVALIVVFAGVKIVPQGFQWTVERFGRYTKTLMPGLNLVVPFMDRIGRKINMMEQVLDIPSQEVISRDNANVAIDAVCFIQVVDPARAAYEVSNLEQAIVNLTMTNFRTVLGSMELDEMLSQRDSINSRLLHIVDEATNPWGVKITRIEIRDVRPPAELIASMNAQMKAERTKRADILEAEGVRQAAILRAEGEKQSQILKAEGERQSAFLQAEARERAAEAEARATQLVSDAIASGNIQAVNYFVAQKYTDALQKIGSSNNSK

SEQ ID NO: 109006 - protein, 70 aa, Glycine max
  Coding DNA Sequence Number=SeqID_17321
MTVPEAEPAVAGDEPMVDADAQDTGAEIDAQDTDAEDVADEAEGFAGGPRDSSVLTEYAEHVAASVWFGE

SEQ ID NO: 109007 - protein, 104 aa, Glycine max
  Coding DNA Sequence Number=SeqID_17322
MEWFFFISHPFIIATQAGDQLRHAPAANHEEYMQPAFPQVPVAFDPPSTCSEDDYDGYEAIAERLERMLNHRMVTAGTKLHDIMQDCLTIARGGASAYGSVRAR

SEQ ID NO: 109008 - protein, 148 aa, Glycine max
  Coding DNA Sequence Number=SeqID_17323
RGSCGSLDTPRPVLLHLSIHGCCLMIHTIGGCTIRTIWLQHVTSVFCQGSVPVTTWTGSSDPETDIRPITKPAVPSTSARSDVDDPRHAVEACDAIAKRLERHLNLGVVTLGTSTHEVIEECLKIVMSVIKDQLVYVRSRRRRRTDQS

SEQ ID NO: 109009 - protein, 145 aa, Glycine max
  Coding DNA Sequence Number=SeqID_17324
MTYEVRRWWCLCRGRTDQLRINLICNRFTDQLDPTVVMGHMDKDQWMYESIMSEEADMDYQNKEACGVNEPHVDCFDVFNTSQLRYKPVVGGEGWMVKLICVVHNHELANLLVGHPYAGQLTKAEKTVIADMTKSMVKPRNILLT

SEQ ID NO: 109010 - protein, 137 aa, Glycine max
  Coding DNA Sequence Number=SeqID_17325
FQENDRSHPAQAVAAQIRTLLYKHEGCTSSVPSPGLKSYFCVELISIVQRAISVKYNLHVLKRDVVTSGAGAVSWSSKKHPMLFSCMKIQYFMEGSIKMSYCSTQNQLANIMTKPLKWEQFLNLRSMLGMIEASEVN

SEQ ID NO: 109011 - protein, 355 aa, Glycine max
  Coding DNA Sequence Number=SeqID_17326
  Gene Ontology: Mol. function=aspartic-type endopeptidase activity; Cellular component=small subunit processome; Biological process=DNA integration
  Homolog annotation: Hit_ID=A5ALQ7; Match level="QueryCoverage=42%, HitCoverage=11%, E-value=4e-21, Identity=44%"; Hit description =Putative uncharacterized protein
MAHSVFANDIQQLYDATQKLVILKQTDHDMVAYVSKAQSVVEELKLSLEADKLEDIKMKLANLYTVLVLREMHPDFDHIRDQLKVLKLLPWYLIERDEVIVEIEEDELEEEVALNVLTAFSISPLVLILLNRMALPKERIGILLRLLGHYYFMPMYMSDIGVLISLLLEPSNVFSLDIPNYKKVTDVTLLFTIVYISADVTFFEEKPYFSPSMVESNTLQEVFPIPYLGPSPSLQESESTVDSTIDIPNNPPLEQTQRSPIVYQPRPRILVVELEGNERPVESCPSPTDNPTMDLPEENLDLLIALRKDTRSTPLDHPGWRQAMIDEMQALEHNGTWELVPFPPGKKHAIPRFMA

SEQ ID NO: 109012 - protein, 384 aa, Glycine max
  Coding DNA Sequence Number=SeqID_17327
  Gene Ontology: Mol. function=transferase activity; Cellular component= CAAX-protein geranylgeranyltransferase complex; Biological process =protein amino acid geranylgeranylation
  Homolog annotation: Hit_ID=Q6EMC1; Match level="QueryCoverage=96%, HitCoverage=94%, E-value=1e-126, Identity=59%"; Hit description =Geranylgeranyltransferase type I beta subunit
  Pfam annotation: Domain name=Prenyltrans; Domain location=201-244; Score=69.1; E_value=1.5e-17; Accession=PF00432.12; Description =Prenyltransferase and squalene oxidase re
  Pfam annotation: Domain name=Prenyltrans; Domain location=260-299; Score=35.9; E_value=1.5e-07; Accession=PF00432.12; Description =Prenyltransferase and squalene oxidase re
  Pfam annotation: Domain name=Prenyltrans; Domain location=320-363; Score=38.9; E_value=1.8e-08; Accession=PF00432.12; Description =Prenyltransferase and squalene oxidase re
  Pfam annotation: Domain name=Prenyltrans; Domain location=62-129; Score=12.7; E_value=0.16; Accession=PF00432.12; Description =Prenyltransferase and squalene oxidase re
  Pfam module annotation: Pfam domain module=Prenyltrans::Prenyltrans::P renyltrans::Prenyltrans; Domain location=201-244::260-299::320 -363::62-129
MMNSTEEEYRGCEIMEKDVHVTFLELMYYLLPSPYESQEINHLTLAYFVISGLDILDSLHKVAKDAVVSWVLSFQAHPGAKTDLNDGQFYGFHGSKTSQFPPDENGVLIHNNSHLASTYCAISILKIVGYELSNLDSETIVTSMRNLQQPDGRYGFETWTRAVAFILVQCFIPIHTGGETDLRFVYCAAAICFMLDNWSGMDKEKTKDYILRCQSYDGGFGLVPGAESHGGATYCAMASLRLMGFIEDNILSSCASSSLIDAPLLLDWILQRQGTDGGFQGRPNKSSDTCYAFCCQSLDKHHMFVRIGAVLRILGGFKFVDNKALRGFLLSCQYKYGGFSKFPGEYPDLYHSYYGFTAFSLLEESGLKSLFSELGITENAALAL

SEQ ID NO: 109013 - protein, 301 aa, Glycine max
  Coding DNA Sequence Number=SeqID_17328
  Homolog annotation: Hit_ID=A7PWX4; Match level="QueryCoverage=89%, HitCoverage=88%, E-value=9e-40, Identity=37%"; Hit description =Chromosome chr12 scaffold_36, whole genome shotgun sequence
MKSLSSVGLGLSIIFGCLLLALVAEVYYLLWWKKRITNREIENDYGNPVKELFYMFCWKRPSSSSLRQTSFTPPEFCSSMRIGDTLVHDPEQVQSQSGKEFVFKPFGEDGTDAEYMRQQDLLLLGPPRFLFTIVEESKEDLESDDGKSKCDKSGKGSRGRSLGDLLVVETPYMTPTTSPPFFTPPFTTPISPYNQRGFNPLFETATDAEFNKLKSSPPPKFKFLQEAEEKLRRKLQEDENKGNGDEVDGSFITIVVDKKTEREVNHQPRPPQYHSSTSQLCAKGTGKPRTTLRKVVKKDVM

SEQ ID NO: 109014 - protein, 235 aa, Glycine max
  Coding DNA Sequence Number=SeqID_17329
  Homolog annotation: Hit_ID=A2Q4S5; Match level="QueryCoverage=76%, HitCoverage=29%, E-value=9e-22, Identity=34%"; Hit description=IMP dehydrogenase/GMP reductase, putative
  Pfam annotation: Domain name=DUF1723; Domain location=158-207; Score =60.6; E_value=5.4e-15; Accession=PF08330.1; Description=Protein of unknown function (DUF1723)
  Subcellular localization annotation: CTP_CleavageSite=34; ConfidenceScore=5.01e-01
MVRTRGLRRMVGTGKGSDLSQNVAEDVPRRRRPTASARRQRVTQMAEDVPQLAEDVPDASDGSPERTGAADGAESDRVASDGTAADDEGFPGGPRDPSVLIGFADHVAHNIWRGQERPDLKLVSHGRKVDKFGRPAAEIEGMIAATGLDPLIRCSVITTDPGLISAFVERWHRETSSFHLPVGEVTITLDDVLSLLHIPITGALHSFGPLATSDAVALLTELLEVTADEATAETR

SEQ ID NO: 109015 - protein, 231 aa, Glycine max
  Coding DNA Sequence Number=SeqID_17330
MKLWCHTLRLDIIDSAHDNAVESVEVALTLATDLMKRGSYGHVIFPIHPIVRSLQIRMRLIDWQSMNSRKHRAVPTPGEASSWDSSRFTSEIAWHRYQDNVQLRNILPERNVELAPGMFDEFLQELQRCCWDQVLTRLPEKRIDVTLVKEFYSNLYDPEDRSPKFCWIRGQVVRFDAETINDFLDTPVILADGEEYPAYSQYLCTPPDHEAILATLCTPGGHFVLNVDGAP

SEQ ID NO: 109016 - protein, 497 aa, Glycine max
  Coding DNA Sequence Number=SeqID_17331
  Gene Ontology: Mol. function=peptidase activity; Cellular component =extracellular region; Biological process=proteolysis
  Homolog annotation: Hit_ID=A7PY74; Match level="QueryCoverage=50%, HitCoverage=46%, E-value=2e-63, Identity=43%"; Hit description =Chromosome chr15 scaffold_37, whole genome shotgun sequence
  Pfam annotation: Domain name=Peptidase_S8; Domain location=1-464; Score=-74.9; E_value=0.0095; Accession=PF00082.13; Description =Subtilase family
MNDGFGAGEGGVMVVVVDGGCAYDRTSCLLEASPARWPVSNNSISHPLEFSQECVPGCDESITKHPLEPTQSRTIHVKGGKRDSVLIRCTLVVEELGSFEDPPDRVCTVESRNLEFEVWSRVGQGCWRGGCRGKVVQTTKDNFDNGLWWSYGYYGQPWKVEPNVTCSEDESLVSRTREPPYAKVIQIDWPSSNSLGSPFVECYLHNIAGIVIVVANTHTASTATSNVVENASLYGRAGGTASGMRYTSRISVYKVCWPKGCANSNILATVDQAVFDGVDVLSLSLGSDPKPFYDDFIAIASFGETKKGIFVTCSTCKEGPSPSTVSNGAPWIMTVVASSTDRSFPAEGRTKMGEVVKVAYGAGMIVLNTKNQAEEIYVDLHILLATSLGASVVMRAFSSKGPSIVGLDVTDPAGASMSCPNVSGIATLLKYLHKDWSPAAIKSALMTTAYTLNNKGAPISYMASDNKAFATPFAFGSDHVNPVSLYVLRKQFFTLVT

SEQ ID NO: 109017 - protein, 754 aa, Glycine max
  Coding DNA Sequence Number=SeqID_17332
  Homolog annotation: Hit_ID=A7PIY6; Match level="QueryCoverage=89%, HitCoverage=58%, E-value=0.0, Identity=63%"; Hit description =Chromosome chr13 scaffold_17, whole genome shotgun sequence
MATWYFKALRIKLFNVGYVLDSRTAAPLILSMLEDMLSSSKTACRVRAFDLILNLAVHAHLLEPIVADDASTIEEEYSQESYYDSDTQVMVQGSRKGSSQNKSDTGSAIDKFESWILNILYEILLLLVQSEEKDESVWASALSCLLYFVCDRGKIKRNRLHGLDIRALVRISRENSWAELVHCKLISMLTNMFYEVAEVAESVSGKPKFLVNQLDLIGGVQFIFIEYSLANSREERKNLYSVLFDYILHQINETCIATGVNDYSDDEIQPLAALLAQTNAPEAFYISVKLGVEGIGEILRRSIASALSRYPNSERLNMLLEVVAEKFDAVISTFTHLDKEFSHMNQITKSLKFLENMEGVVMRNGIGLQAKHSWATLHSLLHSERISYRQNGYIWLGDLLIAQINGERDGNIWSSITYFQKKIAQAGTQDSSNTSDVPLPILLMCGLLKSKYNYIRWGFLFVLERLLMRCKFLLDEHEMQQTSNRDLGHGKKDWHLEKANAIIDIMSGALSLVFQINETDRINILKMCDILFSQLCLRVPPAASLPFGDDVRHGRNFNHVNLSKRFDGDNHAKQDTFHWDGHKEEANRRSGYHNNYHLDHETASMAALFQGRAVVPMQLIARVPAAILYWPLIQLAGAATDDIALGVAVGSKGRGNLPGATSDIRATLLLLLIGKCTVDPVAFRERMMTEKPEKYQHMLQNLVVKAQQGCPSLINSNLTLFLADVGLGFFPIHPSRPALLGLGAWITMVSDPLD

SEQ ID NO: 109018 - protein, 211 aa, Glycine max
  Coding DNA Sequence Number=SeqID_17333
CLTDPDYDEMSPRACRWIATKASSKSLPASRYQKRLDGLTIVDVCWMPYGEHRGDIYDEVPLSSDTDQRGWCDNLDMFKPFLHRLRCASDYMHWFFMISHLFMIQAQPVDLARHPPVTQDDTYVEPHIPEVPVAPAAAPTHAPSDEEQPRHAMEACQEIAERFERLLNLRIVNAGTKIHEVMEDCLRIARGVTVDGNVYVRSRRRQHTDQP

SEQ ID NO: 109019 - protein, 261 aa, Glycine max
  Coding DNA Sequence Number=SeqID_17334
  Homolog annotation: Hit_ID=A2Q1D6; Match level="QueryCoverage=41%, HitCoverage=17%, E-value=5e-12, Identity=40%"; Hit description =Ovarian tumour, otubain, related
MLTTNGGEEARTSNKEEAPTAQPKQMKQRHKDVGCTSNNASFLFLFCHHPNQIKMMNDERVLLATTAILFVHPIIKLTHSFLRFLGFFWFFIVVRGALCRFGRGESITEYNSYELTNSYDLYGLPNPYKSYGLTNSYDLYGFGTPYLFATRDDVLQWAPSVAYEVGFVAVIMKLDTNSGIRGRTLFVLIGCERSDQYRSRKKDFERRNIDSRKCGCPFKLRGKPVIGGQGWMLYNARSEYHFSIRGSDTEMQHLMKLLERD

SEQ ID NO: 109020 - protein, 39 aa, Glycine max
  Coding DNA Sequence Number=SeqID_17335
MVANILVFALFYSIVVTRLINMHICVSIPQQEGSTPLGM

SEQ ID NO: 109021 - protein, 255 aa, Glycine max
  Coding DNA Sequence Number=SeqID_17336
  Homolog annotation: Hit_ID=A7UQU7; Match level="QueryCoverage=60%, HitCoverage=26%, E-value=2e-17, Identity=39%"; Hit description=IMP dehydrogenase/GMP reductase, putative
  Pfam annotation: Domain name=DUF1723; Domain location=180-229; Score =31.1; E_value=4e-06; Accession=PF08330.1; Description=Protein of unknown function (DUF1723)
MVRTRGLGRALGTVSGRGLGRGDHDDSDDSPQRRRPTASARRQRVPVTVTDEADVPATEIDVPGPDLASTEAGLDADEPMVEADIQDTGANTAAEDDVDTGAQAAEDEPEGFLGGPSDPSVLTEYADHVAGSVWTGEERPELKLSSHGRKMHSLGRPVPTIEGLVAGTGLSPLIACSIDTGDRGLLLSFVEQWHRETSSFHLPMGEVMIMLGNVASLLHLPMVGDLHAFQPVHMDDVVQMLVELLMVTSELPGLR

SEQ ID NO: 109022 - protein, 853 aa, Glycine max
  Coding DNA Sequence Number=SeqID_17337
  Gene Ontology: Mol. function=oxidoreductase activity, acting on the aldehyde or oxo group of donors, disulfide as acceptor; Cellular component=mitochondrial matrix; Biological process=metabolic process
  Homolog annotation: Hit_ID=Q9ZRQ2; Match level="QueryCoverage=98%, HitCoverage=81%, E-value=0.0, Identity=82%"; Hit description=2 -oxoglutarate dehydrogenase, E1 subunit
  Pfam annotation: Domain name=E1_dh; Domain location=249-578; Score =238.1; E_value=1.9e-68; Accession=PF00676.11; Description =Dehydrogenase E1 component
  Pfam annotation: Domain name=Transket_pyr; Domain location=642-849; Score=185.8; E_value=1.1e-52; Accession=PF02779.15; Description =Transketolase, pyrimidine binding dom
  Pfam module annotation: Pfam domain module=E1_dh::Transket_pyr; Domain location=249-578::642-849
  Subcellular localization annotation: CTP_CleavageSite=63; ConfidenceScore=5.79e-01
MAWFRAGTSIAKHAIRRTLSKGGSTYLVSRARFLPSIPSSSSSPYSRSFHSTVFKEQAAPVPRAVPLSKLTDSFLDGTSSVYLEELQRAWEADPNSVDESWDNFFRNFVGQATTSPGISGQTIQESMRLLLLVRAYQVNGHMKAKLDPLNLEPRQISEDLDPALYGFTEADLDREFFLGVWRMAGFLSENRPVQTLRSILTRLEQAYCGSIGYEYMHIADRHKCNWLRDKIETPTPTQFNRERREAIFDRLAWSSLFENFLATKWTSAKRFGLEGGETLIPGMKEMFDRASDLGVESIVIGMAHRGRLNVLGNVVRKPLRQIFCEFSGGLQPEGEVGLYTGTGDVKYHLGTSYDRPTRGGKRIHLSLVANPSHLEAVNPLVIGKTRAKQYYANDVDRTKNMGVLIHGDGSFAGQGVVYETLHLSALPNYTTGGTIHIVFNNQVAFTTDPTSGRSSQYCTDVAKALDAPIFHVNGDDVEAVVHACELAAEWRQTFHSDVVVDLVCYRRFGHNEIDEPSFTQPKMYKVIRSHPSTLEIYEKNLLESGELTQEEIDRIHKKVTSILNEEFLASKEYIPKRRDWLSAYWLGFKSPEQLSRIRNTGVKPEILKTVGKAITTIPENFTPHRAVKRIYEQRAQMIETGEDIDWGFAEALAYATLLIEGNHVRLSGQDVERGTFSHRHAVVHDQTTGEKYCPLDHVIMNQDEEMFTVSNSSLSEFGVLGFELGYSMENPNSLIIWEAQFGDFANGAHVIFDNFLASGEAKWLRQTGLVVLLPHGYDGQGPEHSSARLERFLQMADDNPHVIPEMDPTLRKQIQECNLQIVNVTTPANFFHVLRRQYNSPSSEDIETPYTGE

SEQ ID NO: 109023 - protein, 43 aa, Glycine max
  Coding DNA Sequence Number=SeqID_17338
MGARNGMKGFSREGKETLMVSGVAAQQGGEGGVNGVGDWCEEE

SEQ ID NO: 109024 - protein, 85 aa, Glycine max
  Coding DNA Sequence Number=SeqID_17339
  Gene Ontology: Mol. function=beta-N-acetylhexosaminidase activity; Cellular component=plasma membrane; Biological process=carbohydrate metabolic process
  Homolog annotation: Hit_ID=A7Q448; Match level="QueryCoverage=67%, HitCoverage=10%, E-value=3e-22, Identity=79%"; Hit description =Chromosome chr13 scaffold_48, whole genome shotgun sequence
MRGINVMAEVDVPGHAESWGAGYPDLWPSPYCREPLDVSKNFTFDVISGILTVVVFPCLLIVTLPEYAYVKMHYFKQLSDSVTLE

SEQ ID NO: 109025 - protein, 717 aa, Glycine max
  Coding DNA Sequence Number=SeqID_17340
  Gene Ontology: Mol. function=secondary active sulfate transmembrane transporter activity; Cellular component=integral to membrane; Biological process=response to stress
  Homolog annotation: Hit_ID=A7Q445; Match level="QueryCoverage=99%, HitCoverage=99%, E-value=0.0, Identity=69%"; Hit description =Chromosome chr13 scaffold_48, whole genome shotgun sequence
  Pfam annotation: Domain name=BacA; Domain location=222-449; Score= -168.1; E_value=0.044; Accession=PF02673.9; Description=Bacitracin resistance protein BacA
  Pfam annotation: Domain name=STAS; Domain location=525-644; Score =131.4; E_value=2.6e-36; Accession=PF01740.12; Description=STAS domain
  Pfam annotation: Domain name=Sulfate_transp; Domain location=198-502; Score=459.4; E_value=4.6e-135; Accession=PF00916.11; Description =Sulfate transporter family
  Pfam annotation: Domain name=Xan_ur_permease; Domain location=106 -493; Score=-116.6; E_value=0.00094; Accession=PF00860.11; Description=Permease family
  Pfam module annotation: Pfam domain module=BacA::STAS::Sulfate _transp::Xan_ur_permease; Domain location=222-449::525-644::198 -502::106-493
  Subcellular localization annotation: CTP_CleavageSite=38; ConfidenceScore=5.66e-01
MEITYASPSFSDLRAAATSSSMPSSARPVRIIPLQHPTATTSSSSPPNAAFSRWTAKLRRMTWMEWIEFFLPCLRWIRIYKWREYFQVDLMAGITVGVMLVPQSMSYAKLAGLQPIYGLSNFRTAVLKILRTKEDSGFVPLFVYAIFGSSRQLAVGPVALVSLLVSNVLGNIADSSTELYTELAILLSLMVGIMECIMGLLRLGWLIRFISHSVISGFTTASAIVIGLSQAKYFLGYDIDGSSKIIPVVKSIIAGADKFSWPPFVMGSIMLAILLVMKHLGKSRKYLRFLRAAGPLTAVVLGTVFAKIFHPSSISLVGDIPQGLPKFSVPKSFEYAQSLIPTALLITGVAILESVGIAKALAAKNGYELDSNQELFGLGVSNVLGSFFSAYPTTGSFSRSAVNHESGAKSGVSGIVLGIIMTCALLFLTPLFEYIPQCTLAAIVISAVIGLVDYDEAIFLWRVDKKDFLLWTITSTTTLFLGIEIGVLVGVGVSLAFVIHESANPHIAVLGRLPGTTVYRNVKQYPEAYTYNGIVIVRVDAPIYFANTSYIKDRLREYEVDVDCSKRHGPEVERIYFVILEMAPVTYIDSSAVQALKDLYQEYKLRDIQIAISNPSPEVLLTLSRSGLVELIGKEWYFVRVHDAVQVCLQHVQSLKGGSNSPQAPFSSLEDKPSLFARLSKERGEKLSITDLESGNGRPPLPKERDSQLEPLLSKDH

SEQ ID NO: 109026 - protein, 80 aa, Glycine max
  Coding DNA Sequence Number=SeqID_17341
  Pfam annotation: Domain name=A_thal_3526; Domain location=12-50; Score=3.0; E_value=0.038; Accession=PF09713.1; Description=Plant protein 1589 of unknown functio
MFDLRCYFHAPNQTEACTCKYQGHLSMNHRTLWNELEKENKEFFEEYAKAKSKDERMSEEETSQMIQKMISDSSKGAGND

SEQ ID NO: 109027 - protein, 742 aa, Glycine max
  Coding DNA Sequence Number=SeqID_17342
  Homolog annotation: Hit_ID=A7Q441; Match level="QueryCoverage=100%, HitCoverage=100%, E-value=2e-48, Identity=29%"; Hit description =Chromosome chr13 scaffold_48, whole genome shotgun sequence
MESKQEAPSVILNLMGLDQVPTQHPIRDKQKVLSENYLQKVASIGVRKKRSSHQHHSSGMNTSEKEEFEDVLKVVKALRRGKHHNPSKGNGKENPISCKNSNLDDGLLQEIFYPKSMRLYPEMRERKKISYHMNSGKQSSRPFSKISEEISMQSGNVANGVLNTASSSFLRGNEAFASDMLKLKPASNISVNEIQFNFPFLCSDSRTKTLAQGDVAEKLRELGRCGQVCIHNQLPMISEHGNGTRDLTHQSGYYSNDKIRKNIRCKAGVNYSFARRVSIPLCAASVIADNGRTMNQDILFQRYWGLRKNASANWLSWKSKNENVNQKECMEDVNLSPGHEKLPSLSSYFHSNHTEENGINHMSEKRVYGKDLSDKVTMPPQLSSSSPSPELIDSQILQERRLMNDEVKNKTYEDSSMPMQNVVSPDSSVDFLVSDATTEVVGRSHYNPTNHQYKSTVFLSQEIDSLSYTSKKQSVAHCSGTFCSKSHHLPPYQNQCGKILDTSDFQEDSVLSLCSEADPDSISSFEEAYEPSPISVLEPLFGEDSRFSSKCGDHVYDSSEVDDEEYDLNVSSDEDCENEYVDDPEEKKDIAGLFRAEESRDFSYVVEVLTEAECPISPSVFEILEKKFGEQQLWKKSERKLLFDRINLGLLEILQPYLYIPMWEKPMSRRLNAEPSQNMIEEEMWGLLVAQEKKASKGLADSILEGEIRWIELVEDVEDIVREIVNLLIEELANEIVSLEKF

SEQ ID NO: 109028 - protein, 120 aa, Glycine max
  Coding DNA Sequence Number=SeqID_17343
MAQQCMHGHAADTGRDHWLGLQGKDTVLFQVVEAEENGEVGMAESGKCMSAFRILVFLPLEMDKNLNVAPWKILCTNVTEYLNLGKIEPLSEYNFTGTDFNYYERLLQESDRTLVHDVGQ

SEQ ID NO: 109029 - protein, 132 aa, Glycine max
  Coding DNA Sequence Number=SeqID_17344
MALQAEQLLLLVQPYTCYFIHIRLINQSLINNTQNISMEHTGCNSRRPCKGLFVWSLYIVLSLPYPTIHVANFKSPTKKSESNHMKLTSTPTTTMATSWLRVGVRKSRGMERNTYAGDTRATTGSKIRYRRD

SEQ ID NO: 109030 - protein, 578 aa, Glycine max
  Coding DNA Sequence Number=SeqID_17345
  Gene Ontology: Mol. function=anion channel activity; Cellular component=membrane of vacuole with cell cycle-independent morphology; Biological process=malate transport
  Homolog annotation: Hit_ID=A7P360; Match level="QueryCoverage=100%, HitCoverage=97%, E-value=1e-172, Identity=56%"; Hit description =Chromosome chr1 scaffold_5, whole genome shotgun sequence
  Pfam annotation: Domain name=UPF0005; Domain location=61-560; Score =657.9; E_value=8.1e-195; Accession=PF01027.11; Description =Uncharacterised protein family UPF0005
MVSRNVSLRQIFAERSKERLLSRHELPLNGSNNRAGGILRVLADRTATVYKGVCEFFRQLQEMARSDRRKVAFAAKAGLSLALVSLFIYVKEEQLSKYSIWAVLTVVLIFEFSVGATLSKGLNRSFGTLSAGGLALGIAELAILAGDFEELIIVLCIFIAGFCASFVKLLPAMKTYEYGFRVFLLTFCIVLVSGSTTRDFFSTALYRLILIAVGAGICLFVSIFIYPIWAGEDLHKLVVKNFKGVATSLEGCVNGYLQCVAYERVPSKILVYQASDDPLYRGYRAAVQSSSQEESLLDFASWEPPHGPYKTFNYPWRSYVKVSGALRHCAFMVMAMHGCILSEIQTDTKMSEVLLSCFTHNPSSMKFSLLLLAPPEKRMVFSNELQKVGNEGAEVLRQLGSKVEKMEKLSNVDILLKVHEAAEQLQMKIDQQSFRLFNSESWQDAKKPKEIENNDNCLLIDVKDNENKNSLISSLSETGADSRLNINIEPSVPELHTSQSLMSNKMSWPRLSFYGDNMLLEQDSKVYESASSLSLATFASLLIEFVARLQNLVDEFQDLGEKANFKDVFDEPMLKEAI

SEQ ID NO: 109031 - protein, 259 aa, Glycine max
  Coding DNA Sequence Number=SeqID_17346
MEQSRKVLKTGGGDAGGGGGFEGGGGCENPNPTRMNLLRDGGVPEQDDAVVIGDLVVTMVDSAEQQWQQMVRPEVAVDRMKVEKLYQNRINGVNRPSPFPTMGSRVGMGVGLCCRGAGHGSGVSMGSILGMGASGGGKVGGEVGKALSEMDSCFFKLVNGGLTNMAFWHGEVEEKEAGKKEINTQEFYTDSATTRAYIQSPSDLRSLRFLFKPCKKPFTSKDPQGMYPPLFSLNNLVDVPSTRTDPQEMYPLLFSVKPK

SEQ ID NO: 109032 - protein, 38 aa, Glycine max
  Coding DNA Sequence Number=SeqID_17347
MQKEAKAVVVGVALRVGVKLYKKGNVFFHFQSSKLVYF

SEQ ID NO: 109033 - protein, 52 aa, Glycine max
  Coding DNA Sequence Number=SeqID_17348
MTHDLPCACELSKYVVGCIPLDSIHMFWRRLSFSDQGIYEPKVHSLQPRHHN

SEQ ID NO: 109034 - protein, 296 aa, Glycine max
  Coding DNA Sequence Number=SeqID_17349
MGSTGCLVLFFVVVVVPYVFFGRVVPILSSTRHPEEQTVRLKIHHGGMFIYKPFNVHINGQIVEEEWGWNVDIMSYIDFMKLINSLGYKSFKCLWYRDPQKALSRGLKPLNCDFNILQLAEDVFGFDVVEVLMNKDYVEAEEDDDDTSGCSEVLDSDFEESWDWTKSLDPQTFSRSSRPTFETNEVGLTNSDFDDEDGYSDELDTPDESDDEGPPKVRFPHFKVPENDEDVKFKVELQFINKKQILEAIKTFAIMSKKNMKLWVNKSIQASYWQVVTFKDDRCYFRTAKNSKATLD

SEQ ID NO: 109035 - protein, 59 aa, Glycine max
  Coding DNA Sequence Number=SeqID_17350
MASGTACPAGVPLESPQQLVSEPMVQVGDRLRRVCKYRKWPEWLAAQRAPQVKRGSQNG

SEQ ID NO: 109036 - protein, 313 aa, Glycine max
  Coding DNA Sequence Number=SeqID_17351
  Subcellular localization annotation: CTP_CleavageSite=75; ConfidenceScore=5.18e-01
KPNITSDRELLGAPSNIAASSSLPEPASSLLREAYSPRGALRLSFSSPRTGEKTRVRQKKWRKRMTTKSSGRPVRGSSGSSGRTFSRKFPEEVVHPEEFQKTRSSGRTFKFPEDLFGRTTSSGMFPEEPLLPEVIMARTRGLGRAIGRVVGRDRAADEDAGDVSERRRPTASARRLRVHQMTTEGRDIVEDVADMTDDVPEQPTEAPEMRADVQGADSGEGSDGDDAAEGFPGGPRDPSVLTSFAEHVTHAVWSGQERPDLKLVSHGRKVTLIGRPVPEIEGLVAVTGLSPLIDCSAIPGDPGLISAFVERWH

SEQ ID NO: 109037 - protein, 112 aa, Glycine max
  Coding DNA Sequence Number=SeqID_17352
MKERLGHDQSGRGGGWEVDAEEGAGRGRQGPCKCTAIMIDEIRKPLTRGLIPLVELVIDITSGAGEFGVASSHHFHWRLGLQAMLAGGTGEQEGLANTSCEMSLYPPMVLAI

SEQ ID NO: 109038 - protein, 50 aa, Glycine max
  Coding DNA Sequence Number=SeqID_17353
  Homolog annotation: Hit_ID=A5BXI2; Match level="QueryCoverage=100%, HitCoverage=5%, E-value=1e-08, Identity=44%"; Hit description =Putative uncharacterized protein
MGTSQDGNGGVLPLAFAVVEDKNGICLIPDRHASIKSAVANEALGWQPPH

SEQ ID NO: 109039 - protein, 253 aa, Glycine max
  Coding DNA Sequence Number=SeqID_17354
  Gene Ontology: Mol. function=transposase activity; Biological process= transposition, DNA-mediated
  Homolog annotation: Hit_ID=A7Q0I0; Match level="QueryCoverage=89%, HitCoverage=90%, E-value=2e-14, Identity=26%"; Hit description =Chromosome chr7 scaffold_42, whole genome shotgun sequence
MTDKRKVLGKNNEETRSYFTWNLEMERVLTDVLRDQRNLDNKGDGGWKRSTLNVAAAVLSTSFNVNVTSDNVKNRIKLWRSWYGIVSDILGQSGFDWDDTKHMITVENENAWNEYCISHKSAKPFRYKVLQNWDDIVDLCAKDRATGHGAETAMDADEVMSRETNEVEFMGKKRQGSTSSGTHPHKRKMGEKEGITTSLDKMTNSFNRMVEKMDGKVDDEDIQEVLREAALILDLNRQQWAKAIKWWLTIQNS

SEQ ID NO: 109040 - protein, 94 aa, Glycine max
  Coding DNA Sequence Number=SeqID_17355
  Homolog annotation: Hit_ID=A7NZ19; Match level="QueryCoverage=98%, HitCoverage=27%, E-value=7e-27, Identity=65%"; Hit description =Chromosome chr6 scaffold_3, whole genome shotgun sequence
  Pfam annotation: Domain name=ENTH; Domain location=1-94; Score=30.7; E_value=4.8e-08; Accession=PF01417.11; Description=ENTH domain
MTEEVTNENPRPPDTRTRSIIARAAFEVDEYERIEILHHRLSKFDKGYWRASYNALTLLEHLLTHGPKRVPEEFQCDIHVIEEIGQFQYIDEKR

SEQ ID NO: 109041 - protein, 287 aa, Glycine max
  Coding DNA Sequence Number=SeqID_17356
  Gene Ontology: Mol. function=nucleic acid binding; Cellular component= integral to membrane; Biological process=peroxisome organization and biogenesis
  Homolog annotation: Hit_ID=A7P347; Match level="QueryCoverage=42%, HitCoverage=36%, E-value=1e-55, Identity=66%"; Hit description =Chromosome chr1 scaffold_5, whole genome shotgun sequence
  Pfam annotation: Domain name=Aa_trans; Domain location=10-282; Score=- 101.3; E_value=0.016; Accession=PF01490.9; Description=Transmembrane amino acid transporter protein
MVSASSSPPRNAKWWYSTFHTVTAMIGAGVLSLPYAMAYLGWVPGTLFLLISWCLTLNSMWQMIQLHECVPGTRFDRYIDLGKHAFGPKLGPWIVLPQQLIVQVGCDIVYMLPNFNSVTGVSVAAAVMSLRPFQVSMISVAPNGIVHFQMAKTNALNEEMRMKTQGTSSQSEESKDKKDHDDDRVTTATSDDLVIQHDIDSLNLVSDESMKKFFTSYTPGDFGVLKMDNDGVSKVIGVGDVLDDAGYDNHFGSGKWKLTKGNLVVAKGDKISKLYWTKALVARDSAN

SEQ ID NO: 109042 - protein, 56 aa, Glycine max
  Coding DNA Sequence Number=SeqID_17357
  Homolog annotation: Hit_ID=A7P346; Match level="QueryCoverage=60%, HitCoverage=4%, E-value=6e-08, Identity=73%"; Hit description =Chromosome chr1 scaffold_5, whole genome shotgun sequence
MAEKQLIVAVESTAAMGPYWNTILMDYLDKMIRFEVVYYVGVVLVVVKLDESFNVL

SEQ ID NO: 109043 - protein, 416 aa, Glycine max
  Coding DNA Sequence Number=SeqID_17358
  Homolog annotation: Hit_ID=A7P346; Match level="QueryCoverage=99%, HitCoverage=45%, E-value=3e-84, Identity=47%"; Hit description =Chromosome chr1 scaffold_5, whole genome shotgun sequence
MGKRNNRAADPPLEAKTPHFLILISEGFREARGALSRSGITSLPSNQSPVKVDAVSVTPVTGAPPTSMPVNGSIPNRQPVPAGNVAPATVKVEPVPVTSMVSGPAFPHNSSVPRATSTSQGVPSLQTSSPSSVSQDIITNNETAQDTKPTVSMLPLRPVNPVQANVNILNNLSQARQVMNSAALSGGTSMGLPSMGQTPVAMHMSNMISSGMTSSVPAAQNVFSSGQSGITSMTSSGPLTVPAQVGQNSGLGSLTSNTSNLSSSSNIGISQPLGNLQGVVSIGQQVSGMSQGNLSGAQMVQGGVSMNQNVMSGLGQSVVSSGTGTMIPTPGMSQPVQSVMQPLVNNAAANMPLSQQTSGGMQSAQSKYVKVWECTALSVMVFDRSPSQGSLSGQRQGQPVFITKLEGYRNSSASET

SEQ ID NO: 109044 - protein, 116 aa, Glycine max
  Coding DNA Sequence Number=SeqID_17359
MVIQKSVCFQAFNNMTQVAYNASTNIFSQDMQLFKDMNMIIRYANGDYNLQAQDSSQSLNFQLNMGARDNSFMHKLVKPMEWPRERPSTLTEAPGLWKPHLPPNEKAGLLARPLEK

SEQ ID NO: 109045 - protein, 92 aa, Glycine max
  Coding DNA Sequence Number=SeqID_17360
  Subcellular localization annotation: CTP_CleavageSite=54; ConfidenceScore=5.64e-01
MAESSKKCKGSFSSTTTVGQRRHGASGDTLAPPNPSLSSPRSLTIFSSDDQCQRLAAGVSLSEACALSENHALSEALSPLSELGEYEKHLRA

SEQ ID NO: 109046 - protein, 54 aa, Glycine max
  Coding DNA Sequence Number=SeqID_17361
MRPMRYRITTVINFYIVHRSEFGYDLSALRGPLCCFVYLHLLLLSLVNLSSFVK

SEQ ID NO: 109047 - protein, 166 aa, Glycine max
  Coding DNA Sequence Number=SeqID_17362
  Gene Ontology: Mol. function=enzyme inhibitor activity; Cellular component=cell wall; Biological process=cell wall modification
  Homolog annotation: Hit_ID=A7Q0F8; Match level="QueryCoverage=54%, HitCoverage=19%, E-value=8e-17, Identity=49%"; Hit description =Chromosome chr7 scaffold_42, whole genome shotgun sequence
  Pfam annotation: Domain name=PMEI; Domain location=4-134; Score=18.8; E_value=0.00042; Accession=PF04043.6; Description=Plant invertasepectin methylesterase inhibitor
MEERKSDDVVHGDSSSSLRSSEPGSVKSKAWLFLRECDEATVSFYDDDDGEPKRVKAKVCFEDRVDLNRDMAQAIRLVRATIEDLSTIDTLLSGAMTNLYTCLDGFAYSKGRVRDKIEKKLLQRSHHVSNSLAMLNKVPRVKKLTTSSESDEVFPEYGKMQKGFPL

SEQ ID NO: 109048 - protein, 112 aa, Glycine max
  Coding DNA Sequence Number=SeqID_17363
MKQALEMMADLEVRSQAETSVNQVALALDQVFGGFCRSKLHDDESKGTSTWVVVTENKKGYISCGSVQVEGTSTWLFKENKGGYIPCRSLLVKVFTRLKRNLKDRRSLGDWM

SEQ ID NO: 109049 - protein, 334 aa, Glycine max
  Coding DNA Sequence Number=SeqID_17364
  Gene Ontology: Mol. function=nucleic acid binding; Cellular component= intracellular; Biological process=regulation of transcription
  Homolog annotation: Hit_ID=A7P341; Match level="QueryCoverage=62%, HitCoverage=70%, E-value=4e-95, Identity=76%"; Hit description =Chromosome chr1 scaffold_5, whole genome shotgun sequence
  Pfam annotation: Domain name=zf-C2H2; Domain location=150-172; Score =20.6; E_value=0.006; Accession=PF00096.17; Description=Zinc finger, C2H2 type
  Pfam annotation: Domain name=zf-C2H2; Domain location=235-257; Score =19.4; E_value=0.013; Accession=PF00096.17; Description=Zinc finger, C2H2 type
  Pfam module annotation: Pfam domain module=zf-C2H2::zf-C2H2; Domain location=150-172::235-257
MQAHHPFSYISSCPGNSTSSAFLEPHHHHHEAVVDEASISLSLGPPGQQHQQPNNPNKAVTSSIPHHHYQQNPTTTTSSDDHHRQRGGVTVALHIGLPSTTPTTSPNSVTTTTTTTSKSPDLHLASAAPNIQGQYWIPSPAQILIGPTQFSCTVCNKMFNRFNNMQMHMWGHGSQYRKGPESLRGAKPASSMLRLPCYCCAEGCKNNIEHPRSRPLKDFRTLQTHYKRKHGAKPFGCRKCGKPFAVRGDWRTHEKNCGKLWFCICGSDFKHKRSLKDHVRAFGDGHAPHTVESCGRVGEDGLLLLGDDDDDELEVEEDDEEEDYNSNDLAFGFN

SEQ ID NO: 109050 - protein, 99 aa, Glycine max
  Coding DNA Sequence Number=SeqID_17365
  Gene Ontology: Mol. function=glutathione gamma-glutamylcysteinyltransf erase activity
  Homolog annotation: Hit_ID=Q2TE74; Match level="QueryCoverage=59%, HitCoverage=12%, E-value=2e-16, Identity=71%"; Hit description =Glutathione gamma-glutamylcysteinyltransferase 2
MKALIYLCFEGKKIALVAWRQVSASRDLGGLGIKDIKADIVEQIRTTRLFKHVTRWLDSESSCCNTLANLGDKDMLPALAASVCCQAADLLTVCGSQSI

SEQ ID NO: 109051 - protein, 167 aa, Glycine max
  Coding DNA Sequence Number=SeqID_17366
AHLGGEAPSSMAYSLVDDASSHLFSFVFRCISMVPESLQVHDVNMCCTFVSEKSATDQVEEIRAGCYNPPPSPTPALLRQQHDRVGSNQRFEAIQCASDGNVEGAGLPMPPLDEGEYKSRISGDYRTPDQWTQSDGRNHAFYLRRWSPKFIYFSTMGDQLQLGSFLN

SEQ ID NO: 109052 - protein, 157 aa, Glycine max
  Coding DNA Sequence Number=SeqID_17367
MDVEWYKSYVEYFKANYLWEVKNGRHTNFSNHWWIKEGISLRQTLRAWQEQYLTNTIIRNVRELVRKHAPNIHEEREDNFVWHNTDDGQYKVKRGQVFHNILRSPSFKHIPRKVNLVVDAFVKDGLGQEQGMIFYIDVLIFVVNLLKKDLAPSSVCC

SEQ ID NO: 109053 - protein, 326 aa, Glycine max
  Coding DNA Sequence Number=SeqID_17368
MALRKLPSKRSKKDATGEGSSAAQPTDTDFDRHRFWSAEHQQRFETIKGYFTPMPSLPKNDFGICAPGRSQVSGFDEEAIAQLLCIQGLDFARTTTRRRVRIMRTSMNTLTQIWMTLLLLSNILPSDHNSNLPLPKCQLVYAILIQVSIHVAHLIADAIYQFAGMVPTRHPMDPERSNRALGFPALITGLFQFYEVPVTPSKIIRPPITRAFIEKYYITRQACAIAATRGGTVSEAANHRGRRWLNEMFYHYNLHQQSQDPSPFPWPTPEQFEATVAWPGDEAEFEMQAGPTGTSGGGDEAQDDQDLADMLDFLLREGQGLPYCQT

SEQ ID NO: 109054 - protein, 130 aa, Glycine max
  Coding DNA Sequence Number=SeqID_17369
MNHKFGNLVVSVLLRGGSPTCLPCPDRLGLRPHLQRPPWPRTAQEWAKGKNRGPDFAGARCDQRWTSETVPPLVVVMAHLLILLRLLWCLALRLPRDAVLLDEGSGNGRSNDLAGGDGHSVELAEAHDQI

SEQ ID NO: 109055 - protein, 160 aa, Glycine max
  Coding DNA Sequence Number=SeqID_17370
MWAFHKGLQIDWAHLVRYRMHKALRLNAPLPYPHLVTLFLQHFNIPLDSEPYVPIKRSFLIGASVIASFGYQKEHDGSWVKKGARHVGEEGHDGEDSSLLSKILDRFDGLQTFVGERFDTLELQVDMRFNEMESRITKVEEDVSYIRSSFDLPPPPPPSS

SEQ ID NO: 109056 - protein, 89 aa, Glycine max
  Coding DNA Sequence Number=SeqID_17371
MGSKSILRLMRTLGPSLGSLAQSTWSLVPNALAERCLRPVVDQQVTKSNAKDKQKYYVRDRQVITHPTQDVKEVLLGGNLVPFKSLLVI

SEQ ID NO: 109057 - protein, 127 aa, Glycine max
  Coding DNA Sequence Number=SeqID_17372
MTPVNRKAGTGERTREPPGGNAWGAEPMEKRLCRGPLTSLLSIFRLFQEISAPLGKPFRRFITVEFRARVESVLSGNAVIFPIRMADRFPDCSGAVARHVVVTRHSTAYTCPDVRRCFCRYAPPRNS

SEQ ID NO: 109058 - protein, 357 aa, Glycine max
  Coding DNA Sequence Number=SeqID_17373
  Gene Ontology: Mol. function=RNA binding; Cellular component =intracellular; Biological process=hemolysis by symbiont of host red blood cells
  Homolog annotation: Hit_ID=A5CSH8; Match level="QueryCoverage=64%, HitCoverage=82%, E-value=1e-56, Identity=53%"; Hit description =Putative rRNA methyltransferase
  Pfam annotation: Domain name=FtsJ; Domain location=129-322; Score= -8.6; E_value=3.2e-07; Accession=PF01728.10; Description=FtsJ-like methyltransferase
  Pfam annotation: Domain name=S4; Domain location=74-121; Score=50.6; E_value=5.3e-12; Accession=PF01479.16; Description=S4 domain
  Pfam module annotation: Pfam domain module=FtsJ::S4; Domain location =129-322::74-121
  Subcellular localization annotation: CTP_CleavageSite=64; ConfidenceScore=5.36e-01
SRRLDCPGGHDLFRSIASVRTRVASPPVAGAAYSGISTALRTSRRLRGPARRALPSSGERREARAAGDLGHPMTRLDAALAARGLARSRSHAATLISDGLVSVDGRPVVKASTAVDDAAEITVAGADHYVGRAAHKLIAGLDGFGISAQRRLALDMGASTGGFTQVLRERGARTVLAVDVGHGQLAPSIRSDPGVIVVEGYNVRHMTRENLTEATGEADAPELIVGDLSFISLELVLPAVAEVAAQAADVVLLVKPQFEVGRTAVRGGLVTDPTTRADAVARTVWSAWDVGLGMLGILPSPILGTHGNAEMVGHHQPTGRRTMNERSILVVAHAGRVDTVEAARRVINALRDARGTT

SEQ ID NO: 109059 - protein, 111 aa, Glycine max
  Coding DNA Sequence Number=SeqID_17374
  Subcellular localization annotation: CTP_CleavageSite=87; ConfidenceScore=5.12e-01
MVKVGTLTCRSTSHFRQKVGPGLPGINRDTRIYFFLRSDPSVTAVPPVQLLTGWCVTGKSTRRTSALAKLRNCWERAIGAGLFAITPAGERGMCCKAIKLGNARVFPVTTL

SEQ ID NO: 109060 - protein, 128 aa, Glycine max
  Coding DNA Sequence Number=SeqID_17375
  Homolog annotation: Hit_ID=A0PAV3; Match level="QueryCoverage=21%, HitCoverage=14%, E-value=6e-07, Identity=89%"; Hit description =Restriction endonuclease
WNSYVPINVSFSPKVGPGLPGINRDTRIYLFCEVIFRHRYFSAQSASAVPPVQLLTGWCVTAKAPPDISAGKCSGHAARRVPFAIQAAQLLGRAIGAGLFAITPAGERGMCCKAIKLGNARVFPVTTL

SEQ ID NO: 109061 - protein, 195 aa, Glycine max
  Coding DNA Sequence Number=SeqID_17376
MGSYISVFSLCRAIRLAKRIDRSILKSIVTPSTGLPRQSQLKNDIVAFSKDLILRYCPSFLSTPLCQGYVGSQLGKRDLRGGRKGFPQWSPFIRYPYDQKNEERSPWSTETAESTIHSLSGLDTSVSLLTQAPLVDYRNLPRLALSATDRWPLSLKTHLIRTLFGKSVGDCLDAIFSRSMKYPFFAQFEVSYSLE

SEQ ID NO: 109062 - protein, 174 aa, Glycine max
  Coding DNA Sequence Number=SeqID_17377
  Homolog annotation: Hit_ID=A2Q1D6; Match level="QueryCoverage=37%, HitCoverage=10%, E-value=5e-11, Identity=50%"; Hit description =Ovarian tumour, otubain, related
MDYDYDNEEECGVNEPHVDCSNAFNTSQVFGTRDDVLQWAQTVAHENGFVAVIMRNKDFVRKDTGSRKCGCPFRLRGKPVHGGKGWMDEKKIIADMTKFDGETKKHLANDEVVVRDLFWCLPDAVELCDACHLVFVIDSTYKTYRYRLPLLDFVGVTPTAMTFSAGFAYLEAER

SEQ ID NO: 109063 - protein, 213 aa, Glycine max
  Coding DNA Sequence Number=SeqID_17378
ARGMKADMEALKEQMATMMEAMMSMKKIMEVNATAVAAISPVFGVDPTPPSDLNLINHPTADTGDPHFVQAQNKQVFPPYGFPPNYTPPNENVNNFTSIPIESQQPQSDHAHVSQPMGETHEMRHHNLADFQPCLGYATEGQAVGAGKNPHAMANMGKLDHQEERLRAIEGGEDYAFANLEELFLVPNIITLPKFKVPDFDKYKGTTCPKNLQ

SEQ ID NO: 109064 - protein, 99 aa, Glycine max
  Coding DNA Sequence Number=SeqID_17379
MVHDIFVKVKLEVTGTSTALNVFGRRRSSDMVTSILQLDSMNLFVKARAWFNPITQGMAILIANTSSTFHRDERLGNTHAMHGKCNYEFEMPEEKSFLS

SEQ ID NO: 109065 - protein, 270 aa, Glycine max
  Coding DNA Sequence Number=SeqID_17380
  Gene Ontology: Biological process=transposition, DNA-mediated
  Homolog annotation: Hit_ID=Q6UUU1; Match level="QueryCoverage=31%, HitCoverage=55%, E-value=3e-18, Identity=61%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLVDRLKPLLPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVLPFGYRCHSAVMA

SEQ ID NO: 109066 - protein, 17 aa, Glycine max
  Coding DNA Sequence Number=SeqID_17381
FFHLFLEDGTINPQMVQ

SEQ ID NO: 109067 - protein, 101 aa, Glycine max
  Coding DNA Sequence Number=SeqID_17382
  Gene Ontology: Mol. function=transcription factor activity; Cellular component=intracellular; Biological process=regulation of transcription, DNA-dependent
  Homolog annotation: Hit_ID=A4TM18; Match level="QueryCoverage=100%, HitCoverage=30%, E-value=3e-33, Identity=65%"; Hit description =Transcriptional regulator, LacI family
MTLARLLYPQMDAILCTNDDLAVGVLQECQRAGIAVPQVLAIAGFHGLEIGQATKPRRASVITPRLKMGKVATEIVLKKINQQPTIEQVDVHYQLSMGATI

SEQ ID NO: 109068 - protein, 170 aa, Glycine max
  Coding DNA Sequence Number=SeqID_17383
  Homolog annotation: Hit_ID=Q1J7G7; Match level="QueryCoverage=18%, HitCoverage=58%, E-value=8e-07, Identity=68%"; Hit description =Transposase
LPGINRDTRIYLFCEVISVTGIYSAQSASAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSILNEFLETLVILDPRERGGPLEAVEEGPHHTRTDMECPLLL

SEQ ID NO: 109069 - protein, 191 aa, Glycine max
  Coding DNA Sequence Number=SeqID_17384
MFDEFLQELRRHRWDQVLTHLPEKRIDVALVKELYSNLYDPEDQSPRFCRVRGQVVRFDADTINDFLDTPVILEDGEEFPAYTRYLSTHPNPDTIAATLCTPGGRFVLNADGLPWKLLRKDMTTLAQTWSVLSYYDLAPTSHTSDVNLDRARLIYGLLYITADQPDCPVQHLEARVPSVDYSAVRHSGGGF

SEQ ID NO: 109070 - protein, 57 aa, Glycine max
  Coding DNA Sequence Number=SeqID_17385
MGHYGKRVGIQKMENEFDALQTLAQAMGNQNRGEAARAAEYHDLDCFQRNNPPACNG

SEQ ID NO: 109071 - protein, 80 aa, Glycine max
  Coding DNA Sequence Number=SeqID_17386
GKIKLKTPEEATELIENMSPSDHAILMLYWHKISFSLMQAPLELVGLGPSSSMDSFDSWKMNGSGMEKGRERGDATSRRR

SEQ ID NO: 109072 - protein, 104 aa, Glycine max
  Coding DNA Sequence Number=SeqID_17387
MNIEESIHVTFDESNAILSRKNMLDDIADSLEQMHIHGQDSKGNDKGNNEDPPEEAPLELVGLGSSSSMDSFAPWKMNGSEMEKEEREETPLQGEDESRRSSPP

SEQ ID NO: 109073 - protein, 129 aa, Glycine max
  Coding DNA Sequence Number=SeqID_17388
MQRQVQGDAPQAADAPPPHQAGPAGSFNTEQYLRHLVRQQAANHRAHVQTHDCLYQMSLSLQSQGFTSFSCPTPDQFRAEVAWPGDWPEAQAGEAPAGAPAEAPDKADEAREDEEMTGLLDFLGGSGAT

SEQ ID NO: 109074 - protein, 211 aa, Glycine max
  Coding DNA Sequence Number=SeqID_17389
  Gene Ontology: Mol. function=ATPase activity, coupled to transmembrane movement of ions, phosphorylative mechanism; Cellular component=membrane; Biological process=metabolic process
  Homolog annotation: Hit_ID=A8GBC0; Match level="QueryCoverage=100%, HitCoverage=77%, E-value=4e-87, Identity=73%"; Hit description=Cof -like hydrolase
  Pfam annotation: Domain name=Hydrolase_3; Domain location=6-211; Score=83.8; E_value=5.5e-22; Accession=PF08282.3; Description =haloacid dehalogenase-like hydrolase
MSYRVIALDLDGTLLTPNKTILPESLEALARAQQAGVQVLIVTGRHHCAIHPFYQALQLTTPAICCNGTYLYDYQAQRVLAADPLEKSQAARVIEMLDQENIHGLLYVDDAMLYQEATGHVTRTLNWAQSLPKAQRPLFVQVPSLAQAAHDAQSIWKFALSHPDTRALQQFAERTERELGLACEWSWHDQVDIAQAGNSKGKRLAQWVASQ

SEQ ID NO: 109075 - protein, 165 aa, Glycine max
  Coding DNA Sequence Number=SeqID_17390
  Gene Ontology: Biological process=transposition, DNA-mediated
  Homolog annotation: Hit_ID=Q1J7G7; Match level="QueryCoverage=23%, HitCoverage=67%, E-value=9e-11, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLSCVPISGNLEIKLIDTVDLEGGPVGKPVVPAALMNRPTRGERRFAYWALAECILAYYVGTDEGVSEVLHVAEKKGCT

SEQ ID NO: 109076 - protein, 125 aa, Glycine max
  Coding DNA Sequence Number=SeqID_17391
HLYVPTYSQVTTTKDGVVDKSEAFAPNYPQFVMRNSDLHADISGKGADDHIGLCVSIGLGDSKTCVWITIECLRVPPDSQVTIAKCGVVDKSEAFAPTYPQFVMRNSDLRSSCFCETKIVSVFLH

SEQ ID NO: 109077 - protein, 148 aa, Glycine max
  Coding DNA Sequence Number=SeqID_17392
MESPYQLGWDHELKGDKAAKSGEIEAESGDEHNYTENHKPCNMSKESGNSIPIPHKGQGIAEKLTLEFTFHLWCLMGLHGTSSSQCGVRKLDLQCTEKTQQQTIEISAFGRFYLQLILWHTYLLMSGIGTLLATLEAVETTLEAAEPL

SEQ ID NO: 109078 - protein, 71 aa, Glycine max
  Coding DNA Sequence Number=SeqID_17393
  Subcellular localization annotation: CTP_CleavageSite=30; ConfidenceScore=5.19e-01
MYPLLFSVTTTQVDVPSTCTTKDVPSNLLRQSSQAVSPLKLCEGETKDISGEQGLETRKLRKLLAKEEEEE

SEQ ID NO: 109079 - protein, 137 aa, Glycine max
  Coding DNA Sequence Number=SeqID_17394
  Pfam annotation: Domain name=zf-CCHC; Domain location=65-82; Score =28.5; E_value=2.5e-05; Accession=PF00098.14; Description=Zinc knuckle
MELQRLNQNEEIDKKKRRNEEEESEDEEDFLLFVKKFQKFVKKRRIEKRQNFNNGRRSQEDSQILRCYKCNQLGHIKAYCPSNEEWPEKSDKKRYEERRTKKAYIAWDDNDSSDGSEKKINLLTKDYESDENISQED

SEQ ID NO: 109080 - protein, 121 aa, Glycine max
  Coding DNA Sequence Number=SeqID_17395
  Homolog annotation: Hit_ID=Q2HW90; Match level="QueryCoverage=75%, HitCoverage=18%, E-value=1e-10, Identity=36%"; Hit description =Putative uncharacterized protein
MGTNQTSKRFYQVKVKGLDATSIKELGRLMEPLQMQAFRKTYGKILDLTIAEVSIEAIASLTQYYDQPLRCFTFGDFQLVPTIEEFEEILGCPLGGRKPYLFSGFLPSLSIIATVVKDSAR

SEQ ID NO: 109081 - protein, 108 aa, Glycine max
  Coding DNA Sequence Number=SeqID_17396
MAPRKLSTKRSRKDAAAEGTSAAPEFDSHRFRSAEHQQRFEAIKGWSFHRERHVQLRDDEYIDFQEEIARRRWMSLVTPMAKFDPDIVLEFYANAWPKEEGVRDLRSW

SEQ ID NO: 109082 - protein, 317 aa, Glycine max
  Coding DNA Sequence Number=SeqID_17397
MRDMRSWGRGQWIPFDADALSQFLGYPLVLEEGQECEYGQRRNRADGFDEEAIAQLLCILGQDFAQTAAGRRVRIMRTSMTTLTQIWMTLLLSNIQPSDHNSDLPLRKCQLVYAILTQMSVHVAQLIADAIYLFAGMAPTRHPLDPDKSNRALGFPALITGLCQSFGVPVAPSMVIRPPITRAFIEKYCTQRQAQGDAPQAAGAPPPPHQADPAGSFDTEQYLRHSMRQHAANHRGLGQVHECLYQLSLSMQSQGVATYPSAGGRRETRGMRVPRKEYARSRHQRLFEENVGKTGKDAIYELLSERFGSCIYARGRY

SEQ ID NO: 109083 - protein, 69 aa, Glycine max
  Coding DNA Sequence Number=SeqID_17398
MASSSSSSSHVNIKSGPIDADNMFGMGKKIGNYISDELSPRIKGKNKFLSKFFLFFYNLVSPGLSRWGT

SEQ ID NO: 109084 - protein, 181 aa, Glycine max
  Coding DNA Sequence Number=SeqID_17399
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=33%, E-value=8e-94, Identity=70%"; Hit description =Photosystem I P700 chlorophyll a apoprotein A1
TIAKGPDTTTWIWNLHADAHDFDSHTNDLEEISRKVFSAHFGQLSIIFLWLSGMYFHGARFSNYEAWLSDPTHIRPSAQIWRASGITSELQLYCTAIGALVFAALMLFAGWFHYHKAAPKLAWFQDIPKEIPLPHEFILNRDLLAQLYPSFAEGATPFFTLNWSKYAEFLTFRGGLDPVTG

SEQ ID NO: 109085 - protein, 246 aa, Glycine max
  Coding DNA Sequence Number=SeqID_17400
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPEFDDSGMASIKFGVVAGEQCPKCGVLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 109086 - protein, 162 aa, Glycine max
  Coding DNA Sequence Number=SeqID_17401
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=8e-25, Identity=56%"; Hit description =Putative uncharacterized protein
  Subcellular localization annotation: CTP_CleavageSite=25; ConfidenceScore=5.16e-01
MTMITPSSKLTLTKGNKSWYRAPPRATTPNLIEAIPESSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 109087 - protein, 297 aa, Glycine max
  Coding DNA Sequence Number=SeqID_17402
  Gene Ontology: Mol. function=acid phosphatase activity; Cellular component=cytoplasm; Biological process=keratinization
  Homolog annotation: Hit_ID=UPI00006A17C9; Match level="QueryCoverage =84%, HitCoverage=97%, E-value=3e-20, Identity=35%"; Hit description =UPI00006A17C9 related cluster
MSSPSEGCMSSPLEGSTPSPSEGYTSSPSEGYTSSILEGYTSSPSEGYTASSSEGYALSPSEDYTSSPLEGYTPSPSRGYMPSPYEDYTSSLSEGYAPSPSEDYKSSPSEDYTSSPLEDYTSSPLEGNTPSPSKGYTPSPLEDYTSSPSRGLHVLTFRGLHVLAFRGLHVFTFRGLHVLGFRGLNVLIFRGPHALAFRGLHVLTFRGLHVLPSEGYTPSPFEHYTSSPSEGWTPSPKEGCTPSPSEGYTPSPLEGLHVLAFRGLHVLPFRGLHVLAFRGLHVLGFRGLHVFTFRGLH

SEQ ID NO: 109088 - protein, 157 aa, Glycine max
  Coding DNA Sequence Number=SeqID_17403
MTQELVARGDTLQLSAPRHSVTPSVIDEQRPMWSSAPFPEMSASSDTVVSDDAQRRKLVILHPLSSRGGGPDDTRRQNLVIPHPFAIQTQSCPMARRDKNWSFCTLCHPEAAGPMTRGDKIWSFRTPLPFRHSRVRWRAETKIGHSAPFVIQRRRAR

SEQ ID NO: 109089 - protein, 153 aa, Glycine max
  Coding DNA Sequence Number=SeqID_17404
MSKKPGERKGTWHYGIIAYNSLNPDSTLIYSATPAGKTGLDFEQTHYSDSAIKINSEGPKTGISFTHYDGGQIYSKGRELFIQPGQEGLTIAAPNGEPVWRFGVGGSVWFKGFNLMKVGIPAGLILLIVFVFMLLQIISLRKQVAEIKRIVKG

SEQ ID NO: 109090 - protein, 114 aa, Glycine max
  Coding DNA Sequence Number=SeqID_17405
  Homolog annotation: Hit_ID=A5C693; Match level="QueryCoverage=53%, HitCoverage=27%, E-value=1e-09, Identity=44%"; Hit description =Putative uncharacterized protein
MASLDFLSFKSIFRNKFFQDHDEDQVNLCLMTKSDEKNKENSVRKKWYIDSGCSKHMTGDVSKFTTISPKKSGHVTYDDCHTLISSGDHPLLGCDPRLTTSRYFAPIVRQFVKF

SEQ ID NO: 109091 - protein, 179 aa, Glycine max
  Coding DNA Sequence Number=SeqID_17406
  Homolog annotation: Hit_ID=A5BSW9; Match level="QueryCoverage=46%, HitCoverage=6%, E-value=3e-11, Identity=42%"; Hit description =Putative uncharacterized protein
MEMTLVRANIEEDTKAVHDGFTNKISFQHHDQKIILKPLSLREEFKDVFPKEIPHGLPPSRGIEHQLTKSIPQHRDAQAKVEYVKRLYDQVKVQIAKKNKSNAKQANKNRKEVVLEPDDDPGHLRANAFQEGGNDENPETDQTQDKGPSGEGQSPRVEKDEGPEAEALPRLLIVAEGLD

SEQ ID NO: 109092 - protein, 234 aa, Glycine max
  Coding DNA Sequence Number=SeqID_17407
GYTPSPWVLVTLTVERTTRPRLERTTRPHHQRAARPHLQRTTCPCLERATRPHLGGLHVLAVKGYMCLHLCRATSYPHRSRGLHVLALRGLHVLTIRGLHALTPEDYMSSHFQREGIALTLGTRLPLPPSVGLHVPRLRKADTTISPRFQWATALTLGTGTVVFLLTVPGPPPDIGGGPTVRAQPEREAITQLLCILGQDFTRAAAKRRQHSAQRPQCQSPPAEVSVGLCRPDM

SEQ ID NO: 109093 - protein, 79 aa, Glycine max
  Coding DNA Sequence Number=SeqID_17408
  Subcellular localization annotation: CTP_CleavageSite=33; ConfidenceScore=5.17e-01
MSFLMAVVLDAGMNFSKNALLRCRDVPFCGRARARLTGALSKGGKMRGVATNVYLWKTSEKSKETGQNENSKFGSCIYA

SEQ ID NO: 109094 - protein, 76 aa, Glycine max
  Coding DNA Sequence Number=SeqID_17409
MAGAGDNGGVYHQLDEFQRLLLDAMTSQIQRLLNHNNEVLYRRIERLEHQMNPNSRRPYGGNIRAGVIQMPMLTGR

SEQ ID NO: 109095 - protein, 108 aa, Glycine max
  Coding DNA Sequence Number=SeqID_17410
  Homolog annotation: Hit_ID=A6N1H4; Match level="QueryCoverage=34%, HitCoverage=33%, E-value=9e-12, Identity=91%"; Hit description =Retrotransposon protein
MGDNLLRREGNSPDHQLRPLNDRSVIKEVWVQRQPGGERSALKGRTRASSAGRSGSENVGLSNANVGENPMPRKPKGSSARPKGVVYGQQVNIPVLPFVGPEGRMRLG

SEQ ID NO: 109096 - protein, 131 aa, Glycine max
  Coding DNA Sequence Number=SeqID_17411
  Homolog annotation: Hit_ID=A5BSC1; Match level="QueryCoverage=42%, HitCoverage=3%, E-value=1e-07, Identity=39%"; Hit description =Putative uncharacterized protein
MATPMSTTCYLDKDEIGQSIDIKKYRVRYSHSDFAGSKTDRKSTSGTCHFIGSALIEEAKEHHLDDDALIPRNVAPCRACRPWIFFINGALCLLKINGSGMENEERFWRCHFKEKMSQEQAHHHRKPYIRA

SEQ ID NO: 109097 - protein, 69 aa, Glycine max
  Coding DNA Sequence Number=SeqID_17412
  Subcellular localization annotation: CTP_CleavageSite=35; ConfidenceScore=5.24e-01
MGLPAATYHQKRKTLDETSLLSSKLKTQNNHRSTSTSNVSHKPRLLKDSFLANKNKKRSLRCWTLNDLK

SEQ ID NO: 109098 - protein, 489 aa, Glycine max
  Coding DNA Sequence Number=SeqID_17413
MKVGLSALYKVIACAPKREKQIGKNSWQIWIPKHPLDGNEGLYNYNNPMLAIRQLGYPMRGAPSEEIIAPFIAKDKELKGSSNGVIDGYHKWLKSWTQGITWLLKLKGLSGKEAKVPEESEEVQALKEELEKMRVVKEKLKMTVTRVRKKCDELRDVNMTTVEALEWETKRAQKEEWSRNKFRGALWGSNNELKLRRAERDELRMESMVLKDKLKACQRAKRSLTEQLSKMEENMLTIIDQYKEKVNLAASHGLLARAKAMVDKYLALNEVHGLSDYCQHMHPYRTRAKAKIMSEIEEVQEQMKADIEAMKDQMTTMMSMRRMMKVNTAAVATTSAAAEVDPTHPSGVNQMSHPVPDVVGQGGEALGSTDGPHVVQSKNSFPPYGLPPNYAPPNVVHVPNENVDHSAPVPLESQQPQLGHAHFAQPIEGGGGYVKNPETMLWSTSSLTPDMPLRGQHLVACPSLTPSPAATLTFLGGKTASGHGGKREI

SEQ ID NO: 109099 - protein, 119 aa, Glycine max
  Coding DNA Sequence Number=SeqID_17414
  Gene Ontology: Mol. function=helicase activity; Biological process =viral genome replication
  Homolog annotation: Hit_ID=A2Q378; Match level="QueryCoverage=80%, HitCoverage=6%, E-value=1e-19, Identity=44%"; Hit description =Putative uncharacterized protein
  Pfam annotation: Domain name=DUF889; Domain location=1-116; Score= -58.7; E_value=1.7e-07; Accession=PF05970.5; Description=Eukaryotic protein of unknown function (DUF889)
LDIGDGKLAEPNDGYGEITIPDEFLIKDFQDPIQAIVEATYPDLLHNYNNGDFLQKRVVLASTKDVVDKINDYVLSLIPGEEKEYCSADSVDKSDELHFIGGVLYCHHQKGGDCRCNWL

SEQ ID NO: 109100 - protein, 204 aa, Glycine max
  Coding DNA Sequence Number=SeqID_17415
GLHVLTFVGHHALTFRGLHVLANRGLHAFTLRGLHVLTNVGLHALTFRGLHVLANRATHALTFRGLHVHAFRGLHVLTIRGLHALTSRGLHVLALRGLPALALGTFTYPLQRTTCPRLERATRLHLGGLHVLALRGLHAFTLGTSYLHLQRTTRPRLERTTCPHHQRAARPHLQRTTCPRLERATRPRLGYFYLSPPEDYMSSP

SEQ ID NO: 109101 - protein, 27 aa, Glycine max
  Coding DNA Sequence Number=SeqID_17416
MAGKQPMGRFGVRVFAVFGACIQFHKG

SEQ ID NO: 109102 - protein, 123 aa, Glycine max
  Coding DNA Sequence Number=SeqID_17417
MSGCTHDSPQISASPYQLDLAPYASEPYNAQWNAPGLLHDKHTLRSSRILGEMEVDEPWLGLWLPLNYQVDMGASGVRHWKCGRQALGVDLGMAVVDNWVVGKEKVCYWLSNDIVGLVGNLVV

SEQ ID NO: 109103 - protein, 133 aa, Glycine max
  Coding DNA Sequence Number=SeqID_17418
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLHAGDGET

SEQ ID NO: 109104 - protein, 64 aa, Glycine max
  Coding DNA Sequence Number=SeqID_17419
PKEDCEHDSISPCSQDKTQHVEEDNIEGLVVEAREYLCVKVANQSPLFEDGVVSTQNGDGRRSP

SEQ ID NO: 109105 - protein, 145 aa, Glycine max
  Coding DNA Sequence Number=SeqID_17420
  Homolog annotation: Hit_ID=A5B9I8; Match level="QueryCoverage=84%, HitCoverage=6%, E-value=1e-12, Identity=32%"; Hit description =Putative uncharacterized protein
MSKYGGWNALIHGRNSTAFSNWWKDLKSIFQQQHTNRLSNNLCWKLGNGAKIRFWKDKWREDDLTLQEKYPTLYQVSYQQDSSISLMGILVDNKWEWRMQWRRNFFDHEIDMVAAFMDEIDAVQICPTSMDSLIWKADPSGTYST

SEQ ID NO: 109106 - protein, 162 aa, Glycine max
  Coding DNA Sequence Number=SeqID_17421
NRAMGFPALITGLCQSFGVPVAPTKVIRPPITRAFIEKYCTQRQAQGDAPQAAGVPPPPHQAGPAGSFDMEQYLRHLVRQQAANHRAHVQTHDCLYQMSLSMQSQGFASFSCPTPDQFRAEVAWPGDWPEAQAGEAPPKVLGDGEEGHEDEEMADLLDFLGG

SEQ ID NO: 109107 - protein, 37 aa, Glycine max
  Coding DNA Sequence Number=SeqID_17422
MYNAKYSLKAQVEKDEGPSGEGQSPRVEKDEGPSGEG

SEQ ID NO: 109108 - protein, 78 aa, Glycine max
  Coding DNA Sequence Number=SeqID_17423
MTEREMITIMVDTLPTFYYEKLIGYMPANFADLIFAGEMIESGLRKGKFEYASNVAPNNNTRGKMKETPTQSPPPRRG

SEQ ID NO: 109109 - protein, 171 aa, Glycine max
  Coding DNA Sequence Number=SeqID_17424
  Homolog annotation: Hit_ID=A2Q6C8; Match level="QueryCoverage=55%, HitCoverage=26%, E-value=5e-08, Identity=29%"; Hit description =Lambda integrase-like, N-terminal
MDENQWMCDSMMSEEVYMNVENEKDVGFKVEHVDCSDAFKTSQLLVSHDEVLQWARSLAHDIGFVVVIMRSDTNIGVRGRVSFLLIACEMSGEYRPKKHNLDDNVVRDLFWSHPDEQFRGLFMKVDTLPEVIVTDRDLSLINAVKTVFPDATNLLCWFHIDKNVKAKCKTL

SEQ ID NO: 109110 - protein, 199 aa, Glycine max
  Coding DNA Sequence Number=SeqID_17425
MKDKRDEEEKLEKQNKKKDSKALSSKAKGKEKEEKDSSKKIVKKENHFATKGDIKRALLLKQSFYLLLSRETSLITAIPLEHEVIPQVKEFLDKGLVRKSLNPCAFLVPKIGIIRHRIPMIGGMMNVLSGATLFCKITHAPNIFMISIHRDSLGRNNQHENKEKGVEERINEFQEPLDLRSNPFQGGGNDAIPPPKVIG

SEQ ID NO: 109111 - protein, 137 aa, Glycine max
  Coding DNA Sequence Number=SeqID_17426
MPPTRHPLDPDKSNRALGVPVTPSKVIRPPITQAFIEKYCTPRQAQGDAPQATDAPPPPHQVDPAGSLGMERYLQHLVRLQAANHRGQVQIHECLYQLSLSQQGQGFVPFVWRSVQIHECLYQFRAEVAWPGDRPET

SEQ ID NO: 109112 - protein, 144 aa, Glycine max
  Coding DNA Sequence Number=SeqID_17427
  Homolog annotation: Hit_ID=A0ST23; Match level="QueryCoverage=31%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLVPTRATFCQPPLCTLLPRGTELEFVIMVIAVSFGKPVVPAALMNRPTRGERRFAYWALFRFLAH

SEQ ID NO: 109113 - protein, 131 aa, Glycine max
  Coding DNA Sequence Number=SeqID_17428
  Gene Ontology: Mol. function=nucleic acid binding
  Homolog annotation: Hit_ID=A5AYU6; Match level="QueryCoverage=54%, HitCoverage=12%, E-value=2e-13, Identity=49%"; Hit description =Putative uncharacterized protein
MASANFLFPEGNSMITAIIESKNLSTMSFAILFEKLQKHEIELQKLNQNEKEQANVCLMTKNHENNEEEPLKKKWYIDSGCSKHMTGDASKFTTISPKKSGHVTYGDNNRDVIEYLLILKNVSLDMNMIRI

SEQ ID NO: 109114 - protein, 122 aa, Glycine max
  Coding DNA Sequence Number=SeqID_17429
  Gene Ontology: Mol. function=RNA methyltransferase activity; Biological process=RNA modification
  Homolog annotation: Hit_ID=P0AGJ8; Match level="QueryCoverage=100%, HitCoverage=77%, E-value=1e-61, Identity=92%"; Hit description =Uncharacterized tRNA/rRNA methyltransferase yibK
  Pfam annotation: Domain name=SpoU_methylase; Domain location=1-108; Score=35.2; E_value=1.4e-09; Accession=PF00588.10; Description=SpoU rRNA Methylase family
MGFTWDDKRLRRAGLDYHEFTAVIRHHDYAAFLEAEQPQRMFALTTKGTPAHSAVSYQKGDYLMFGPETRGLPATILDALPAEQKIRIPMMPDSRSMNLSNAVSVVVYEAWRQLGYPGAILR

SEQ ID NO: 109115 - protein, 132 aa, Glycine max
  Coding DNA Sequence Number=SeqID_17430
MTRGNPGDLQPFDPEIDRTFHRLVRHSVHPDHSIHFEHFEYFVAGNSEYFDFEQSTTNFHIENIAQPPPHERTLREMAAPDFTYESLCIQYPDEGVPYVLKTGQIHLLPKFHGLAGEDPHKHLKEFHMFVPP

SEQ ID NO: 109116 - protein, 72 aa, Glycine max
  Coding DNA Sequence Number=SeqID_17431
MEDVQLFELQEQGGTQEEFVVGSSFCSVIAAFVATVNCCFAEEFVIGSSFCSVIAAFVATVNYPFQLNIICG

SEQ ID NO: 109117 - protein, 82 aa, Glycine max
  Coding DNA Sequence Number=SeqID_17432
MSIKGGAGGAGGGDSISTSGEVGGSTTGGCDSAGHLVQKLFHGYYWPVASGSMVAVRGGGLDDERMSSTLALFLEVICKKRM

SEQ ID NO: 109118 - protein, 64 aa, Glycine max
  Coding DNA Sequence Number=SeqID_17433
MRHAPDLNSQMQCVFVKATQSCTVTPPFLGDQPRLQEGSLPGDTPPSTKYILPQFILFSMSYEA

SEQ ID NO: 109119 - protein, 80 aa, Glycine max
  Coding DNA Sequence Number=SeqID_17434
  Subcellular localization annotation: CTP_CleavageSite=33; ConfidenceScore=5.17e-01
MSQPSLLWASEARLTGASSKGGKRAESPPTFICGKRRKNRRKPIMKNIPYSGVVFTFEEGRQKRGSCSYVPSIEEEIRPP

SEQ ID NO: 109120 - protein, 47 aa, Glycine max
  Coding DNA Sequence Number=SeqID_17435
MHQTSSSSVIRHALLMQSYPARALDRKLQVDWARDAREGPRVLMSLR

SEQ ID NO: 109121 - protein, 90 aa, Glycine max
  Coding DNA Sequence Number=SeqID_17436
MDKVDIFVPHPLANASLLIQLSPECWVQAIGLFAQATCAPECWTSKTVQSEITRLARWWGCRKTTKRSELSRIGCWTNGLSYLEKKRGLN

SEQ ID NO: 109122 - protein, 193 aa, Glycine max
  Coding DNA Sequence Number=SeqID_17437
  Homolog annotation: Hit_ID=UPI00006A2D9E; Match level="QueryCoverage =94%, HitCoverage=94%, E-value=7e-07, Identity=16%"; Hit description =UPI00006A2D9E related cluster
DYMSSPFVGLHALTFRGLHILAFRGLHVLTLRGLNVLALRGLHVLTIRGLHASHLQRTTRPRLERTTCPHHQRAARPHLQRTTRPRLERATRPCLGGLHVLTFVGLHALTFRGPHVLTFRGLHALAIRGLHVLTFVRLHALTFRGLHVLANRGLHAFTFRGLHVLANRGLHALTLKRTTRPHLQRTIHPRLER

SEQ ID NO: 109123 - protein, 108 aa, Glycine max
  Coding DNA Sequence Number=SeqID_17438
  Gene Ontology: Mol. function=orotidine-5'-phosphate decarboxylase activity; Biological process='de novo' pyrimidine base biosynthetic process
  Homolog annotation: Hit_ID=A1FWT7; Match level="QueryCoverage=100%, HitCoverage=44%, E-value=7e-54, Identity=100%"; Hit description =Orotidine 5'-phosphate decarboxylase
MEACAAANSSDMRLLAVTVLTSMGRPDLAQMGIDREPVDVVVERALAAQAAGIDGVIASGQEAGPIRAATGAGFSIVCPGIRPGGPVGDDQKRTVGVAQAFADGADAI

SEQ ID NO: 109124 - protein, 56 aa, Glycine max
  Coding DNA Sequence Number=SeqID_17439
EGEALKDSSECRPWGSPDLSALLSLFRSHMVGAFSQNTVTLTGLPMISPSESDLTC

SEQ ID NO: 109125 - protein, 31 aa, Glycine max
  Coding DNA Sequence Number=SeqID_17440
ATGPMTSRDQVRSICTLVSSRGGGPDDKQRP

SEQ ID NO: 109126 - protein, 59 aa, Glycine max
  Coding DNA Sequence Number=SeqID_17441
MALDRRLQEDWARDVEEGPRVLMSLRDLIEAQRSSLHRSFISKLPTSGIRAQELQVGAP

SEQ ID NO: 109127 - protein, 122 aa, Glycine max
  Coding DNA Sequence Number=SeqID_17442
  Pfam annotation: Domain name=G-patch; Domain location=1-42; Score =21.7; E_value=0.00045; Accession=PF01585.14; Description=G-patch domain
MVARVMLKHGFEPGMGLGKDDLGNADIVDIRGNMYKNGLGYEPGMPGRRNVPSRLRADRAWPGRISQCFASAGMMSEEEVAAVGEEFPQDPPNFVQPCHPVSQGRFFEDPKDEGLTIDFDRD

SEQ ID NO: 109128 - protein, 77 aa, Glycine max
  Coding DNA Sequence Number=SeqID_17443
MTRGNLGDLQPFDPEIDRTFHRLVRHSVHPGHSVHFEHSKHFVEGDSEYSDFEHSTTNSYTDNMAQPPPYERTLREM

SEQ ID NO: 109129 - protein, 69 aa, Glycine max
  Coding DNA Sequence Number=SeqID_17444
MKHSSKLEVGGHMNSARQGHSWGSEKSVEWRIALEGGVGYRQSRMTLNGNLKGRDTKNGFSFAGSPLPC

SEQ ID NO: 109130 - protein, 77 aa, Glycine max
  Coding DNA Sequence Number=SeqID_17445
  Subcellular localization annotation: CTP_CleavageSite=59; ConfidenceScore=5.37e-01
MGVQIATRPTWAFQKIPPEGGCFWRKQPSSLGKSKLRRFRNVSVGHFAKIFNRSSFILQSSTGKSPKSNFSIHSMYP

SEQ ID NO: 109131 - protein, 43 aa, Glycine max
  Coding DNA Sequence Number=SeqID_17446
MAEINQGMEANGGWDRNRPSVTPSRRWASGEHRCKAAQYPLNS

SEQ ID NO: 109132 - protein, 78 aa, Glycine max
  Coding DNA Sequence Number=SeqID_17447
  Subcellular localization annotation: CTP_CleavageSite=65; ConfidenceScore=5.55e-01
MGYGYGGSCPRPTWRRLASRAHFSGNRGTGGLRIGRSSASSLTDSLRSVVRLRRAVSAHSKAVIRLSTESGDNAGKNM

SEQ ID NO: 109133 - protein, 191 aa, Glycine max
  Coding DNA Sequence Number=SeqID_17448
MGSFLKFFREGAVIYMFCMHAPRKSPVELASLLSVNKSQVAMVILSCIGTRQFDWRVPLGRLRRSSFAGVRPCSFAGVRQAMQSGWRVVVMVILSCIGTRQFDWRVPLGRLRRSSFAGVRPCSFAGVRQAMQVCRVQWSAVQEGTTNRDGNLHLTEIVSVAGELWTVLCSSYYVVSLLFLLCDFSVSLVRM

SEQ ID NO: 109134 - protein, 161 aa, Glycine max
  Coding DNA Sequence Number=SeqID_17449
  Homolog annotation: Hit_ID=A5C693; Match level="QueryCoverage=47%, HitCoverage=34%, E-value=6e-07, Identity=31%"; Hit description =Putative uncharacterized protein
RVHLLGLLTENKRGYISCGSVLVEGTSTRFKENKGGSRSNLKSSQDHDEDQVNLCLMTKSHEENKEDSVRKKWYIDNGCFKHMTGDVSKFTTISLKKVDMLHTATTTRGKLLESVATYPSAGGRRVTRGCVFQERNTRGVATNVYLRKNNGKTGKDVVYEF

SEQ ID NO: 109135 - protein, 108 aa, Glycine max
  Coding DNA Sequence Number=SeqID_17450
MELIENMAASDQAILRDHSHVPTKKSLLELSTQDATLAQNKLISRQLEAITETLSKLPQQLQAVNISHSPVLQVEGCPTCGGTHEPGQCAIQHEPSQEINYMGNPNRQ

SEQ ID NO: 109136 - protein, 159 aa, Glycine max
  Coding DNA Sequence Number=SeqID_17451
METMMSMKKILEVNATVVAATNAIAEVDSTPPSGLNQIIHPTSDMVGQGGKELGSTGAPHFVRVQNKHPFLPYGLPPNYAPPNVAHAPDENVNNYSPILIESQQPQADHSHVSQPMGETHEIPHHNLADFEPRLGYATEGQAVGRVPLPNTLEGPQFRP

SEQ ID NO: 109137 - protein, 123 aa, Glycine max
  Coding DNA Sequence Number=SeqID_17452
  Homolog annotation: Hit_ID=Q9KHC4; Match level="QueryCoverage=34%, HitCoverage=8%, E-value=2e-07, Identity=69%"; Hit description=SocE
DAGSRQARQGASAGVGGCRGWLNYAASEQIVLRVHHMRAIGAGLFAITPAGERGMCCKAIKLGNARVFPVTTFRETCRASCINESANARGEAVCVLGALPLPRSLTRCARSFGCGERYQLTQR

SEQ ID NO: 109138 - protein, 43 aa, Glycine max
  Coding DNA Sequence Number=SeqID_17453
MYIYVEMALRKLASKRSRKDTAAAGTSATPEFDSHRFRSTEHQ

SEQ ID NO: 109139 - protein, 235 aa, Glycine max
  Coding DNA Sequence Number=SeqID_17454
  Gene Ontology: Mol. function=motor activity; Cellular component=cell projection
  Homolog annotation: Hit_ID=UPI00016621D1; Match level="QueryCoverage =74%, HitCoverage=40%, E-value=1e-15, Identity=32%"; Hit description =UPI00016621D1 related cluster
  Subcellular localization annotation: CTP_CleavageSite=61; ConfidenceScore=5.78e-01
RPRLKRDTRPGFQRTTRPRLKRATRPRLQRTTRPRLQSTTRPRLQRATRPRLQRTTRLHVLAFRGLHALTLTERHFLTFRGLHFLTFRGPHILAFRGLHVLPFIGLDVLAFRGLHVLAFRGLHVLPFIGLHDLAFRGLHVLDYRGLHVLTFRGLHVPAFIGLHILALRGLHVLAIRGLHVVAFRGLHVLAFQGLHVIAFIGLHVLAFIGLHVLAFRGLHILAVIGVHVLAFRGLH

SEQ ID NO: 109140 - protein, 93 aa, Glycine max
  Coding DNA Sequence Number=SeqID_17455
  Homolog annotation: Hit_ID=A6FJQ2; Match level="QueryCoverage=40%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVSDFDKVFNLIFQDTPLFGGVSSIAMHNEVLKVVDPFVPRLTK

SEQ ID NO: 109141 - protein, 84 aa, Glycine max
  Coding DNA Sequence Number=SeqID_17456
  Homolog annotation: Hit_ID=UPI0000ECBAF8; Match level="QueryCoverage =48%, HitCoverage=48%, E-value=1e-16, Identity=100%"; Hit description= UPI0000ECBAF8 related cluster
DTARRSRTTERSESVSEEAEERPIRKPPLPARMQAWHWPSFYNVVTGKTLALPNLIALQHIPLSPAGVIAKRPAPIALPNSCAA

SEQ ID NO: 109142 - protein, 93 aa, Glycine max
  Coding DNA Sequence Number=SeqID_17457
  Gene Ontology: Mol. function=nucleic acid binding
  Homolog annotation: Hit_ID=A5AYU6; Match level="QueryCoverage=79%, HitCoverage=13%, E-value=2e-13, Identity=48%"; Hit description =Putative uncharacterized protein
MEKSEKKNFSEKKAKKAYITWDDNDMESFEDSGNEVINLSLMAKSYESDEEVSLKKRWYIDSGCSKHMTGDASKFTHISPKKSGHVTYGDNNK

SEQ ID NO: 109143 - protein, 202 aa, Glycine max
  Coding DNA Sequence Number=SeqID_17458
  Gene Ontology: Mol. function=catalytic activity
  Homolog annotation: Hit_ID=A1R463; Match level="QueryCoverage=89%, HitCoverage=24%, E-value=1e-46, Identity=53%"; Hit description =Putative uncharacterized protein
MRIRLFELVYWSWALEVANEWRSLLGLGQEQRWDRVARNMAPPARLGDGTYAALSTPPYLVRKDHPSMLMALGWLPPTDAVDPDIMRSTLEAVWARWDLQSSWGWDYPVMAMTAASLGDLGRAFDALLLPSPKNQFLPNGHTPQIPGFLSLYLPANGGLLAAIAHIVQAIEGGASEPHGWRVTYDAPDTASTGKPRAASRVS

SEQ ID NO: 109144 - protein, 137 aa, Glycine max
  Coding DNA Sequence Number=SeqID_17459
  Homolog annotation: Hit_ID=Q6L477; Match level="QueryCoverage=44%, HitCoverage=10%, E-value=2e-07, Identity=32%"; Hit description =Putative uncharacterized protein OSJNBa0009L15.8
  Subcellular localization annotation: CTP_CleavageSite=40; ConfidenceScore=5.80e-01
MASPPASPPPPPPPSLPPPPPPSTPLDALASLSAVKQTRKASRLRSLSTRPPGAERPVVHVDPATGKVDGPHRKKLRTYLGIVARDKVDVTYENWKEVPTAQKDLIWEDIHAEFEIPKASDSRTKRKLLQTVGERWR

SEQ ID NO: 109145 - protein, 92 aa, Glycine max
  Coding DNA Sequence Number=SeqID_17460
  Homolog annotation: Hit_ID=A6FJQ2; Match level="QueryCoverage=41%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLSTLEDPLSDAWTGMEFLPQAEQRGGTSWPSDYCDV

SEQ ID NO: 109146 - protein, 238 aa, Glycine max
  Coding DNA Sequence Number=SeqID_17461
  Homolog annotation: Hit_ID=UPI00016621D1; Match level="QueryCoverage =93%, HitCoverage=40%, E-value=2e-16, Identity=31%"; Hit description =UPI00016621D1 related cluster
AFRGLHVLHFRGLHVLPIRGPHIPALRGLHALAFKGLHALVFRGLHVLTFRRLHALALKGLQVLTFRGLHNLAFRGLHVLAFRGVHILPLRGLHALTFKRVHVLTFRGLYVVAIRGLHVLAFRRLHVLPFRGLHAHNFRGLHVLAFRGLHVLPFRGQHDLPFRGMQALALTGLHVLTFRGLHNLAFRGLDALAFRGVHILPLRGLYALAFVGLDTLTFKGVHVLNIRGLYIVAIRGLQ

SEQ ID NO: 109147 - protein, 103 aa, Glycine max
  Coding DNA Sequence Number=SeqID_17462
  Subcellular localization annotation: CTP_CleavageSite=30; ConfidenceScore=5.30e-01
MSLSLCFLGLNVLCSYVIVQSKKSFSVSIRNAKDTKRWGKRVFSLNILDPSSPRLASGLPRPPKDFHLKKLARLGELVASWLSLSLSRCEGRLRDGFQSPALR

SEQ ID NO: 109148 - protein, 284 aa, Glycine max
  Coding DNA Sequence Number=SeqID_17463
MSMEALFGKLRAYEHELIQQSHAEEREKKRKGIALKKFGKFLKRSSNKKFSKPSKKIESTNNTFTCFECGKQEWKEGQKTEKAYIAWEDNASTSSNSSSEEDNVNVLLIADTMNDSSTIEETKINSEFEEVLKAFNAMHDEAQRLAVSNNKLRSDLKLHITKLASTQSVPVATYPSAGTRKGQNGSDETFVSEGENEQSLHQRLFKENVRKTEKTMVKGLRILKMRRVSIAKRGFSMLSVKKEYGRAPESKQRAKHEISSLRDLSVSCQAQCNIGAKSKSTYSR

SEQ ID NO: 109149 - protein, 52 aa, Glycine max
  Coding DNA Sequence Number=SeqID_17464
MGCTPLELVFLGSSSSMDSFASWKMNASGMEKEEREKTPLQVEDESRRSSPP

SEQ ID NO: 109150 - protein, 53 aa, Glycine max
  Coding DNA Sequence Number=SeqID_17465
MEVEEPWLGLLCWKIPSLVGVLAGFVADLGVAFVDDWVFLADRVVGNGKADIS

SEQ ID NO: 109151 - protein, 101 aa, Glycine max
  Coding DNA Sequence Number=SeqID_17466
MEDTCTPVGNDIQGSPHKSGEWRIGGQRYAITSRGSRLEGGGHMNSARQLHSWRYAITSRGSRLEGGGHMNSTRQLHSWVSGKKWRMENWQTALRNNFAGL

SEQ ID NO: 109152 - protein, 235 aa, Glycine max
  Coding DNA Sequence Number=SeqID_17467
  Pfam annotation: Domain name=zf-CCHC; Domain location=84-101; Score =8.2; E_value=0.087; Accession=PF00098.14; Description=Zinc knuckle
MSLHSLSSVNGRHRAHPRPHSHWREKERKPQEANINLLYFHGKDNKDQCQGILGVTPSKPKDDKGKTIEKQPLKASMQEKTSSIKCFKCLGRGYITSQCPTKKTMIMRGQDIYSSQDEATTSPSSSESEEAKGEESSKEIYPQEEGQSLMVKEKCKEVSVSSKRLAKKERYFEIKTNIKGISPLRQPPHFLLCKKTLVSIATPLRFEFIPQVKELLDEGLVRKSLNPYALLVPKI

SEQ ID NO: 109153 - protein, 74 aa, Glycine max
  Coding DNA Sequence Number=SeqID_17468
  Subcellular localization annotation: CTP_CleavageSite=38; ConfidenceScore=5.03e-01
LSSFIGSGVYPDLSSLTGSGVYPDLSSFIGSGVYPDLSSFTGSGVYPDLSSFTGSGVYPDLSSFTWKWRHPKPP

SEQ ID NO: 109154 - protein, 115 aa, Glycine max
  Coding DNA Sequence Number=SeqID_17469
MVGYTPSSFTDLVFASERIEVGLKRGKFNHPAWTTEKSGANEEGENEGETHAATAIPTWPNFPPAQQCRYSANNNPSPYPPPSYPQRPSMNQPQNPPTTQPMHNTTFSTNQNTNQ

SEQ ID NO: 109155 - protein, 286 aa, Glycine max
  Coding DNA Sequence Number=SeqID_17470
  Gene Ontology: Mol. function=membrane alanyl aminopeptidase activity; Cellular component=plasma membrane; Biological process=proteolysis
  Homolog annotation: Hit_ID=A6T733; Match level="QueryCoverage=99%, HitCoverage=32%, E-value=1e-104, Identity=67%"; Hit description =Aminopeptidase N
GQHLSLPLHVADAFRAVLLDTDCDPALTALILTLPSENEIAELFDTIDPQAIALVRDALQRTLARELADEFFAIYNANQQPEYRVEHDAIGQRSLKNTCLTYLAFSDAQLADKLVQTQYHQATNMTDALAALSAAVAAQLPCRDALLAAYDERWHQDGLVMDKWFVLQATSPAANVMRNVRQLLTHRSFTMSNPNRVRSLVGAFASANPAAFHAKDGSGYKFLVEMLTDLNTRNPQVAARMVEPLIRLKRYDEDRQAMMRQALEQLLQLDKLSGDLYEKITRALNA

SEQ ID NO: 109156 - protein, 101 aa, Glycine max
  Coding DNA Sequence Number=SeqID_17471
MVSGNRLPRECNRLPGLKTRLRNGTGGLWRPLRNRPLVIDYQLCNSSLASGNRLPRLCNRLPEMKSLEIPLLLACSGYETQLCCGVVRYRVKESTPFFYFL

SEQ ID NO: 109157 - protein, 178 aa, Glycine max
  Coding DNA Sequence Number=SeqID_17472
MTERLLPVHWLLKVASFIISLCYLASKIYKPCTVRYRMHKALRLNAPLPYPHLVTLFLQHFSIPLDSKPYVPIKRSFLIGAAVIASFGYRKEHDGSWVKKGAQPNDGEGHLQGGEDSSLLQKILDRFDGLETFVGDRFDALELQVDMRFDEMDSRITKVEEDASYIRTSFDLPPPPSS

SEQ ID NO: 109158 - protein, 136 aa, Glycine max
  Coding DNA Sequence Number=SeqID_17473
MAPKKLSTKRSRRDATGEGSSATPKFGSHRFRSAEHQQRFEAIRGWSFHRERHVQLREDEYTDFQEETARRRWTPLVTPMAKFDPEIVLEFYVNAWPTEEGVQDMRSWVRGQWIPFDADALIQFLGDSLVLEEGQQ

SEQ ID NO: 109159 - protein, 261 aa, Glycine max
  Coding DNA Sequence Number=SeqID_17474
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=19%, HitCoverage=50%, E-value=2e-23, Identity=100%"; Hit description=LacZ protein
  Subcellular localization annotation: CTP_CleavageSite=96; ConfidenceScore=5.15e-01
MVKVGTSYVPINVSFSPKVGPGLPGINRDTRIYLFCEHRRTSALASVAVTLRVTTTPAALNAPLQGASHSPFRLRNCWEGRSGFPSHDVVKRRPVNCNTTHYRANWSSTAVAAALELVDPPGCRNSITRRRIIYRDDSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 109160 - protein, 254 aa, Glycine max
  Coding DNA Sequence Number=SeqID_17475
KVEIYHTELDEFKAELERRNFHKRLTNLADSSIDLALVKEFYANLYSPEGPSPKQVRIRGRVIRIDADSLNTFLETPVVLAEGESLPAYFRYCRMPTDIREIEAALCIPNRGSVLNAEGHPGKILRKDLTTLAQVWSVLSYSSLAPTSHTSDLIVDRARLIFGLVSQLDMNVGAFIHGQITGVASDSPIFERLSPIINLAYIRKNCWNHADLTVTIRGARRARARPAEAPSTSAAPPPARTSAASSTPSSADFQ

SEQ ID NO: 109161 - protein, 39 aa, Glycine max
  Coding DNA Sequence Number=SeqID_17476
MAGAGGGGDKYHQLEEAQRLLLDAMNAKMQRLLDRTNEE

SEQ ID NO: 109162 - protein, 42 aa, Glycine max
  Coding DNA Sequence Number=SeqID_17477
MQAGNFDLYGFLEPQSIQSALKGLDDAPQPKSKAAARWIVVK

SEQ ID NO: 109163 - protein, 112 aa, Glycine max
  Coding DNA Sequence Number=SeqID_17478
MSNHKSSESTLKNLEVQVGQLAKQIADKSSNNFVANTEQNPKEECKAVMTRSKRFVEAEDEDSVVHKKKTANKKNEVRGESNQEKEEQIMVMNKELKDKEKEVEKEIENEKN

SEQ ID NO: 109164 - protein, 322 aa, Glycine max
  Coding DNA Sequence Number=SeqID_17479
  Gene Ontology: Mol. function=binding
  Homolog annotation: Hit_ID=A7PRR3; Match level="QueryCoverage=100%, HitCoverage=55%, E-value=3e-42, Identity=57%"; Hit description =Chromosome chr14 scaffold_27, whole genome shotgun sequence
MAINLENIPSGVVGRATIGSLIILARAVTLALSHLHSQQGFPEALLVQLLKVMLHSDVEARVGAHLIFSILLFPSSFHTNEISSLRSRYVGQHNKRHSHAPSVSASASITALLEKLRRNRNTKAENHVNIVHDQERDIVAEDWKQGCGLKNSPNFYKLTSIIDKATGSPSLTDTDFPSNSAGEDDTISEASVSDLSRFIPKMPLSPSAPHVISIGQLMESALEVAGQVAGTAISTSPLPYNTMASQCESLGTCARKKLSNWLAFENHYSQALDDKSFLAIADIRNSAPEKVTNGGGHAQLPRDPMKLPPASPFDNFLKAAGC

SEQ ID NO: 109165 - protein, 43 aa, Glycine max
  Coding DNA Sequence Number=SeqID_17480
MVGIDVIREPTSQGYTREDADEFIFCSYNGHNWVFSKVEWFHE

SEQ ID NO: 109166 - protein, 79 aa, Glycine max
  Coding DNA Sequence Number=SeqID_17481
SRLFRFFRRFPQINVGGDSARIPFMEHASRESCVALPPKGRLRHPEIGPRPKQERRPQKLPTMEKRPTRTRRWPICLTS

SEQ ID NO: 109167 - protein, 149 aa, Glycine max
  Coding DNA Sequence Number=SeqID_17482
  Homolog annotation: Hit_ID=A6FJQ2; Match level="QueryCoverage=25%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARGTSTWVVVTENKRGYISCGSVQVEGTSTWLFKENKGGYIPCGSLLVKAFTRLKRNLKDRRSLGDW

SEQ ID NO: 109168 - protein, 155 aa, Glycine max
  Coding DNA Sequence Number=SeqID_17483
  Subcellular localization annotation: CTP_CleavageSite=61; ConfidenceScore=5.50e-01
MSPMAYFAVYSATAFSSAKRLSSGRDCLDAQAPMRLPRGREARRTPVRRNPSTAPCAHWPVCKKFERLGGFGEVVACVCHFGYFKSLSEFADHPARESPPRNPNGAGQEGASSITGILSMVLPGCVVAGFDMALLSGQLLVWRRSRWGLCQNSIS

SEQ ID NO: 109169 - protein, 200 aa, Glycine max
  Coding DNA Sequence Number=SeqID_17484
MVPRKLSTKRSRKDAVAEGTSTAPEFDSHRFRSAEHQQRFEAIKGWSFHRERRVQLRDDEYTNFQEEIARRHWTSLVTPMAKFDPEIVLESYANAWPTEEGVRDMRSWVRGRWIPFDADALSQFLGDPLVLEEGQECEYSQRRNRLMDLTRRPLLSCIHTGSGFCPDRCRETGADHAHQHDYLDPDVDDVAAQEHPTQRS

SEQ ID NO: 109170 - protein, 194 aa, Glycine max
  Coding DNA Sequence Number=SeqID_17485
  Gene Ontology: Mol. function=heat shock protein binding; Cellular component=cytoplasm; Biological process=response to stress
  Homolog annotation: Hit_ID=A6WWB0; Match level="QueryCoverage=58%, HitCoverage=60%, E-value=7e-60, Identity=99%"; Hit description =Putative uncharacterized protein precursor
  Pfam annotation: Domain name=DnaJ; Domain location=119-181; Score =112.6; E_value=1.2e-30; Accession=PF00226.22; Description=DnaJ domain
MGGVSIEKAVPDSSTITGSVKQPQPVETDTGKLSDQSAIRNVVSALNFTEWGKKPVPWANPDTGSQGTITTIAEYSKNNQLCREFETSREAFDGVSIYRGETCMQRGGQWTVTSNYMRDPYSVLGVAKTAKPEEIKSAFRKLAKKHHPDQNKDDPKAQERFAELNQAYEIVGDKDKRGQFDRGEIDAEGKPAFQ

SEQ ID NO: 109171 - protein, 89 aa, Glycine max
  Coding DNA Sequence Number=SeqID_17486
FYRDSFGFLRENKKLQCEGFSSKLRHDFAIPNGENARNWVANVVLKFHDDPTVNDSEIIVFLRQVLWAAGKRKGFERKKGKTKMRGRGG

SEQ ID NO: 109172 - protein, 18 aa, Glycine max
  Coding DNA Sequence Number=SeqID_17487
MDFYKDSGSLKWVARVLD

SEQ ID NO: 109173 - protein, 293 aa, Glycine max
  Coding DNA Sequence Number=SeqID_17488
MERSMIDAASGGALGDMTPAEARNLIEKMASNSQQFSARNDAIVIRGVHEVATNPSASSETKKLEGKLDALVNLVTQLALNQKSVPVARTFALPCSNLEQLSNLKLMLQIFTIDLLYLSSKINHSRAIMTFPATDTTLDGGITLTSDGPALSNNSSSPAPSFQNAAGPSRPYIPPPIQQQQQPHKHPTVEAPPQSSLEELVRQMTMQNMQFQQETRASIQSLTNQMRQLATQLNQQQSQNSDKLPSQAVQNPKNVSAISLRSGKQCPGPQPVTPSSSTNEPAKLHSIPEKGDD

SEQ ID NO: 109174 - protein, 177 aa, Glycine max
  Coding DNA Sequence Number=SeqID_17489
  Homolog annotation: Hit_ID=UPI00016621D1; Match level="QueryCoverage =90%, HitCoverage=42%, E-value=3e-12, Identity=32%"; Hit description =UPI00016621D1 related cluster
MDVVPSEGYTPSPSEDYISSPSEGLHAFAFRGLPVLTFRGLQTLNFRGLHVLPLRGLHVLAFRGLDVLSYRGLHALTFRGLYALPFRGLHALAFRGPHALIFRGLHVLTFIGLLSLTFRGLHVLTIRGLHAFTIRGLHVLAIRGQHVLAFRGLRILTFRGLQVLAFRRLHVLAFRGL

SEQ ID NO: 109175 - protein, 87 aa, Glycine max
  Coding DNA Sequence Number=SeqID_17490
MVIDQSLLFKLTQLSCDGVPFEGTLDDEWKFDFSVSDACQMVCTNQADMTRRLLAVKRSFSIGANVVSSFGYRKEKDGSWVKKDAPA

SEQ ID NO: 109176 - protein, 144 aa, Glycine max
  Coding DNA Sequence Number=SeqID_17491
  Homolog annotation: Hit_ID=A0ST23; Match level="QueryCoverage=31%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLMHQYEKVGTELEFVIMVIAVSFGKPVVPAALMNRPTRGERRFAYWALFRFLAH

SEQ ID NO: 109177 - protein, 93 aa, Glycine max
  Coding DNA Sequence Number=SeqID_17492
MAIDMKTKFDKYWSDYNNVLSFGCILDPRSKIKNLKYFNSKLGLAPLELVALGSSSSIDSFASWKMSGSGMEKGERDEMPLQGEDESRRSSPP

SEQ ID NO: 109178 - protein, 209 aa, Glycine max
  Coding DNA Sequence Number=SeqID_17493
MYLSRRAPGSQQIKGTKTTKQGGLCGGWPAVNFDSYVGYGLWLENEVRKLGELLRNGSLVIDYQIMMAAQLIHDRVEMECLEGAWETLEGNTRCRFWGTIRFTTNSLVHPDEPVRTLQHTVEWILPMPTPYCLVEPAQVIELTSSEEDPEEDLEELPPEPAVDALDFLGGDEDPLPEVDSPEEVMSASEADSTEDSGPGEMAISGSSSS

SEQ ID NO: 109179 - protein, 63 aa, Glycine max
  Coding DNA Sequence Number=SeqID_17494
MEKRHNIVQRDQNLPYKKMETRSLLVPPLDKGGYKSPIADEQACPIYAPSFHGRILQLRTFLN

SEQ ID NO: 109180 - protein, 61 aa, Glycine max
  Coding DNA Sequence Number=SeqID_17495
MEEDHKKTLKFLDVTNASNLVTSKLIVLQMKNDLRKVIRKEKEINLLTKDYESDENISQED

SEQ ID NO: 109181 - protein, 175 aa, Glycine max
  Coding DNA Sequence Number=SeqID_17496
VSYEKSATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTRILLFETYISLIEEVQIFIQDAWRDCDKRVLYWATRDCCKHGKQ

SEQ ID NO: 109182 - protein, 386 aa, Glycine max
  Coding DNA Sequence Number=SeqID_17497
  Gene Ontology: Mol. function=transferase activity, transferring groups other than amino-acyl groups; Cellular component=cytoplasm; Biological process=protocatechuate catabolic process
  Homolog annotation: Hit_ID=Q8FW29; Match level="QueryCoverage=88%, HitCoverage=85%, E-value=1e-167, Identity=86%"; Hit description=Beta- ketoadipyl CoA thiolase
  Pfam annotation: Domain name=Thiolase_C; Domain location=238-350; Score=152.0; E_value=1.7e-42; Accession=PF02803.9; Description =Thiolase, C-terminal domain
  Pfam annotation: Domain name=Thiolase_N; Domain location=2-231; Score= 263.6; E_value=4.2e-76; Accession=PF00108.14; Description=Thiolase, N- terminal domain
  Pfam module annotation: Pfam domain module=Thiolase_C::Thiolase_N; Domain location=238-350::2-231
MERNGSVDWEAVDDVIFGSANQAGEDNRNVARMSLLLAGLPVGVSGTTINRLCGSGMDAVITAARAIKAGEAELVIAGGVESMSRAPFVMPKADSAFSRKAEIFDTTIGWRFVNPLMKKQYGVDSMPETGENVAEDFNVSRQDQDIFALRSQEKAAVAQENGRLAREIVPVTIPRRKGEPIIVDRDEHPRVTSLEALAKLGTPFREGGTVTAGNASGVNDGAAALIIASEEAIKKYGLTPIARIVGGATAGVPPRIMGIGPAPATRRLCARTGIATDAFDVIELNEAFASQGLAVLRDLGISDDDERVNPNGGAIALGHPLGMSGARIAGTAALELSLNRGRGSPLRLNAFEARANEKSGRFARILHLVKRDNTFALSGDYNIARD

SEQ ID NO: 109183 - protein, 78 aa, Glycine max
  Coding DNA Sequence Number=SeqID_17498
MSIRHASPRQQKSPANRACTCIAHALAVKTGDGQQSGQSDPGRPESGQIVSALVPPRHRPDYLCQTNLMRCRKHKLRR

SEQ ID NO: 109184 - protein, 146 aa, Glycine max
  Coding DNA Sequence Number=SeqID_17499
LFLDGGKGYNSAVECHLDVVEVISSSLIIPKPNRTPVEYEAPGYKLCLGMEENSESALSTNKEAISNATRNLMESSILAQDERWRHALHMQVGREVVFPVADGHGPDSYGRQQWGIFRNGRKPDGAMPREGRRPTGHELLFPEKKQ

SEQ ID NO: 109185 - protein, 233 aa, Glycine max
  Coding DNA Sequence Number=SeqID_17500
IPGLFRDAVAGHIVPDIVRSEITAELDLAALACIQRVPVALQRRAHEPGEDCQVARVRRIGAVSGRQYAVEHRRGNPWQLGPVPVGHGELRITAERADRALRNQLRGPNRNATGIAVGRLGTLRQQAPEAATHETATMKRIASGGKKITTCVAHSLPPGFAGGSVAAAGPTGTSSPAASTGRCNDGRGGSGDHSRRRVHMCPAEAVHRRRCGVADQPGMACRYGSGFTLTTRF

SEQ ID NO: 109186 - protein, 127 aa, Glycine max
  Coding DNA Sequence Number=SeqID_17501
  Subcellular localization annotation: CTP_CleavageSite=51; ConfidenceScore=5.37e-01
MATCPRLQRTTRPGFQRTARPRLQRTTCPRLQRTTCPRLQRATHPHLRGLRALTFRGLHILAFIGQHVLTFRGLHVLALRGLHVLAFRGLHVLAFRGLHVLIFRWLHALTFRGLQVLAFRGLHALAL

SEQ ID NO: 109187 - protein, 129 aa, Glycine max
  Coding DNA Sequence Number=SeqID_17502
  Subcellular localization annotation: CTP_CleavageSite=36; ConfidenceScore=5.02e-01
MEAIIQQLCIPGQDFTRATTKRRQRSVQRPQCRSPSTEASVGLCHRDIGVAPTRHPVDLEELNRALGFPALVTGLCHSRKVPVPPPPPQQGIAPARHPVDPEKPNRVLGFQALITGLCQFYGVPVAPSK

SEQ ID NO: 109188 - protein, 261 aa, Glycine max
  Coding DNA Sequence Number=SeqID_17503
  Homolog annotation: Hit_ID=A6FJQ2; Match level="QueryCoverage=14%, HitCoverage=84%, E-value=9e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPLTFFDPTTLQPIPYSSGSIRSSKTWVNPNSKPVAHPTNQPSAMLTNSSSHDNGQACSTWIPDSGASFHVTGEPQHIKQFARFDGPDQIFIGNGEGLSISSVGSSSFVSPNDSGRETCRASCINESANARGEAVCVLGALPLPRSLTRCARSFGCGERYQLTQR

SEQ ID NO: 109189 - protein, 79 aa, Glycine max
  Coding DNA Sequence Number=SeqID_17504
MVAITPARFPQTPIFSEDMTRTQHVHIVGEPWGIPLSTDFQVQAIGQFAQATCAPEFGLPRPFNQRLLVLHVGGVAVKQ

SEQ ID NO: 109190 - protein, 145 aa, Glycine max
  Coding DNA Sequence Number=SeqID_17505
  Homolog annotation: Hit_ID=A2Q6C8; Match level="QueryCoverage=87%, HitCoverage=43%, E-value=2e-11, Identity=28%"; Hit description =Lambda integrase-like, N-terminal
FHIDKNVKAKCKSLIGQKNVWDYVMDSWGNLVDCPSKQEFLEHLQRFQVVCSPWPMFVDYNSVGDLYSVWDAMNNMMTLQHTEIGASFETSTHVVGHVFKKTLYKSLLGMVSRYALNEISVEFERVRHFKNMLNSGPGQSQAAPT

SEQ ID NO: 109191 - protein, 171 aa, Glycine max
  Coding DNA Sequence Number=SeqID_17506
MIPYKSVTRLGLYFQNIIEVPSVYHKQWAPDYPNYVVFDYNGKKHHIRVRKFSNRVYIVDGLKHFRRDMRIYEGVMITFVAPDKNWKFDIHFSLPLHAQTCGRPVHSAREYVFIVDVDNRMIARLYPLVLPLDAVGYVNVGDEYVTVLGVRRRRHFWKLSMYNGLQCFVEP

SEQ ID NO: 109192 - protein, 108 aa, Glycine max
  Coding DNA Sequence Number=SeqID_17507
MAEDHPQRMTLEDYSSFATPQYLTSIARLDVQAANISYPHSLIQLIQGNIFHGVPEDAIHLNLFSSSLASEAKRWLHSFKGNSLWTWEAMVEKFLKKYFPEVQDRLGE

SEQ ID NO: 109193 - protein, 135 aa, Glycine max
  Coding DNA Sequence Number=SeqID_17508
MGEVEEVQEQMKADMEAMKEHMATMMEAMMSMKKIMEANTIAIPATSAVAKVNPMPPSDLNQMNHPISNMVGKDLGCTDGPMMCKFKTSTPSRHMACLPTIRHPMWCTLPMRMSITPLLYSLRANNLKSDHAHVS

SEQ ID NO: 109194 - protein, 687 aa, Glycine max
  Coding DNA Sequence Number=SeqID_17509
  Gene Ontology: Mol. function=protein transporter activity; Cellular component=membrane; Biological process=cell division
  Homolog annotation: Hit_ID=Q7VZR4; Match level="QueryCoverage=50%, HitCoverage=33%, E-value=1e-127, Identity=67%"; Hit description =Integral membrane component of multidrug efflux system
  Pfam annotation: Domain name=HlyD; Domain location=40-261; Score =22.1; E_value=0.00071; Accession=PF00529.11; Description=HlyD family secretion protein
SADSGNNTQSQQAILVAAEEARAKTVPTVLTGIGELEATRQVMVTSESGGLVTAILFNAGARVHAGQTLVQLNDAPEQGQLIKLKAESVNAKAQLARTRTLFRQQAATQEQLDQVQANWQQLQGEIVRVQALIDQKRIKAPFSGVLGVRKVNTGQFIQAGDGMVSLTDAGEIYANITLPEHALPVIKTGLKMNITVDAYPNQTFSGTISTIEPMIDRGTRTLLVQATLANSDNRLSPGVLVKGSISLPDPQKIVSVPETAINYNAYRDFIYVIDKNDENKLIARQVYVKTGGRDGSYVAIVEGIKAGVRVITSGQLRINNGAPVEIASVDTLATEDQSAHSVAHTLIFLMGLLALNNLPVRQYPLTESSTLTITTQYPGASPQLMQGFVTQTIAQAVATVEDVDYMTSTSTQGRSVIMVRMKLNADSNKAMTQIMAKVSEVKYRLPAEAYDPVIVKSSGDATAVAYVGFSSPTMSTAALSDYVSRIVQPQLSSIEGVGSLDLNGGQRMAMRVWLNAEQMAARGIAAGDVSRALLENNVQAAPGQAKGLYVVSDIQVNTDLVSVDEFRNMVVKRTINGVVYLRDIATVELGAASTNTSALMDGVNAVYFGLNAAPNANPLVIVKKLNEILPEIKKNLPPDVTVAVPFELARFISASIDEVVHTLIEAIVIVIFVIFLSLGSARAVIIP

SEQ ID NO: 109195 - protein, 68 aa, Glycine max
  Coding DNA Sequence Number=SeqID_17510
MEGCCPLGQTWEVLIPSSNVNTTPESWNILHDRFPSVFLTFSTNKRWWRLSAFSSIGRHTREPRLARS

SEQ ID NO: 109196 - protein, 85 aa, Glycine max
  Coding DNA Sequence Number=SeqID_17511
WPTTGGKCRYMSVSTSSASVSRARVLLLLHALLQISLGLRSHGSEIGPRDQTKEAPAGAPDDAEDACMDEEMTDLLGFLGGSGAM

SEQ ID NO: 109197 - protein, 62 aa, Glycine max
  Coding DNA Sequence Number=SeqID_17512
MTVKTSDTCSSRRRSQLVYAVRRNTASGAIRHSGCATVGKGDRCGPLRYYASWRKGDVLQGD

SEQ ID NO: 109198 - protein, 82 aa, Glycine max
  Coding DNA Sequence Number=SeqID_17513
MAAKWRRKRERRRHFKEKMSLEDAHHHRRPWIRAWRKKEMNEGRGREEHGIIEFQIWFNPLIQDQVQDSPLSVLRCHEACKA

SEQ ID NO: 109199 - protein, 66 aa, Glycine max
  Coding DNA Sequence Number=SeqID_17514
MEVDNTDDHPTGPPLELVACNNAAPAGSVDNTVENDFQDHQLMADLLSDNGELKTEQISMQESVFH

SEQ ID NO: 109200 - protein, 71 aa, Glycine max
  Coding DNA Sequence Number=SeqID_17515
  Homolog annotation: Hit_ID=UPI0000ECBAF8; Match level="QueryCoverage =57%, HitCoverage=48%, E-value=1e-16, Identity=100%"; Hit description= UPI0000ECBAF8 related cluster
MGKKPPPGECNKENDSDCCMQAWHWPSFYNVVTGKTLALPNLIALQHIPLSPAGVIAKRPAPIALPNSCAA

SEQ ID NO: 109201 - protein, 57 aa, Glycine max
  Coding DNA Sequence Number=SeqID_17516
MLSYRVCKVGLAGKEPVKPKGRSAQQMPQGIVLGSGMLGLARGYHQNNWLSYLGLAI

SEQ ID NO: 109202 - protein, 186 aa, Glycine max
  Coding DNA Sequence Number=SeqID_17517
MGDQEETQEQMKADMSALKEQMASMMEAMLSMKQLIEKNAATAAAVSSAAEADPALLATTHHPPSNIVGRGRDTLGHDGSPYLGYNRATYPYGLPPNYSPPVLQEDAGHTASPVHEREPPQQPDEVHKDPQDYARRDVEFYPPIPEGPAPGTLPQPNIAASPIVCPRKGRPQQLKKGGSSISLRKD

SEQ ID NO: 109203 - protein, 128 aa, Glycine max
  Coding DNA Sequence Number=SeqID_17518
  Gene Ontology: Mol. function=protein serine/threonine kinase activity; Cellular component=cell surface; Biological process =recognition or rejection of self pollen
  Homolog annotation: Hit_ID=Q70I30; Match level="QueryCoverage=91%, HitCoverage=17%, E-value=7e-43, Identity=73%"; Hit description=S -receptor kinase-like protein 1
  Pfam annotation: Domain name=B_lectin; Domain location=64-128; Score=- 0.1; E_value=0.0025; Accession=PF01453.15; Description=D-mannose binding lectin
MVRCFFFCLISMLSVEGTITITPKKSIQGTKSLVSAAGTFEAGFFNFGNSQGQYFGIWYKNISPRTIVWVANRDAPVKNSTAFLTLTHQGNPVILDGSKGIVWFSNSSRIAEKPIMQLLDSGNLVVKD

SEQ ID NO: 109204 - protein, 139 aa, Glycine max
  Coding DNA Sequence Number=SeqID_17519
MERGHGMYYTPATFSEYPSQMYQYPFAGHHTDTFETSHSFGGVAETQPHFSWPTMTPSQQHDAPMATPNAPFAPQWNVPGAIPDMGELLGVDLRQEFSAEAEEAEAGRQRGGRRNPDRQARRWDRPCGTSSRHHGHHND

SEQ ID NO: 109205 - protein, 66 aa, Glycine max
  Coding DNA Sequence Number=SeqID_17520
MEKSEKKNHSEKKLKKAYITWDENDLESSDDSENEEINLCLMAKSYESDEEKRTWYINLLLQEKLQ

SEQ ID NO: 109206 - protein, 36 aa, Glycine max
  Coding DNA Sequence Number=SeqID_17521
MAGTPLCAAKASPRASSIPKSSNLRILLKSSPKHVP

SEQ ID NO: 109207 - protein, 139 aa, Glycine max
  Coding DNA Sequence Number=SeqID_17522
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTFEGGTELEFVIMVIAVSFGKPVVPAALMNRPTRGERRFAYWALFRFLAH

SEQ ID NO: 109208 - protein, 215 aa, Glycine max
  Coding DNA Sequence Number=SeqID_17523
MDRMYAYNGYVISTSTDARQALRDLSQTERYAWGVAALVHMYDHLNDASINSSRQLGGYITLLQVDCHEEDREEHTYTGVQGAPGPTLDSGCLLDPIWGAPTGPGHPYDFMLFRSPMLGARCVYYRPERVMRQFGYTQTIPAPPVDSWVSYDDIHDRWMHYSDHKVPAGEASIRSSARWSCSAALSRPSGPRDRYPSRAGARSTIDICEARYGGA

SEQ ID NO: 109209 - protein, 109 aa, Glycine max
  Coding DNA Sequence Number=SeqID_17524
MDIIGGDYSSQCLMNRIVAMKDGFKKRHHKVSNLDDLVSCLDKMTLLAEEEDRIIEAREEAPPLVPQFERQQFDMSGRSVETQGLRRHRESVDAEAHVIPMMPERQHGI

SEQ ID NO: 109210 - protein, 73 aa, Glycine max
  Coding DNA Sequence Number=SeqID_17525
MLWKLGRIDGDPVLRETRIWATWEYVSSDGGGQQGDGVVPGDMSRGSGDLAVTSGGVLLSNNPSLTNPDPVRA

SEQ ID NO: 109211 - protein, 48 aa, Glycine max
  Coding DNA Sequence Number=SeqID_17526
MGTELEFVIMVIAVSCGLRIGRSSASSLTDFAALGRSAAASGISSLKG

SEQ ID NO: 109212 - protein, 98 aa, Glycine max
  Coding DNA Sequence Number=SeqID_17527
MLGFTSDSPQILASPHQLDFAPYASGPYNAQWNAPGLLHDKHTLHSSRILGGMEVEESWLFFCKIHFLVGVSICAKGGVRHWKCGRNDIFGLGGSLAM

SEQ ID NO: 109213 - protein, 78 aa, Glycine max
  Coding DNA Sequence Number=SeqID_17528
MRDGKKTSYVIGIEVNSGVGLGGKFLIALESAPKWALLAGRVGVGAGAWGASLWMGAGALGCTGAELEESSARAEKLG

SEQ ID NO: 109214 - protein, 91 aa, Glycine max
  Coding DNA Sequence Number=SeqID_17529
  Homolog annotation: Hit_ID=A7PD81; Match level="QueryCoverage=80%, HitCoverage=29%, E-value=1e-13, Identity=56%"; Hit description =Chromosome chr17 scaffold_12, whole genome shotgun sequence
MEEEKVVPNYDELTCKGETTAWFKQGLGFSSSAPKDDVPKPSSSFLSKFVKASFESTKQAQLQSIHDNLKKKPSFESRVSSRDRDSDRSRR

SEQ ID NO: 109215 - protein, 72 aa, Glycine max
  Coding DNA Sequence Number=SeqID_17530
MWTLQLTQEMLDHPEPLSLLQPQDSLKAAWPPLQWKVETLNPAIGEKGVVQPWYDFLEDMNFDDGDEISIYY

SEQ ID NO: 109216 - protein, 81 aa, Glycine max
  Coding DNA Sequence Number=SeqID_17531
MMKALTSSCSKARVETLGPFSPRVPLCVSDRPEFCFTLRSKNEKKGWNLLLLKLVRNNDLYPVHAVPPKDQEDMSQMKDKT

SEQ ID NO: 109217 - protein, 54 aa, Glycine max
  Coding DNA Sequence Number=SeqID_17532
MAEINQGTWERMQMGMGSRPTNRCPFPALNEQRTSLQGSPVSFMFAVSFTICQY

SEQ ID NO: 109218 - protein, 27 aa, Glycine max
  Coding DNA Sequence Number=SeqID_17533
MEPHRGAHQRMEFLLIVMLPRIRIQGM

SEQ ID NO: 109219 - protein, 249 aa, Glycine max
  Coding DNA Sequence Number=SeqID_17534
  Homolog annotation: Hit_ID=Q2HVA2; Match level="QueryCoverage=63%, HitCoverage=46%, E-value=5e-08, Identity=24%"; Hit description =Putative uncharacterized protein
MGNFDQDRWRWNFKWRRNLFDYESDQAVNFMEEINSIHIQRYVKDVMLWKADPKEVGHLFFNCKKIVGLWWESMSWIQAMGPLLASPVDHFLQFCDGFGAEKNHSTCCGWWVALTSTIWKHRNFLIFQDKPFEPQKVMEDAMFSIWSWLKARQKGYNISFNHWSSNISKSFERRIKVELCYKPRTTDEQKGSAIWKVQLLPRFSGCNCQENLWHILALLEFYTFVIVMLIPYNYSTISDEPYDSATSTS

SEQ ID NO: 109220 - protein, 131 aa, Glycine max
  Coding DNA Sequence Number=SeqID_17535
MTLTDITSVIQSSITDANVSSTINSIWYHCLIHEINGHVEYTTCPIIDEEDVWCMFNTFANMRSVISHGPEIYPKAHENPRVFSCIFDPIFLESSIQCPSGVGLYHSLPLEKDLTSNPEVLETMGFFPQHL

SEQ ID NO: 109221 - protein, 74 aa, Glycine max
  Coding DNA Sequence Number=SeqID_17536
MAQLISDVIYCLHGSRPQDAQWTRRSPTRPWGFQLWLRASISPTGCPSPPARDRARKTPSGQKGVPYGARFPPA

SEQ ID NO: 109222 - protein, 75 aa, Glycine max
  Coding DNA Sequence Number=SeqID_17537
EPVQVIEVASSEEDPEEDLEELPPEPAVDALDFLEGDEDSLPEVDAPEEVTSASEADSTEDSGPGEMAISGGSSS

SEQ ID NO: 109223 - protein, 157 aa, Glycine max
  Coding DNA Sequence Number=SeqID_17538
GFPGGAERPICVDQAMRIHVACSVWTGEVVLNLSLSLWEEGSTVIRIDEASARRLDRSGFGCYWSRYVGASGGGTGTSTSDHAILVSCTGGPVAVYYRPERVVRQFGYTQTISAPPIDSWVSYDDIHDRFGCTYEDHIVPAGEVCIVPGACPVTTST

SEQ ID NO: 109224 - protein, 263 aa, Glycine max
  Coding DNA Sequence Number=SeqID_17539
  Homolog annotation: Hit_ID=Q6WAY6; Match level="QueryCoverage=73%, HitCoverage=33%, E-value=1e-22, Identity=35%"; Hit description =Putative uncharacterized protein
MSPASRNWDGKILDLTVAEVFTGAVVSLAQYYDQPLRCFTFGDFQMVPTIEEFEEILGCPLRGRKPYHFSRFLPSLSKIAAVVGDSAKELDRMKQTRSGVVGLPRKYLEGKARDIASQEKWGPFADILALLIFGVVLFPNVDGLVDLAAIDAFLAYHHSKESPVVAILADLFDTFDRRCEKNSARIVCCLPALCVWLVSHLFQQDTIHPCPLQSYRSCAEKGGVDWDQHLAGIGGSAINWFPRWKERQGKEFFYRVGTTLMFH

SEQ ID NO: 109225 - protein, 190 aa, Glycine max
  Coding DNA Sequence Number=SeqID_17540
  Homolog annotation: Hit_ID=A0GQM3; Match level="QueryCoverage=65%, HitCoverage=31%, E-value=5e-16, Identity=41%"; Hit description =Putative uncharacterized protein
MRSDKVQLALNAPDLLAQVFADARVQRRQRFIEQQQPRASDQRSRQRHALTLAARQLMRIALRQIAQLHQRQHLLHPLADLPGRQLLHFQPEGHVAFHRHIGKQRIALEHHADAALLRRQRHQILTLQQDLPAVDRGQAGQTAQQRRFAAAARPQQGDELPLFGGEIDILKHLGLAIVFVQAGDVEISHR

SEQ ID NO: 109226 - protein, 72 aa, Glycine max
  Coding DNA Sequence Number=SeqID_17541
MGLCEFYGVPVAPSKVIRPPTNRAFIKKYCVPRQAQAKTPQQPGDARQQATDAPPSPLEFTSAHPQKGRKIP

SEQ ID NO: 109227 - protein, 80 aa, Glycine max
  Coding DNA Sequence Number=SeqID_17542
  Homolog annotation: Hit_ID=Q59296; Match level="QueryCoverage=32%, HitCoverage=5%, E-value=3e-08, Identity=96%"; Hit description =Catalase
  Subcellular localization annotation: CTP_CleavageSite=46; ConfidenceScore=5.10e-01
MTDSSECRPWGSPGLSAPLSLCRSHVVGAFSQNIVTLTSLPMILPRFSGYRARIRNHGHSCFLCEIVIRSQFHTTYEPEA

SEQ ID NO: 109228 - protein, 172 aa, Glycine max
  Coding DNA Sequence Number=SeqID_17543
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
  Subcellular localization annotation: CTP_CleavageSite=66; ConfidenceScore=5.12e-01
LSGFATSDLSVDFCDARQGGGAYGKTPATRPFYADTARRSRTTERSESVSEEAEERPIRKPPLPARVAEGVAAHPDADFVESLEIIIIIGEDAGAASSSEEDGSATRDGGSVGTGSTCAGMQAWHWPSFYNVVTGKTLALPNLIALQHIPLSPAGVIAKRPAPIALPNSCAA

SEQ ID NO: 109229 - protein, 122 aa, Glycine max
  Coding DNA Sequence Number=SeqID_17544
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPRDILKASGGTTYIRTKIVVNVVKLK

SEQ ID NO: 109230 - protein, 32 aa, Glycine max
  Coding DNA Sequence Number=SeqID_17545
MEVGSWKWKLEVGNESYWKLKVENAVYLFLLD

SEQ ID NO: 109231 - protein, 114 aa, Glycine max
  Coding DNA Sequence Number=SeqID_17546
MTVVMNIFLVIAQQLSLVLSRTLESDQFPLLNDPNKACIYVIKSGNLLYNKEKNKMKDCKNTSGEDVSFTSRISQSLTNSSQALRTASASNSHLGRSSHSKISQNSLELGPFSL

SEQ ID NO: 109232 - protein, 81 aa, Glycine max
  Coding DNA Sequence Number=SeqID_17547
DRARKTPSGPEEVQQGLEFYGVPVAPSKIIRPPTNRAFIKKYCVPRQAQGETPQQPGDGRQRATDTPPSPLEFTSAHPQKG

SEQ ID NO: 109233 - protein, 198 aa, Glycine max
  Coding DNA Sequence Number=SeqID_17548
  Homolog annotation: Hit_ID=UPI00016621D1; Match level="QueryCoverage =70%, HitCoverage=38%, E-value=6e-12, Identity=33%"; Hit description =UPI00016621D1 related cluster
MADPLNESISCCLLRVGPGGLHALAFRGLHALTFRGLHFLTFRGLHALAFRGLHVLTFRGLHALTFRGLHVLAIRGLHVLAFIGLHVLPFRGLHVLAIRGLRTLAFRELHVLVFRGLQVLAFRGLHVLAFRGLHILTYRGLHILAFRGLHALAFRGLHALIFRGLLASPSEGYMPSPLEGCMPSPLEDYMSSPSEGLH

SEQ ID NO: 109234 - protein, 152 aa, Glycine max
  Coding DNA Sequence Number=SeqID_17549
  Homolog annotation: Hit_ID=Q6WAY6; Match level="QueryCoverage=38%, HitCoverage=10%, E-value=1e-07, Identity=47%"; Hit description =Putative uncharacterized protein
MARVARVVKISAQELDRVKQNRNGVVGIPKQRLEERAEALVDQGEWTSSKCRRASGFSSDRCFSCLSPQQGKPGMVGALVSWFPRWKEGGAGVLCSCEGLSNVPSMETRGCINYNPILAIRQLGYPMREAPSEEIITPFVARGFSEGNAKML

SEQ ID NO: 109235 - protein, 55 aa, Glycine max
  Coding DNA Sequence Number=SeqID_17550
MRIEDLRACYNIHLMGMCDSIYAHMDLTHIFKHPLHLIIVGQSLLPHTIFLQKYG

SEQ ID NO: 109236 - protein, 75 aa, Glycine max
  Coding DNA Sequence Number=SeqID_17551
MAPKKHSTKRSRRDAQGESSSVSVEFDSHWERRVQLMEDEYSHIQEEIAHRHWTPLVTPMAKFDPEIVLEFYANA

SEQ ID NO: 109237 - protein, 68 aa, Glycine max
  Coding DNA Sequence Number=SeqID_17552
KVFYLVGPYSLLKRSPPPPSFEEAGCEATMESAFPDSDAVERRLVVKGTDDLGLDGFAPGEHHLSIVK

SEQ ID NO: 109238 - protein, 1120 aa, Glycine max
  Coding DNA Sequence Number=SeqID_17553
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=97%, HitCoverage=84%, E-value=0.0, Identity=51%"; Hit description =Multidrug resistance-associated protein 3
  Pfam annotation: Domain name=ABC_membrane; Domain location=115-384; Score=72.1; E_value=1.9e-18; Accession=PF00664.14; Description=ABC transporter transmembrane region
  Pfam annotation: Domain name=ABC_tran; Domain location=458-629; Score= 143.0; E_value=8.4e-40; Accession=PF00005.18; Description=ABC transporter
  Pfam annotation: Domain name=ABC_tran; Domain location=901-1084; Score=161.7; E_value=1.9e-45; Accession=PF00005.18; Description=ABC transporter
  Pfam module annotation: Pfam domain module=ABC_membrane::ABC _tran::ABC_tran; Domain location=115-384::458-629::901-1084
MEKLASLEEVLLNGGSSVNNSSDPSKTIGNENLTCYSNAGFFSILTFSWISPLLSLGNEKTLDHEDLPLLAADDSAYGAFTTFRNNLESECGSDLRRVTTLKLVKVLIFSTWKGIVLSGLLEFLCTCASFVGPYLIESLVQYFNQEHKFKNEGYMLAIAFVAAKLVECLPDRHGRFNLEQVGVRMQSMLVAMIYAKGLTLSCQSKEGYSSGEIINLMTVDAERVDELCWHMHAPWICVLKVALAMLILYKSVGVASIAAFAATVIVMLLNLPVASLQEKFQGKIMEFKDKRMKVTSEILKNMKILKLQAWEMKFLSKIFHLRKTEETLLKKFLVSSATMTCLLFNAPTFIAVVTFSACFLIGIPLESGKILSALATFEILQMPIYSLPDTISMIAQTKVSFDRITSFLSLDDLQTDVVEKLPRGSSDIAIELVNGNFSWNLSSLNTTLKNINLTVFHGMRVAVCGTVASGKSSLLSCIIGEIPKISGTLKVCGSKAYVSQSPWVESGKIEENILFGKEMDREKYEKVLEACSLTKDLEVLPFGDQTIIGEKGINLSGGQKQRVQIARALYQDADIYLFDDPFSSVDAHTGSHLFRECLLGLLKTKTVIYITHQVEFLPDADLILVMREGRITQSGKYNDILRSDTDFMELVGAHREALSSVMSSERIPTLETVNISTKDSDSLRYFELEQEEKNIDDHHDKSDDTVKPKGQLIQEEEREKGRVRFKVYWKYITTAYGGAFVPFILLSQTLTTVFQIGSNYWMTLETPISATAETGIESFTLMVVYVALAIGSSFFNLVISVLREIAGYKTATILFNKMHFCFFRAPMSFFDATPSGRILNRASTDQNTIDISISYLVWVFTFILIHLLGTIAVMSQAAWQVRYAPHLPLILRGLTCTFAAGAKTGIVGRTGSGKSTLVLTLFRLLEPVAGQILIDSVDISLIGIHDLRSRLSIIPQDPTMFEGTVRSNLDPLEEYTDEQIWEALDMCQLGDEVRKKEGKLDSSVTENGENWSMGQRQLVCLGRVLLKKSKILVLDEATASVDTATDNIIQQTVKQHFSECTVITIAHRITSILDSDMVLFLNQGLIEEYDSPKKLLKNNSSSLAQLVAEYTRRSNCGFGT

SEQ ID NO: 109239 - protein, 475 aa, Glycine max
  Coding DNA Sequence Number=SeqID_17554
  Gene Ontology: Mol. function=sequence-specific DNA binding; Cellular component=nucleus; Biological process=regulation of transcription, DNA-dependent
  Homolog annotation: Hit_ID=B0LUS4; Match level="QueryCoverage=74%, HitCoverage=90%, E-value=0.0, Identity=82%"; Hit description =Transcription factor
  Pfam annotation: Domain name=WRKY; Domain location=266-324; Score =148.9; E_value=1.4e-41; Accession=PF03106.6; Description=WRKY DNA -binding domain
  Subcellular localization annotation: CTP_CleavageSite=10; ConfidenceScore=5.41e-01
MTNTTPSGLCAQSVEDNTKRNSSFSCHPSSFFFFFHHFPPMYTPNADSGTAPHPRPTITLPPRPSAEAFFSAAGGASPGPMTLVSSFFGSDAAADCRSFSQLLAGAMASPMAFSAAAASAADNSGKDDDGPHKGFKQSRPMNLVIARSPVFTVPPGLSPSGFLNSPGFFSPQSPFGMSHQQALAQVTAQAVLAQSHMHMQADYQMPSVTAPTEPPVQQLSFALNEASEQQVVSCVSEPRNAQLEAPELSQADKKYQPSSQAIDKPADDGYNWRKYGQKQVKGSEYPRSYYKCTHLNCVVKKKVERAPDGHITEIIYKGQHNHEKPQANRRAKDNSDSNGNVTVQPKSESNSQGWVGQLNKLSENIPNSSVPESDQTSNQGAPRQLLPGSNESEEVGIVDNREEADDGEPNPKRRQAKFLLFRNTDVGVSEVPLSQKTVTEPKIIVQTRSEVDLLDDGYRWRKYGQKVVKGNPHPR

SEQ ID NO: 109240 - protein, 148 aa, Glycine max
  Coding DNA Sequence Number=SeqID_17555
  Gene Ontology: Cellular component=integral to membrane; Biological process=transport
  Homolog annotation: Hit_ID=A7PMZ6; Match level="QueryCoverage=94%, HitCoverage=62%, E-value=3e-40, Identity=57%"; Hit description =Chromosome chr14 scaffold_21, whole genome shotgun sequence
  Pfam annotation: Domain name=EMP24_GP25L; Domain location=45-107; Score=44.8; E_value=3e-10; Accession=PF01105.15; Description =emp24gp25Lp24 family
MASIVNSMQFELKSGQSKCISEDLKSNVITVGNYYVLNPNNDGFPIPDSHKITVRVRSPYGNDFHYGDSVHSGNFAFTAAEAGDYTACFSVPSNLNLAVTVLVDFVWKNGFAAKDWSKVVKKGHIEECIYKELLHLGLKKRRGVTMNY

SEQ ID NO: 109241 - protein, 268 aa, Glycine max
  Coding DNA Sequence Number=SeqID_17556
  Homolog annotation: Hit_ID=A5B5G7; Match level="QueryCoverage=72%, HitCoverage=13%, E-value=2e-11, Identity=28%"; Hit description =Putative uncharacterized protein
MAHTLSAPHPLIQQRIRSTRLAGSAAPSALIYWEARAKRALMTSRKRRAVPTPGEASNWDTSRFTSEIAWHRYHDNIQLRNILPERNVELGPGMFDEFLQELRRRRWDQVPTHLPEKRIDVALVKEFYSNLYDPEDHSPRFCRVRGQVVRFDADTINDFLDTPVILEDGEEYPAYTRYLSTHPDPDTIAATLCTPGGRFVLNADGLPWKLLRKDMTTLAQTWSVLSYYDLAPTSHTSDVNLDRARLIYGLLYITADQPDCPVQHLEAR

SEQ ID NO: 109242 - protein, 140 aa, Glycine max
  Coding DNA Sequence Number=SeqID_17557
  Homolog annotation: Hit_ID=A7Q7B5; Match level="QueryCoverage=57%, HitCoverage=83%, E-value=6e-16, Identity=54%"; Hit description =Chromosome chr18 scaffold_59, whole genome shotgun sequence
GSLLSLEEAVGAMTLEEGKVKIEKFDDKDFSFLKMQIENYLYQKKLYQPLSGVKPYDMKQEEWNFLDQQTIGVIRLTLAKNVTYTARISPTIGIRADGSTCGDASIASGKNGYTNGCVRSPYVLARGPQVYSSDKIGSTD

SEQ ID NO: 109243 - protein, 451 aa, Glycine max
  Coding DNA Sequence Number=SeqID_17558
  Gene Ontology: Mol. function=damaged DNA binding; Cellular component =nucleus; Biological process=proteasomal ubiquitin-dependent protein catabolic process
  Homolog annotation: Hit_ID=Q38JH6; Match level="QueryCoverage=86%, HitCoverage=90%, E-value=6e-87, Identity=47%"; Hit description=RAD23- like
  Pfam annotation: Domain name=UBA; Domain location=148-187; Score =37.2; E_value=5.7e-08; Accession=PF00627.22; Description=UBATS-N domain
  Pfam annotation: Domain name=XPC-binding; Domain location=303-361; Score=75.0; E_value=2.5e-19; Accession=PF09280.2; Description=XPC -binding domain
  Pfam annotation: Domain name=ubiquitin; Domain location=6-78; Score =78.1; E_value=3e-20; Accession=PF00240.14; Description=Ubiquitin family
  Pfam module annotation: Pfam domain module=UBA::XPC-binding::ubiquitin ; Domain location=148-187::303-361::6-78
MKINVKTLKGTHFVLQVNPQDTVAVVKKNIETAQGADVYPAAQQMLIHQGKVLNDATTLEENKVVENNFVVIMLSKNKVSSGASSAPSNLGTQPQSSLPPTSSTSQPPASAVGQGESNSEQSPVITPPTIAVPSIYDHAASNLMAGSNLETTIQQILEMGGGNWDRDTVTGALHAAFNNPERAIEYLYSLLIGTLLSVGLETPVAAHVIFKLTGLMLQRIKPSKLVLLVNYAILCQYSFKLMGIPERADVPAAVRSLITGQAENSSIQSTQPAVPTGGPNTNPLNLFPQGLPNMSAIDNRGDLDSLRNREEFQALRETMRENPQILQPMIQELGQQNPQLMQIIQDHQEDILDLMNEPEGDENLQSQLDSMISGTVTITPEENEAIQRTKVKKKFMSSIKYVRPSVRLSLAGSIPIHIHDRGYIEIDFFKHFFFSSQGLATNVYTFDMSCF

SEQ ID NO: 109244 - protein, 451 aa, Glycine max
  Coding DNA Sequence Number=SeqID_17559
  Gene Ontology: Mol. function=structural molecule activity; Cellular component=mitochondrion; Biological process=translation
  Homolog annotation: Hit_ID=A6YGF0; Match level="QueryCoverage=73%, HitCoverage=80%, E-value=6e-52, Identity=38%"; Hit description =Putative uncharacterized protein
  Pfam annotation: Domain name=DUF292; Domain location=18-139; Score =135.0; E_value=2.1e-37; Accession=PF03398.5; Description=Eukaryotic protein of unknown function, DUF292
MGLLGKSFTSKFKSITLLAVSRIVILKNQHKARASYARSDVAQLLNLGYHDRALLRVEQWIIEQNMLEVFAMIESYCNFLRERAEALERNKECLVELKEATSSLVFASSRCGEFPELHKIREMFTTKFGKEFADHAVELHKNNRVNSKVLIGYYKHLMIQKLSPRRPNMEIKMKALKQIASEIGVNLRLEQDPILINEDKLSVDRKQDEPETRKSRVDGPSHKENIQNNPANTIQDENLSDKNEERKRYMDTDASVAEKAIESKPSGIEVSKQSDHRVALGKMHAHPIASSSSKQEGEVAPKNNHAIELKGLERREIKKQFAWEESHLSQNPRDDVITSRIAEFISKEHVEEENREGRMVGELGSAKSFQMDNNDHNSLSESDAATENEHFSEERVHPSSHATRWNSQRSQSDSTLNPMARRHVMETRDPTHFQKQIHTRVDWKVMSARTR

SEQ ID NO: 109245 - protein, 603 aa, Glycine max
  Coding DNA Sequence Number=SeqID_17560
  Gene Ontology: Mol. function=binding; Biological process=positive regulation of growth rate
  Homolog annotation: Hit_ID=A7PAN9; Match level="QueryCoverage=99%, HitCoverage=24%, E-value=0.0, Identity=72%"; Hit description =Chromosome chr14 scaffold_9, whole genome shotgun sequence
MGSNLQFELDSLHGQATVLAALVSISPKLPLGYPARLPGLVFGVSKKMLTEHSRNPVAATVEKEAGWLLLSSLFASLPKEELEEDVFDILALWASLFTGNPENEITKTDDLKSRIFVWSAAVHALTAFIKCFISPNVANDGVLLQPVLVYLSSALSYISALRAKGLPHVKPAVDVFVIKTLIAYQSLPDPVSFKNDHPQIIQLCTFPFRHASECEESSCLRLLLDKRDAWLGPWIPGRDWFEDELRAFQGGKDGLMPCVWENEISSFPQPETISKTLVNQMLLFFGIIFASQDSGGMLSLLGIIEQCLKAGKKQHWHKASLTNICVGLLAGFKALLSFRPQTLGQEILGLAQSIFLGILAEGDICASQRRASSESLGYLARFGNDIFTARMACSFNLTRSLLGDLNGATDPNYAGSIALALGCIHRSAGGIALSTLVPATVSSISSLAKSSVANLQIWSMHGLLLTIEAAGLSFVSHVQATLSLAMDILLSDENGLVDIQQGVGRLINAIVTVLGPELAPGSIFFSRSKSAIAEISSWQETSTMLESARFTQQLVLFAPQAVSVHSHVQTLLSTLSSRQPTLRHLAVSTLRHLIEKDPVGSPS

SEQ ID NO: 109246 - protein, 411 aa, Glycine max
  Coding DNA Sequence Number=SeqID_17561
  Gene Ontology: Mol. function=heparan-alpha-glucosaminide N -acetyltransferase activity; Cellular component=integral to membrane; Biological process=glycosaminoglycan metabolic process
  Homolog annotation: Hit_ID=A7QTC2; Match level="QueryCoverage=92%, HitCoverage=83%, E-value=1e-148, Identity=67%"; Hit description =Chromosome chr1 scaffold_166, whole genome shotgun sequence
MKLMILVDDAGGLIPALNHSPWNGLTLADYVMPFFLFIVGVSLALSYKKLSCGVDASRKASLRALKLLALGLFLQGGGYFHRVNDLTFGVDIKQIRWMGILQRIAVAYLVVALCEIWLKSDDTVNSGPSLLRKYRYQWAVALILSFLYLCLLYGLYVPDWVYQIQTEPSAEPKTFSVKCGVRGNTGPACNVVGMIDRMILGIQHLYKRPIYARMPECSINSPNYGPLPPDAPAWCQAPFDPEGLLSSVMAIVTCLIGLHYGHIIVHFKDHRVRIIYWMIPTSCLLVFGLALDLFDIDMVLLVGMHINKVLYSLSYTCVTAGAAGVLFVGIYLMVDVCGCRRMTLVMEWMGMHALMIYILAACNVFPIFLQGFYWGSPHNNIVISLSLSYFDIIIFYYDFERLYSPHADNVI

SEQ ID NO: 109247 - protein, 625 aa, Glycine max
  Coding DNA Sequence Number=SeqID_17562
  Gene Ontology: Mol. function=protein domain specific binding; Cellular component=cytoplasm; Biological process=response to stress
  Homolog annotation: Hit_ID=Q1KUS3; Match level="QueryCoverage=42%, HitCoverage=98%, E-value=1e-121, Identity=84%"; Hit description =Putative uncharacterized protein
  Pfam annotation: Domain name=14-3-3; Domain location=6-243; Score =509.1; E_value=5.3e-150; Accession=PF00244.11; Description=14-3-3 protein
  Pfam annotation: Domain name=HGTP_anticodon; Domain location=519-599; Score=34.6; E_value=3.7e-07; Accession=PF03129.11; Description =Anticodon binding domain
  Pfam module annotation: Pfam domain module=14-3-3::HGTP_anticodon; Domain location=6-243::519-599
MSDSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETSKQQPELGARIKEPPSVPGFMKPQTAQGILVNFKDLYYYNANKLPFAAAQIGQAGTRRTAPVRGAAVTTVEVLADTEDLEFTLAESEHFVDPQDKSHPKEEQMSGQSAKRIPLRDAVSKNVSCLCIDKYRLRFRQHLANEMVTMLLTVGMQRLSAPLDKSGVLQVAREKFSEPKEVEGNPRMVVEAHEVEFQVCTLGKVVTIKKNMVTIQKKKNIEHERVFTRSVIESSFGIGRIIYCLFEHTFYTRQSKAGDQQLNVFRFSSLVAPIKCTVFPLVQNQKYEEVAKLTSKSLTAAGISHKIDTSTITDELDVPFAITVDSTSSVTIRERDSKGQVRVDVDKAASVVREVTEGQRTWEDVWSTSPHHSSTSASADD

SEQ ID NO: 109248 - protein, 45 aa, Glycine max
  Coding DNA Sequence Number=SeqID_17563
MQLEWNLVFQHTFREANQIADYLAGKLMARLKIFSLAVEVHGRYW

SEQ ID NO: 109249 - protein, 158 aa, Glycine max
  Coding DNA Sequence Number=SeqID_17564
MDLPWISTGVDPAVYPRPKAILLSSDSMKYMASFFLRSEFPGVPCWEPSAGDLISELSITLNTQPLATGFPQSLSSVQINNSQNMEREGSTTTLKQAMYNKWQYNTTQHHWKPLKRVHLWSPAVEAGTIAVIDWCLHHENVDAHNFPSELEGGDWTVA

SEQ ID NO: 109250 - protein, 209 aa, Glycine max
  Coding DNA Sequence Number=SeqID_17565
  Subcellular localization annotation: CTP_CleavageSite=66; ConfidenceScore=5.44e-01
MKVAVYEKSLPGGLGGSRMRRTRIPSTIAATRARGARRPRTCAPPSPSPPALRPCTSTATPPFLSTASRRTAGLSPAPPHAPGAARGSTSARACFSDPEPARTAPDLIRTRSESRGPCWVGSGWEPETTQPKPPTATGGRHCRSCALDEITYRRREEKVLCMVGDIGEKPLAWGRRVGIGAYGYATLREGWWGCYSLLNPAVCSLPFSV

SEQ ID NO: 109251 - protein, 480 aa, Glycine max
  Coding DNA Sequence Number=SeqID_17566
  Gene Ontology: Mol. function=nucleic acid binding
  Homolog annotation: Hit_ID=A7PN40; Match level="QueryCoverage=85%, HitCoverage=85%, E-value=3e-96, Identity=50%"; Hit description =Chromosome chr14 scaffold_21, whole genome shotgun sequence
  Pfam annotation: Domain name=TPX2; Domain location=375-431; Score =81.1; E_value=3.7e-21; Accession=PF06886.2; Description=Targeting protein for Xklp2 (TPX2)
  Subcellular localization annotation: CTP_CleavageSite=76; ConfidenceScore=5.35e-01
MAAVASSPTPLGSRSKAQQEPSKNIENFDPNKQQQSPVSKPSCSSPSSSPLVKSKNPNKVDYFSPKNKIRQRKFLVAKKKKEKKAEEEGSGAAADSCKCKASGANANENNKCVCVAYNNLRKSQEEFFKNNDDGVVDDGEEEGFESVVVEEEKGESLLGNGEVSGLVVKRRRERLMEEARKSVLPQSGSGKVMHLVKAFEKLLSIPKTKEEEDEEGSQDQERVGKWALPGLQQQQVSEISFCPPNCVLTSQNLGLDPGASVSSSWDSSRASVSSRTSTGGRRSRKNSLESSSTFGRRRLKKKQQKVTSQKPFKLRTEQRGKLKEEEFVKKIQEMAAVEEKQRIPVAQGLPWTTDEPECLVKPPVKEITRPVDLKLHSDVRALDRAEFDHQVQEKLSLIEQYKLERERQQKLAEEEELRRLRKELVPKAQPMPYFDRPFIPRRSMKSPTIPREPKFYNHKKIKCSLSSWNDISPYSSSCLN

SEQ ID NO: 109252 - protein, 374 aa, Glycine max
  Coding DNA Sequence Number=SeqID_17567
  Gene Ontology: Mol. function=transferase activity, transferring glycosyl groups; Cellular component=cytoplasm; Biological process =metabolic process
  Homolog annotation: Hit_ID=A7PA89; Match level="QueryCoverage=99%, HitCoverage=99%, E-value=4e-72, Identity=47%"; Hit description =Chromosome chr14 scaffold_9, whole genome shotgun sequence
MSYPHFLVMPYPILGHMNPLLQFSQVLANHGCKITFLITEFNQKRMKSEIDHLGAQIKFVTLPDGLDPEDDRSDQPKVILSLRNTMPTKLHRLIQDINNNNNALDGDNNKITCLVVSKNIGWALEVAHKLGIKGALLWPASATSLASFESIPRLIDEGIIDSETGLPTRKQEIQLLPNSPMMDTANLPWCSLGKNFFLHMVEDTQSLKLGEWWLCNTTCDLEPGALAMWPRFLSIGPLMQSDTNKSSFWREDTTCLHWLDQHPPQSVVYVSFGSLAIVEPNQFNELAIGLDLLNKPFLWVVRPSNENNKVGLGLDQDENGLIMKGEIRKKVEQLLGNEDIKARSVKLKELTVNNFDEGGQSSQNIEKFINWAKD

SEQ ID NO: 109253 - protein, 668 aa, Glycine max
  Coding DNA Sequence Number=SeqID_17568
  Gene Ontology: Mol. function=RNA binding; Cellular component=nucleus; Biological process=nuclear mRNA splicing, via spliceosome
  Homolog annotation: Hit_ID=A7PAA8; Match level="QueryCoverage=75%, HitCoverage=93%, E-value=1e-119, Identity=53%"; Hit description =Chromosome chr14 scaffold_9, whole genome shotgun sequence
  Pfam annotation: Domain name=Extensin_2; Domain location=298-604; Score=-129.3; E_value=0.031; Accession=PF04554.4; Description =Extensin-like region
MTEDSIVRVSSSNETSAANEASQTRQRKKRKWDQPAESLMPVGMTVPGALPLSNAVTLGGVAFPAMAPVISGTLLTNPLAASAQLPQHAAAAAVAAQKLNQHKIQDELIIAREIVINDAESSVRYKLTKRQTQEEIQRCTGAIVITRGKYRLPNAPHDGEKPLYLHISAGAHIKETAERILAVDRAAAMIEEILKQVQNSQSISSVTPSALVNGVKMLSTCVFLGFDADPSLNIVARIRGPNDQYINHIMNETGATVVLRGRGSGNNECLNGEDGQQPLHLFLSSNNAKSLEDAKLLAENLLDTICTECGASSAVPPPQQAYTAVPPPQQVYSAVPPPQQVYSGPSLLKQIPAAISPPQVYSAVPPPQQLLTGVQSSGIDLEAGASLITSSMSAAGVLTPVPPASLVGVTGVTGALTLGTTPQSIRHLSSGPQANMTGYTPPPLVSGGTSYIGYGGLYPQATPLQQVALALRHSPPVASTVAPTTSASNRGSKSTLSSDLEKEKRPPQRRKFQELPVGSKDTTKLNQVCGMVNVSKLTDLIAMNLPTGGMERLQPLKTNEQSDGPVVRNISTMPAPKKLVQPSSNGMPPPLLRTMPPPPPPPKFCGPSEVKVQAKNKTLLKTKSDAVPDTLVKLMEYGEEDDDDIDSSEESLPHDAGATGVQKPFWAL

SEQ ID NO: 109254 - protein, 359 aa, Glycine max
  Coding DNA Sequence Number=SeqID_17569
  Gene Ontology: Mol. function=protein dimerization activity; Biological process=alkaloid metabolic process
  Homolog annotation: Hit_ID=Q84KK5; Match level="QueryCoverage=99%, HitCoverage=99%, E-value=1e-147, Identity=72%"; Hit description=S -adenosyl-L-methionine: daidzein 7-0-methyltransferase
  Pfam annotation: Domain name=Dimerisation; Domain location=30-78; Score=66.3; E_value=1e-16; Accession=PF08100.2; Description =Dimerisation domain
  Pfam annotation: Domain name=Methyltransf_2; Domain location=92-336; Score=323.1; E_value=5.2e-94; Accession=PF00891.9; Description=O -methyltransferase
  Pfam module annotation: Pfam domain module=Dimerisation::Methyltransf_ 2; Domain location=30-78::92-336
MASNNGRKASEIFQGQLLLYRHMYAHVDSMFLKCIVELGIPNIIHNHGQPITLPKLVSILQVPPNKVSGLQSLMRYLAHNGFFEIVTIHDNLEEKEAYALTAASELLVKGSDLCLAPIVECFLDPTFSSSWHQMKKWICEDDLTLFGISLGSHLWDFLNKSPTHNKSFNEAMASDSQMMNLALRDCNWVFEGLETIVDVGGGTGITAKIICEAFPKLKCIVLERPHVVDQNLSGCNNLKYVVGDMFKSIPKADAVLLKWILHNWNDNDCRKILENCKEAIISSKCKRGKVIVIDVVINENQDEHEVTRLKLLMNVHMACLINGKERSEEEWKKLFVEAGFQGYKISPLTGHLSLIEIYP

SEQ ID NO: 109255 - protein, 312 aa, Glycine max
  Coding DNA Sequence Number=SeqID_17570
  Gene Ontology: Mol. function=acyltransferase activity; Cellular component=cytoplasm
  Homolog annotation: Hit_ID=A4F1S4; Match level="QueryCoverage=64%, HitCoverage=44%, E-value=2e-59, Identity=54%"; Hit description =Putative anthocyanin malonyltransferase
  Subcellular localization annotation: CTP_CleavageSite=13; ConfidenceScore=5.02e-01
MEHATRGTARRTRQQQGSAPDTGASGSALPLGATDSALPLGATGALPVAPTRWTLPVAPSSRALPDAPASGALPCCCLVRRAVPRVACSMEAPSWGALCNKKTDPPVFNVVPTSESEEFQLPTQTSLSLTFFDILWLRLPPVQRVFFYEFPHPTHLFFDTLLPKLKHSLSLALAHFFPLAGHLTWPLHSQKPIINYKSGDTVPLTVAVSEADFNHLAGTDLYEAKEIPHLLPHLTISHEKATLLALQATLFPNSGFSIGITSHHAVLDGKTSTSFIKSWAYLCRESQSPTSLPPELIPFYDREVIKDPNHLG

SEQ ID NO: 109256 - protein, 286 aa, Glycine max
  Coding DNA Sequence Number=SeqID_17571
  Gene Ontology: Mol. function=transferase activity; Cellular component= cytoplasm
  Homolog annotation: Hit_ID=A7BIC9; Match level="QueryCoverage=90%, HitCoverage=56%, E-value=1e-41, Identity=37%"; Hit description =Malonyl-CoA:isoflavone 7-O-glucoside-6''-O-malonyltransferase
  Pfam annotation: Domain name=Transferase; Domain location=2-280; Score=-168.1; E_value=0.0085; Accession=PF02458.6; Description =Transferase family
MKVVEVFSVAPTSESQEESQSQSLPFLPPELCPFYERKLVKDPNQVGAKFVNDWLKEGGTNNRSLMVCDLKPPEDATRGSFQLSRSDVEKLKQSVVFKKKGSTNLHLSTFVLSLACAWVCRVRAEEITNKSVALALTVDCRGRLEPPLPSTYFGNCVGFRLPIAETRDLLGEEGLVVAVEAVSDALETLKDGAVSGAENWSSWLLYGVGAEADVKTIGVAGSPRFEVYGSDFGWGRPKKVEMVSIEKTAVFGLSDSRNGDGIEIGFVSKKKTMETFASLFVNGLQS

SEQ ID NO: 109257 - protein, 140 aa, Glycine max
  Coding DNA Sequence Number=SeqID_17572
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=58%, HitCoverage=55%, E-value=1e-26, Identity=75%"; Hit description=LacZ -alpha
  Subcellular localization annotation: CTP_CleavageSite=42; ConfidenceScore=5.33e-01
MAFLFLEQFLTPFSKSFLLVFHFFLWHCLWFVGVARLSAAVKVKLGSSRRPAGVKLSALAVVLQRRDWENPGVTQLNRLAAHPPFASWRNSEEARTDRPSQQLRSLNGEWRLMRYFLLTHLCGISHRIWCTLSTICSDAA

SEQ ID NO: 109258 - protein, 50 aa, Glycine max
  Coding DNA Sequence Number=SeqID_17573
MAFVRRGRTDGFRIKLIRKLFTDQLDPCLSAERMFCGGLDPWLMKTDLWW

SEQ ID NO: 109259 - protein, 152 aa, Glycine max
  Coding DNA Sequence Number=SeqID_17574
  Gene Ontology: Mol. function=protein serine/threonine kinase activity; Cellular component=plasma membrane; Biological process =protein amino acid autophosphorylation
  Homolog annotation: Hit_ID=A5AVT6; Match level="QueryCoverage=73%, HitCoverage=21%, E-value=2e-26, Identity=56%"; Hit description =Putative uncharacterized protein
  Subcellular localization annotation: CTP_CleavageSite=80; ConfidenceScore=5.68e-01
MLFIVPLNSSASTVALTVACPLTRFSHSQLTYSFPVSTGPKFLRLFFYSTSYQNFHRSKAYFSVKAGPYTLLQDFNASLHADAGNDPGDYLFREYCTNLKDGDRLNITFIASKTSQNPDSYAFINGIEIVSMPPFTTPILTTSTSLDCLNSL

SEQ ID NO: 109260 - protein, 103 aa, Glycine max
  Coding DNA Sequence Number=SeqID_17575
MNDDVRVLEFVLQLQDSVVSGVVAESGGNNSEDSDDMFSISQTLAKVVNMFLIIVRALDILSMTSDGDRSLFSLRLTIQRGDEVGRLCSLKVQPEFVEKKCAL

SEQ ID NO: 109261 - protein, 184 aa, Glycine max
  Coding DNA Sequence Number=SeqID_17576
  Homolog annotation: Hit_ID=A7PAB4; Match level="QueryCoverage=55%, HitCoverage=14%, E-value=2e-09, Identity=34%"; Hit description =Chromosome chr14 scaffold_9, whole genome shotgun sequence
MLSLFTSPKANPSSRGMLVSLSRAHYIDVVKVAIRGEVVEDPVEELHKGETELGLLKKSQVLWQKKQIAAQCLKKYGEVALSCLHEDGTQRPPMNDVVRVLEFVLQLQDSVVSGVAVESGGNNYEDIRALDILSMTSDGDRSFVSKESDKLVPEELVFSEINDPKGRCEVGRLCSLKVQPEFVE

SEQ ID NO: 109262 - protein, 233 aa, Glycine max
  Coding DNA Sequence Number=SeqID_17577
MRSLLELTTQDATLAQNKLLSQQIEALTETLNKLPQQLQVVSPSYSSIVQVGGCHICGGTHESGSCMVQDDASNEVNYMDRHNHQGFHQGGPPGFYQRDDFLQDHYWISYPGNNFHQGDSPYQPPSQEPNHQEKPTKLEELLIQIMQKTESHMKSTDATIRNLEVQLAKLVSEKPTETFGVNTEMKSKEECKVIFTGRVEKDNKIEEDVHDEEGEKEEEKEKSEEKAQQWEKY

SEQ ID NO: 109263 - protein, 478 aa, Glycine max
  Coding DNA Sequence Number=SeqID_17578
  Gene Ontology: Mol. function=protein serine/threonine kinase activity; Cellular component=plasma membrane; Biological process =protein amino acid autophosphorylation
  Homolog annotation: Hit_ID=A5AVT6; Match level="QueryCoverage=86%, HitCoverage=82%, E-value=3e-96, Identity=44%"; Hit description =Putative uncharacterized protein
MDTTGTHIASGAIFFLLLLCLSNLSIADVIYSPVELFSINCGSNSSLSTRDGRNWTADIKFLSENKDSVAAPALTPSILEGPYTDARFSHSQFTYSFPVSTGPKFLRLFFYSTSYQNFHRSKAYFSVKAGPYTLLQYFNASLNADADDDPDNFLFREYCINLRDGERLNISFIPSTEDSYAFINGIEIVSMPPFLYYTNPDDDLPQLVGLNMNPFPIENNYAMETKYRLRVGDQEIPASQDTGMLRSWDVDNKYVTTQNVLSLDIDSGIKLRFTKTPNYTAPDTVYRSLRNMGSNGTVNMGFNLTWQLPVDSGFTYLLRLHFCQLDPNISHPGDQSFFIYVQDQLVEKWAGILGWSDKQKGVPVVKQYVVLIPGNEQETLNLSLKMHPNPQSLAKDAQINAIELFKINDPTGNLAGPNPDPLPQSPKRVPLESSNKKSHGTTMRTLAAIAGDHTLVFGVPNEIKSSSSSDKVVSELEF

SEQ ID NO: 109264 - protein, 227 aa, Glycine max
  Coding DNA Sequence Number=SeqID_17579
  Gene Ontology: Mol. function=unfolded protein binding; Cellular component=chloroplast; Biological process=cellular protein metabolic process
  Homolog annotation: Hit_ID=P08927; Match level="QueryCoverage=34%, HitCoverage=13%, E-value=2e-24, Identity=76%"; Hit description =RuBisCO large subunit-binding protein subunit beta, chloroplast precursor
MPEMVNYLCMRLSLGLPVNCNIERCHIGHFYYDSIIVTLKGIILVNNWSWKHTINCDNVEADIVKRALSYPLKLIAKNARVNDSVVSEKVLSSDNPGYGYNAATGKYEDLMSAGIIDPTKVRATVAELQNVVRVFSQLCAASNLHIHGFHQKNVGYCNSIIILASISAPPAHKGYSTFNIGAVVSTDVKTCISTSMVNIAHSIDVKNSTFNNGHALATLSLAHFLSR

SEQ ID NO: 109265 - protein, 177 aa, Glycine max
  Coding DNA Sequence Number=SeqID_17580
  Gene Ontology: Mol. function=protein-tyrosine kinase activity; Biological process=protein amino acid phosphorylation
  Homolog annotation: Hit_ID=Q69F91; Match level="QueryCoverage=96%, HitCoverage=85%, E-value=1e-16, Identity=59%"; Hit description =Serine-threonine kinase
GRKHTSSSQRKYPRVIEELCHPFSLADLRKMTNNFNQNRVVVDAFSEELYKGCLQHSDASEYTVTVSTVMEEKVRDLHRRSVDYTTLTLEPSAPSFAVTSVLQTLILLFCEMPVEENIHPRIKGKIAPECWEVFINITQRCMMYEPDERPTMGEVEHVPSFHQEDITEDSDLENVLP

SEQ ID NO: 109266 - protein, 324 aa, Glycine max
  Coding DNA Sequence Number=SeqID_17581
  Gene Ontology: Mol. function=acyltransferase activity; Cellular component=cytoplasm
  Homolog annotation: Hit_ID=Q69FA1; Match level="QueryCoverage=100%, HitCoverage=100%, E-value=1e-112, Identity=51%"; Hit description =Anthocyanin acyltransferase
  Pfam annotation: Domain name=Transferase; Domain location=5-316; Score=-142.5; E_value=0.00049; Accession=PF02458.6; Description =Transferase family
MADTVTVKVIEQCEVSPPPDTVPSTFFPLTFFDLPWLCCPPLKRIFFYHFPYSSQHFLQTFLPTLKHSLSLTLQHFFPFSSNLVFLPKPNPPHILFTQTDSNSISFTVAESTADFTTLVSDSTSHVAVDGRAFHHFMKFWASICKFKGELGLVSLEGSLPLPLYNRDIIQDPKGLKLSKGEIRDVASDTVRRTFVLSHDHVEKLKKWVKSEEAEVGTIVPTNESPTSWPLFKRSKLVGENGVVEAAIAIGSEGSPKLQVYETDFGWGKPKRSEVVHVDNSGTISLSDCRDKEGRIEVGIALQKTQMNRFITILEEHLTKIAVLD

SEQ ID NO: 109267 - protein, 208 aa, Glycine max
  Coding DNA Sequence Number=SeqID_17582
  Gene Ontology: Mol. function=tRNA (guanine-N2-)-methyltransferase activity; Cellular component=mitochondrion; Biological process=tRNA processing
  Homolog annotation: Hit_ID=A5BTI2; Match level="QueryCoverage=97%, HitCoverage=36%, E-value=8e-90, Identity=77%"; Hit description =Putative uncharacterized protein
MGSLIFIFQNNSVKYLPGHGPVVPQECNYCGKKFNMGGPIWSAPIQDQEWVTSILADVKSMKESCSDIFFSGIATLFLSLHNLCATLKCTSPSAIIFRSAVINAGYHISGTHVNPQGLKSDAPMDVIWDIMRCWVKDHPVKAQPADQPGSVIFAKEPVLRANFARAVSTLSKAQAKKVARFLPNPERYWGPKLRAGRQINSKRVSVLG

SEQ ID NO: 109268 - protein, 429 aa, Glycine max
  Coding DNA Sequence Number=SeqID_17583
  Gene Ontology: Mol. function=L-isoleucine transmembrane transporter activity; Cellular component=integral to membrane; Biological process=amino acid transport
  Homolog annotation: Hit_ID=Q2HUS3; Match level="QueryCoverage=98%, HitCoverage=97%, E-value=1e-180, Identity=76%"; Hit description =Amino acid/polyamine transporter II
  Pfam annotation: Domain name=Aa_trans; Domain location=39-423; Score =146.1; E_value=9.7e-41; Accession=PF01490.9; Description =Transmembrane amino acid transporter protein
MSEKLSYLNEPLLHEWEHREFGHATDEEKVIASHPSTENTASFFGTCLNGLNAISGVGILSVPYALASGGWLSLVLLFAIATTAFYTGMLIKRCMDKYSNIRTYPDIGELAFGKTGRLIVSVSMYTELYLVSIGFLILEGDNLSNLFPIGEVQIAGLAIGGKQFFVILVSLIILPTVWLDNLSLLSYVSASGVFASAFIILSISWTATFDGVGFHQKGTSVNWNGIPTAVSLYAFCYCAHPVFPTLYNSMTNKHQFSNVLLLCFLLTTVGYASMAIIGYLMFGADVESQITLNLPLNKVSSKLAIYITLVNPISKYALMATPITNALKDLLPSTYKNRVTNILVSTVMVIGTTIVALVVPFYGYLMSLVGAFLSVTASILLPCFCYLKISGSYRRFECETVIIVIIIIPAIVMGISGSYNSVMEIVHQL

SEQ ID NO: 109269 - protein, 252 aa, Glycine max
  Coding DNA Sequence Number=SeqID_17584
  Gene Ontology: Mol. function=structural constituent of ribosome; Cellular component=intracellular; Biological process=translation
  Homolog annotation: Hit_ID=A7PMX8; Match level="QueryCoverage=80%, HitCoverage=92%, E-value=9e-55, Identity=57%"; Hit description =Chromosome chr14 scaffold_21, whole genome shotgun sequence
  Subcellular localization annotation: CTP_CleavageSite=56; ConfidenceScore=5.31e-01
MAYFHSSISLCNSSVDQYMANSLDFEPKSRHRKTPNSLQSPPCRRSRSAVVDVVIFAAVIAAFGFLLFPYAQILASESVKFGILIVNLVKEEVSFTPWIYMFIGVSVTFAALTTWVLVACTIRKCGNPNCKGLRKAATFDIQLETEDCVKNSPSLTKDGGVKKGLFKVFCDHHRELEAELKKMAPPNGRAVLVLRGRCGCSVVFSFCDKWAPMIKVTNLLVEYRLALLEEVACDVNHGVDCSITKNLLHSCL

SEQ ID NO: 109270 - protein, 674 aa, Glycine max
  Coding DNA Sequence Number=SeqID_17585
  Gene Ontology: Mol. function=catalytic activity; Cellular component =nucleus; Biological process=metabolic process
  Homolog annotation: Hit_ID=A7PHH0; Match level="QueryCoverage=88%, HitCoverage=90%, E-value=0.0, Identity=59%"; Hit description =Chromosome chr17 scaffold_16, whole genome shotgun sequence
  Pfam annotation: Domain name=PPR; Domain location=116-150; Score =25.9; E_value=0.00015; Accession=PF01535.11; Description=PPR repeat
  Pfam annotation: Domain name=PPR; Domain location=151-185; Score=3.9; E_value=2.7; Accession=PF01535.11; Description=PPR repeat
  Pfam annotation: Domain name=PPR; Domain location=231-265; Score =33.1; E_value=1e-06; Accession=PF01535.11; Description=PPR repeat
  Pfam annotation: Domain name=PPR; Domain location=375-409; Score =48.6; E_value=2.2e-11; Accession=PF01535.11; Description=PPR repeat
  Pfam annotation: Domain name=PPR; Domain location=481-515; Score =10.5; E_value=0.45; Accession=PF01535.11; Description=PPR repeat
  Pfam module annotation: Pfam domain module=PPR::PPR::PPR::PPR::PPR; Domain location=116-150::151-185::231-265::375-409::481-515
  Subcellular localization annotation: CTP_CleavageSite=32; ConfidenceScore=5.56e-01
MQTRSKSHFLTFFTMKNSSLHSLPPSLFTTIVVANGDCTFPSQIPNPSSGLKPKPKKVEYSERQVAVLDDTQIRQTSSSGLCIQIEKLVVCNRYREAMKLFEILELEHDGFDVGGSTYDALVSACVGLRSIRGVKRVFNYMISSGFEPDLYLMNRVLFMHVKCGLMLDARKLFDEMPDLVQVGRQIHSCALKRGVGDDTFVSCALIDMYSKCGSIEDAHCVSDQMSEKTTVGWNSIIASYALHGYSEEALSLYYEMRDSGAAIDHFTISIVIRICARLASLEYAKQAHAALVSHGYGQCSSLCEGMGEGCCTQPYPCICKEAVSGFKPMTNKSPRHNFTAAPGLALKHFNNIINKWGRMEDARHVFNWVRCKNVISWSALIAGYGNHGQGEEAVEMFEQMLQEGMIPNHVTFLAVLSACSYSGLSERGLLDEAYEPIRSAPFKPTTNMSAALLTACRMHYNLELGKVAAENLYGMEPEKLCNYIVLLNLYNSSGKLKEAAGVLQTLKRKGLRMLPACTWIEVKKQPHAFLCGDKSHSQRKEIYEKVDNLMVEISRHGYVEENETLLPDVDEEEQRILKYHSEKLDIAFGLINTPHWTPLQITQGHRVCGDCHSAIKLIAMVTRREIVVRDASKFHHFRNGSCSCSDYWCDKVSFKLQSFILSSLLLTHLSLTFD

SEQ ID NO: 109271 - protein, 207 aa, Glycine max
  Coding DNA Sequence Number=SeqID_17586
  Gene Ontology: Mol. function=protein kinase activity; Cellular component=plasma membrane; Biological process=protein amino acid phosphorylation
  Homolog annotation: Hit_ID=Q69F86; Match level="QueryCoverage=86%, HitCoverage=57%, E-value=1e-62, Identity=62%"; Hit description =Serine-threonine kinase
MSMRDKNKKDNRKENTCCYKKEKKICIGAARGLHYLHAGAKRTIIHPHIKPSNILLDDNMEPKLAGFDLSIQGAHFMSKPKLIQVPAAGTYGYLAMEVWTDNTVTEVVCGRKYLMEPIETEFLEKPLEEKIDEIIKGSIGPECWQVFVDITLRCVKLEPDERPTMGEVEVELEFALSLQKQADRARYSLFSTTIIPPPFSLFRLPGT

SEQ ID NO: 109272 - protein, 202 aa, Glycine max
  Coding DNA Sequence Number=SeqID_17587
  Gene Ontology: Mol. function=sequence-specific DNA binding; Cellular component=nucleus; Biological process=regulation of transcription, DNA-dependent
  Homolog annotation: Hit_ID=Q3Y4G8; Match level="QueryCoverage=94%, HitCoverage=75%, E-value=2e-78, Identity=80%"; Hit description=MADS -box protein
  Pfam annotation: Domain name=K-box; Domain location=26-125; Score =156.5; E_value=7e-44; Accession=PF01486.8; Description=K-box region
MTVLPFFVYLQISMLKTLERYQKCSYGAVEVSKPAKELEQSSYREYLKLKARFESLQRTQRNLLGEDLGPLNIKELEHLERQLDSSLKQVRSTKTQFMLDQLSDLQTKEQMLVEANRSLTVKLEEINSRNHYRQSWEAGDQSMPYGGGGPENSHSHSHSQGFFQPLECNPTLHIGYNAVASDQITATTQPQQVSGFIPGWML

SEQ ID NO: 109273 - protein, 493 aa, Glycine max
  Coding DNA Sequence Number=SeqID_17588
  Gene Ontology: Mol. function=transferase activity, transferring glycosyl groups; Cellular component=integral to membrane; Biological process=metabolic process
  Homolog annotation: Hit_ID=A7QJC6; Match level="QueryCoverage=97%, HitCoverage=96%, E-value=1e-148, Identity=54%"; Hit description =Chromosome chr8 scaffold_106, whole genome shotgun sequence
  Pfam annotation: Domain name=UDPGT; Domain location=20-488; Score= -78.4; E_value=1.2e-06; Accession=PF00201.9; Description=UDP -glucoronosyl and UDP-glucosyl transferase
MDPTVLSHLHFVFIPLMAPGHLLPMVDMAKLLARHKVKVSIVTTPLNCIQFQASIDREIQSGSPIQILHVQFPCAEAGLPEGCESLDTLPSMDLLNNFNMALDLLQQPLEELLEKQRPYPSCIIADKYIMCVTDVANKLNVPRIIFDGTNCFFLLCNHNLQKDKVYEAVSGEEKFLVPGMPHRIELRRSQLPGLFNPGADLKLNAYREKVMEAAEKAHGIVVNSFEELEAEYVEECQRFTDHRVWCVGPVSLSNKDDKDKAMRSKRNSSDLESEYVKWLDSWPPRSVIYVCLGSLNRATPEQLIELGLGLEATKRPFIWVLRGAYGREEMEKWLLEDGFEERVKGRGLLIKGWVPQVLILSHRAIGAFMTHCGWNSTLEGICAGVPLVTFPLFAEQFINEKLVQVVKIGVSVGAESVVHLGEEDKSRVQVTRENVLDSIEKVMGDGQEKEEIRERARKYADMARKAIEQGGSSYLNMSLLIDHIIHLKGLDQS

SEQ ID NO: 109274 - protein, 392 aa, Glycine max
  Coding DNA Sequence Number=SeqID_17589
  Homolog annotation: Hit_ID=Q2HV76; Match level="QueryCoverage=84%, HitCoverage=93%, E-value=2e-37, Identity=33%"; Hit description=F-box protein interaction domain; Galactose oxidase, central
  Pfam annotation: Domain name=F-box; Domain location=18-65; Score =46.8; E_value=7.7e-11; Accession=PF00646.24; Description=F-box domain
  Pfam annotation: Domain name=FBA_1; Domain location=227-377; Score= -45.6; E_value=0.03; Accession=PF07734.4; Description=F-box associated
  Pfam module annotation: Pfam domain module=F-box::FBA_1; Domain location=18-65::227-377
MAQDKKERKRSMKKKQNQSLTTLPQELIREILLRLPVKSLLRFKCVCKSFLSLISDPQFVISHYALAASPTHRLILRSHDFYAQSIATESVFKTCSRDVVYFPLPLPSIPCLRLDDFGIRPKILGSCRGLVLLYYDDSANLILWNPSLGRHKRLPNYRDDITSFPYGFGYDESKDEYLLILIGLPKFGPETGADIYSFKTESWKTDTIVYDPLVRYKAEDRIARAGSLLNGALHWFVFSESKEDHVIIAFDLVERTLSEIPLPLADRSTVQKDAVYGLRIMGGCLSVCCSSCGMTEIWVMKEYKVRSSWTMTFLIHTSNRISPICTIKDGEILGSNCAGTGRLEKRNDKGELLEHFMDTKGQRFSCANLQAAMYTESLLPLPTSFWETSEED

SEQ ID NO: 109275 - protein, 29 aa, Glycine max
  Coding DNA Sequence Number=SeqID_17590
MKDTEKVKSLTMVEVSGSKTCGTLALSGG

SEQ ID NO: 109276 - protein, 402 aa, Glycine max
  Coding DNA Sequence Number=SeqID_17591
  Gene Ontology: Mol. function=peptidase activity; Cellular component =integral to membrane; Biological process=proteolysis
  Homolog annotation: Hit_ID=A7PAG6; Match level="QueryCoverage=79%, HitCoverage=80%, E-value=1e-116, Identity=62%"; Hit description =Chromosome chr14 scaffold_9, whole genome shotgun sequence
  Pfam annotation: Domain name=Abhydrolase_1; Domain location=90-358; Score=-2.4; E_value=0.0082; Accession=PF00561.11; Description =alphabeta hydrolase fold
  Subcellular localization annotation: CTP_CleavageSite=51; ConfidenceScore=5.03e-01
MAAKFAFFPPNPPSYGVGLDDVTGKLKMTGVATRENVDVLKLCTRRGNSVVAMYIRNPSASLTMLYSHGNAADLGQMYELFSELSLHLRVNLLCYDYSGYGQSSGKPSEHNTYADIEAAYKCLVEMYGAKEEDIILYGQSVGSGPTTDLATRLPNLRAVILHSPILSGLRVMYPVKRTYWFDIYKGTDDDVVDYSHGKQLWEHCKQKYEPLWIKGGNHCNLELYPQYIKHLKKFITAIETSSLQKTGSGPVPDQLDRPRSSTDFREKPRLSMDLRENLRRSIDFKEKPRTSTNHKETSRAGPDKKDKSRKSVDRSEKAYIGAEIPEKARNSIDRSVTNHVRLSNEIDFSIVIFRVIPPKRRHFESFCFQNDVVLEEQHGASTKKDSKEARSMSNVLMSVVLC

SEQ ID NO: 109277 - protein, 288 aa, Glycine max
  Coding DNA Sequence Number=SeqID_17592
  Gene Ontology: Mol. function=oxidoreductase activity; Cellular component=cytoplasm; Biological process=metabolic process
  Homolog annotation: Hit_ID=A5BAM4; Match level="QueryCoverage=99%, HitCoverage=98%, E-value=2e-91, Identity=60%"; Hit description =Putative uncharacterized protein
  Pfam annotation: Domain name=Epimerase; Domain location=26-270; Score= -68.7; E_value=0.047; Accession=PF01370.12; Description=NAD dependent epimerasedehydratase family
  Pfam annotation: Domain name=KR; Domain location=25-194; Score=-91.0; E_value=0.046; Accession=PF08659.1; Description=KR domain
  Pfam annotation: Domain name=NAD_Gly3P_dh_N; Domain location=23-168; Score=-59.3; E_value=0.1; Accession=PF01210.14; Description=NAD -dependent glycerol-3-phosphate de
  Pfam annotation: Domain name=adh_short; Domain location=24-190; Score= 70.6; E_value=5.2e-18; Accession=PF00106.16; Description=short chain dehydrogenase
  Pfam module annotation: Pfam domain module=Epimerase::KR::NAD_Gly3P _dh_N::adh_short; Domain location=26-270::25-194::23-168::24-190
MEPQHVTDQNIETQKSSTKRLADKVAVITGGARGIGAAAAKLFAENGAHVVIADVLDELGTTVAKSIGGHYIHCDVSKEDDVESAINLALSWKGHLDIMLSNAGIGGPEGRSITTLEMDRVRHLFSINLYGTIHGIKHAARAMIKGNNKGGSIICTSSAASIMGGLALHGYTMTKAAIDGLVRSAACELGEHLIRVNCISPHGVPSEMLLSACRRFGHDDITPQGVKEMIGSRASLLKGKGATIEDVAHAALFLASDESGFITAHNLLIDGGHTSADSRMSYMYQDPK

SEQ ID NO: 109278 - protein, 344 aa, Glycine max
  Coding DNA Sequence Number=SeqID_17593
  Gene Ontology: Mol. function=proline dehydrogenase activity; Cellular component=mitochondrial matrix; Biological process=glutamate biosynthetic process
  Homolog annotation: Hit_ID=Q6JA03; Match level="QueryCoverage=88%, HitCoverage=62%, E-value=1e-157, Identity=88%"; Hit description =Proline dehydrogenase
  Pfam annotation: Domain name=Pro_dh; Domain location=6-331; Score =267.7; E_value=2.4e-77; Accession=PF01619.9; Description=Proline dehydrogenase
MFFFLLLLSVFLFVCSWVFASSQPCGHVHGIGMKNLVSFVIVKITAICPMSLLERMSDLLRWQHKDPSFSLPWKQDCFPIFSESSPLYHTSKRPEPLTREEESDLQLAMQRFLELCQKCVQANIPLLVDAEHTSVQPAIDYFTYSSAILHNKGDNPIVFGTIQTYLKDAKERLVLAAEAADNMGIPMGFKLVRGAYMSSETKLAESLGYSSPIHNTIEDTHKCFNDCSSFMLEKVANGPGGVVLATHNVESGKLAAAKAHELGVGKVNHKLEFAQLHGMSEALSFGLSNAGFQVSKYMPFGPVETVMPYLLRRAEENRGMLAASGFDRQLMRKELGRRLKAAFF

SEQ ID NO: 109279 - protein, 76 aa, Glycine max
  Coding DNA Sequence Number=SeqID_17594
MVMLGLGRLVVTLKSKIRSLKLKKPYDKMEKSDSMRVEIRSRKARKLIEETLKIADSPKFLAFPSILCTHHIPSQC

SEQ ID NO: 109280 - protein, 229 aa, Glycine max
  Coding DNA Sequence Number=SeqID_17595
  Pfam annotation: Domain name=NAD_binding_2; Domain location=31-203; Score=-89.8; E_value=0.091; Accession=PF03446.6; Description=NAD binding domain of 6-phosphogluconate dehydrogenase
GIGDLGSIWSGFEEFILEASGSEFEMILEASESVSEGLILGAPESGFEEIISEASESESKGLMLDAPESGSEMLLETSETILETSERVFETILEVFEVMVLATSETVSVIFEATWSGFEELIMEASGSTESGEMILEASESGFEEMILEASESDSEGLIMLEAPESGSEMMFAVSERVFEMISEVFENIIANGGCSVDYWNGGLNCTGDTFCEVLQHLREVVLLMNDEK

SEQ ID NO: 109281 - protein, 71 aa, Glycine max
  Coding DNA Sequence Number=SeqID_17596
MEIWFLILETARDECKELLLSVMTVRRRRNKRWREGKKKKGAEGARACVQKSKEGVRALTLSILRWYQNKF

SEQ ID NO: 109282 - protein, 169 aa, Glycine max
  Coding DNA Sequence Number=SeqID_17597
  Gene Ontology: Mol. function=nucleic acid binding; Cellular component= nucleus; Biological process=meristem development
  Homolog annotation: Hit_ID=A7QT77; Match level="QueryCoverage=87%, HitCoverage=12%, E-value=2e-34, Identity=54%"; Hit description =Chromosome chr1 scaffold_166, whole genome shotgun sequence
  Pfam annotation: Domain name=RRM_2; Domain location=1-64; Score=68.8; E_value=1.8e-17; Accession=PF04059.3; Description=RNA recognition motif 2
MVYIQDANNGNVGYAFINMINPGLIILFYQVFNGKKWEKFNSEKVASLAYARIQGKAALIAHFQNSSLMNEDKHCKPISSSTPMALMPVIRILASHLKFALLFLPRDEATKWVLTLLATQVPFPVGINIRNKVGRVRNNTQEDNLQGNLPNFANCKLSSDGDSHSLDSD

SEQ ID NO: 109283 - protein, 76 aa, Glycine max
  Coding DNA Sequence Number=SeqID_17598
MGWKREFEGIEKIEKRQILKAAIIFGTDYELGSDPTILLSYGSVLLWLVSYTYCVLFLWNWTRQLYPIKLIIIIQI

SEQ ID NO: 109284 - protein, 96 aa, Glycine max
  Coding DNA Sequence Number=SeqID_17599
MGHPSLFLVQLLVTSLLFLSFDYGFGRVELTETHQNCALVEYVCSLPKLKQKDFPIRTIVKYDIADYSDPQPNTNPKNGYVLSPPSSPTPIHPPSP

SEQ ID NO: 109285 - protein, 426 aa, Glycine max
  Coding DNA Sequence Number=SeqID_17600
  Gene Ontology: Mol. function=nucleic acid binding; Cellular component= nucleus; Biological process=mRNA processing
  Homolog annotation: Hit_ID=A9PHS8; Match level="QueryCoverage=99%, HitCoverage=82%, E-value=1e-128, Identity=59%"; Hit description =Putative uncharacterized protein
MVRGKTVYIQYSNRHEIVNNKSPGDIPGNVLLVTIEGVEAGDVSIDVIHLVFSAFGFVHKIATFEKTAGFQALIQFTDAETASSARDALDGRSIPRQVVPFVLFPLFFNPIYNSSYSLIRPKFAESLVVWHVDTCFQPMDYTNPMLPVNYTAIEGAVQTAVGPDGKRKEPDSNVLLASIENMQYAVTVDVLHTVFSAFGTVQKIAIFEKNGQTQALIQYPDIITASAAREALEGHCIYDGGYCKLHLSYSRHTDLNVKAFSDKSRDYTVPDPSLLAAQGPATAWQNPQAAPMYPGSAPAYHTQVPGGQVPAWDPNLQAVRPSYVSAPGTFHVQSGAAPPMPAYAPAAAMPAASSPHAQSSPMAHNANPMGIAQPRVPPNANLQSSGASLSAPGSSPLMQTSQAAQGLVQPNARPGGASPPGQHYYG

SEQ ID NO: 109286 - protein, 341 aa, Glycine max
  Coding DNA Sequence Number=SeqID_17601
  Gene Ontology: Mol. function=protein transporter activity; Cellular component=nuclear pore; Biological process=protein import into nucleus, docking
  Homolog annotation: Hit_ID=A7Q9N9; Match level="QueryCoverage=100%, HitCoverage=31%, E-value=1e-161, Identity=81%"; Hit description =Chromosome chr5 scaffold_67, whole genome shotgun sequence
  Pfam annotation: Domain name=IBN_N; Domain location=24-98; Score =77.9; E_value=3.4e-20; Accession=PF03810.10; Description=Importin -beta N-terminal domain
MDLSSLAVILQAALSPNPDERKAAEQGLNQFQYAPQHLVRLLQIIVDNNVDMGVRQVASIHFKNFIAKNWSPLDDTQQKISQSDKDVVRDHILVFVTQVPPLLRVQLGECLKTVIHSDYPEQWPHLLDWVKHNLQDQQVHGALYVLRILSRKYEFKSDEERVPVYRVVDETFPHLLNIFNRLVQIVNPSLEVADLIKLICKIFCMYSFLTLGDQIKVVKFERLEIPKLLFDQNIFNAWMMLFLNILERPVPSEGQPVDPDLRKSWGWWKVKKWTVHILNRLYTRFGDLKLQNPENRAFAQMFQKHYAGKILECHLNLLNVIRVGGYLPDRVINLILQYLSN

SEQ ID NO: 109287 - protein, 264 aa, Glycine max
  Coding DNA Sequence Number=SeqID_17602
  Homolog annotation: Hit_ID=A9PEJ7; Match level="QueryCoverage=80%, HitCoverage=82%, E-value=3e-53, Identity=50%"; Hit description =Putative uncharacterized protein
  Pfam annotation: Domain name=SAM_1; Domain location=197-260; Score =59.2; E_value=1.4e-14; Accession=PF00536.21; Description=SAM domain (Sterile alpha motif)
  Pfam annotation: Domain name=SAM_2; Domain location=196-262; Score =47.2; E_value=5.9e-11; Accession=PF07647.8; Description=SAM domain (Sterile alpha motif)
  Pfam module annotation: Pfam domain module=SAM_1::SAM_2; Domain location=197-260::196-262
MAEEPENNPPPPEPPIPSAPDAAEETAAPAPATTSQPSAEIVAPLALAPKRQRRPSVRLGEIGDQRASSAHGHDSHTRRPSMPPWSWRTPKESSRTSKARTVTNLANGGEEFGNSNSRRGKAKRGPATKRLRTNWAPRATIDENGDEEGFRDFEHEHEQSPVHSMEENGVDYWHVDRNEDPRVRVSENDGVESESQERRKSDGVRSWLYELGLSRYAPMFEIHEVDDELLPMLTLEDLKDMGINAVGSRRKMYTAIQKLRKCLP

SEQ ID NO: 109288 - protein, 662 aa, Glycine max
  Coding DNA Sequence Number=SeqID_17603
  Homolog annotation: Hit_ID=Q2HVW1; Match level="QueryCoverage=19%, HitCoverage=53%, E-value=5e-14, Identity=32%"; Hit description =Putative uncharacterized protein
MKMNVNIPKYGRPKKGESQTVERGTAETGQTQKGRTEVYLSRLPEANMGIQGRSYAEVVNTNIPKPAQRRTTAKLQYISSNATSEVNLDISMTGKQWLKEAWVGRLKNLASFDSIEEAIWWDSGQNISPKYIGDDMVLLLGLTEENAEKMVNEEDEGWGDLFYSIEKWNPSLRPGFRLTWIQCWGIPLVAWDMNCIKQIVAGIGEMVEAEESLEDQRRFDVARILVKTPWKPLIQHTVNIHIQGEIFPVHIAEESGLFGARWQPKRERDFSSSEEILSDECNDDAWSGSELQGWRYKARIESVAEEIRTVAKGGTLEAEAMEDMATEGVVGGEEDNRRGRSEIVPFKTQRGAPAQSETVDDTEDRGGDEERSPRGVEEGRLRQVSRSEGPATVAAGADQNGKAIGTKSGHDPKDKAIVRWVVKQADNALTGDKCVQTRDRELPVSQEEGKTDLGEEDNLGGDVGPDGLGNLYENSMRRQTRNVGGMVYEEDKHNFESPSPKSRDKEMMGLLDLGQAINTPPKLCPSPKNGPVLKTTPLLTPLLTYSRKGKMKRVKAQIGEVVSNQVLSSPEHVQNGLFQRDNEGRGSANPQIQTETSSTHNRQENQLQEETFDSHEESLWRMIKELGLTTGKTQRDYVQQLTEMEDRDGKEADSLGGRGRDS

SEQ ID NO: 109289 - protein, 362 aa, Glycine max
  Coding DNA Sequence Number=SeqID_17604
  Gene Ontology: Mol. function=aspartic-type endopeptidase activity; Cellular component=anchored to membrane; Biological process =proteolysis
  Homolog annotation: Hit_ID=A7Q9Q7; Match level="QueryCoverage=89%, HitCoverage=56%, E-value=1e-102, Identity=59%"; Hit description =Chromosome chr5 scaffold_67, whole genome shotgun sequence
  Pfam annotation: Domain name=Asp; Domain location=17-309; Score= -194.6; E_value=0.043; Accession=PF00026.14; Description=Eukaryotic aspartyl protease
MDLTLYDIKESSSGKFVPCDQEFCKEINGGLLTGCTANISCPYLEIYGDGSSTAGYFVKDIVLYDQVSGDLKTDSANGSIVFGCGARQSGDLSSSNEEALGGILGFGKANSSMISQLASSGKVKKMFAHCLNGVNGGGIFAIGHVVQPKVNMTPLLPDQPHYSVNMTAVQVGHAFLSLSTDTSTQGDRKGTIIDSGTTLAYLPEGIYEPLVYKIISQHPDLKVRTLHDEYTCFQYSESCAPIAVVSMVRGIGHIKKARCHHPSIWQLNAMLALFKLAVMSIGICSGWCLSVDDGFPAVTFYFENGLSLKVYPHDYLFPSSFIWLVLGPVVGLLCHIHIYEEESSYFKSNSKRVTPHLHHSFP

SEQ ID NO: 109290 - protein, 495 aa, Glycine max
  Coding DNA Sequence Number=SeqID_17605
  Gene Ontology: Mol. function=catalytic activity; Cellular component =protein serine/threonine phosphatase complex; Biological process =protein amino acid dephosphorylation
  Homolog annotation: Hit_ID=A7PV59; Match level="QueryCoverage=73%, HitCoverage=76%, E-value=1e-131, Identity=65%"; Hit description =Chromosome chr4 scaffold_32, whole genome shotgun sequence
  Pfam annotation: Domain name=PP2C; Domain location=136-436; Score =137.8; E_value=3.1e-38; Accession=PF00481.12; Description=Protein phosphatase 2C
MIIILVFDHDYDDDDEYEYDYDDDDEYEYEHDYDDDDNFDYDDAVEVLNRYGTDLVGEPRGSDSECLAGFECFLNIVRALGMGSCISEVGAGGSSPPLLPFSPESNMDGGKRRRLRGSSSFDFKVPGRMFLNGSSEVASMYCKQGRKGINQDAMLVWENFCSKEDTIFCGVFDGHGPYGHRVAKKVRDSFPLKLNAQWDLHHKNRDGLSDHSSATGSYKSEGNGFRLVDEKTSPTDHELDETDTILTLRESFLKACKIMDKELKHHPDIDCFCSGTTAVTLVKQGLNLVIGNVGDSRAVLGTRDHEDSLIAVQLTVDLKPNLPREEERIKLRRGRVFSLQNEPDVARVWLPNSDFPGLAMARAFGDFCLKDFGLIAVPDISYHRLTEKDEFVVLATDGIWDVLSNEEVVDIVASASQSTAARALVESAVRAWKTKFPFCKVDDCAAVCLFFDSDLDFKSTDTKDKLIPEASIDQSEQLALLGEKGVGNEAEKKQQ

SEQ ID NO: 109291 - protein, 98 aa, Glycine max
  Coding DNA Sequence Number=SeqID_17606
MNDGKSYNCMGIMHACWDDRSDRNCSSGHEQGWCWRGENAAVGRMVLRLFLEKLGEAKEGLHRAGVGTVSERLKAAMPPIVTSHMTTIQLHGVVSWWF

SEQ ID NO: 109292 - protein, 219 aa, Glycine max
  Coding DNA Sequence Number=SeqID_17607
  Gene Ontology: Mol. function=sphinganine-1-phosphate aldolase activity; Cellular component=endoplasmic reticulum membrane; Biological process=carboxylic acid metabolic process
  Homolog annotation: Hit_ID=Q9C509; Match level="QueryCoverage=84%, HitCoverage=33%, E-value=6e-75, Identity=72%"; Hit description =Sphingosine-1-phosphate lyase
MDEALFLAWSWQRAREKGFHTQFNHWSSNLSEFFGGTLGALYLSYSTPVTEWSGGLYVSPTIAGSRPGSLIAGAWAAMISLGKEGYLKNTKEIMEGSRRIQQGIEEIAELFIVGKPDMTIVAFGSDVLDIFEVNDVMSSKGWHLNALQRPNSIHICVTLQHVPIVEDFLNDLKESVKTGGCRGMAVDVKANPGPISGGLAPIYGAAGKMPDRGMVQELL

SEQ ID NO: 109293 - protein, 51 aa, Glycine max
  Coding DNA Sequence Number=SeqID_17608
MEDTPNGDGGGQRCGLLDNLLQEEVRKVEGEEHLTSELLTIVLANVSLHVG

SEQ ID NO: 109294 - protein, 98 aa, Glycine max
  Coding DNA Sequence Number=SeqID_17609
  Homolog annotation: Hit_ID=A7QUU1; Match level="QueryCoverage=80%, HitCoverage=17%, E-value=4e-12, Identity=48%"; Hit description =Chromosome chr1 scaffold_180, whole genome shotgun sequence
  Pfam annotation: Domain name=IQ; Domain location=46-66; Score=23.8; E_ value=0.00063; Accession=PF00612.18; Description=IQ calmodulin -binding motif
  Subcellular localization annotation: CTP_CleavageSite=79; ConfidenceScore=5.34e-01
MQMKNTPLYRTTPLGVMADPCYRKAPSKVVSIPVHFVGSERTRTNSDSATKIQRVLRGFLVRNTLRKIAAMRVELERIECEVRVEVMKLKREQRERVR

SEQ ID NO: 109295 - protein, 439 aa, Glycine max
  Coding DNA Sequence Number=SeqID_17610
  Gene Ontology: Mol. function=secondary active sulfate transmembrane transporter activity; Cellular component=integral to membrane; Biological process=response to stress
  Homolog annotation: Hit_ID=A7Q445; Match level="QueryCoverage=96%, HitCoverage=57%, E-value=0.0, Identity=77%"; Hit description =Chromosome chr13 scaffold_48, whole genome shotgun sequence
  Pfam annotation: Domain name=STAS; Domain location=350-439; Score =43.3; E_value=8.4e-10; Accession=PF01740.12; Description=STAS domain
  Pfam annotation: Domain name=Sulfate_transp; Domain location=5-327; Score=451.1; E_value=1.5e-132; Accession=PF00916.11; Description =Sulfate transporter family
  Pfam annotation: Domain name=Xan_ur_permease; Domain location=2-318; Score=-160.4; E_value=0.04; Accession=PF00860.11; Description =Permease family
  Pfam module annotation: Pfam domain module=STAS::Sulfate_transp::Xan _ur_permease; Domain location=350-439::5-327::2-318
MECIMGLLRLGWLIRFISHSVISGFTTASAIVIGLSQAKYFLGYDIDGSSKIIPVVKSIIAGADKPAQGRMMVFKDWMFNSFQFSWPPFVMGSIMLAILLVMKHLGKSRKYLRFLRAAGPLTAVVLGTTFAKIFHPSSISLVGDIPQGLPKFSVPKSFEYAQSLIPTALLITGVAILESVGIAKALAAKNGYELDSNQELFGLGVSNVLGSFFSAYPTTGSFSRSAVNHESGAKSGVSGIVSGIIMTCALLFLTPLFEYIPQCTLAAIVISAVIGLVDYDEAIFLWRVDKKDFLLWTITSTTTLFLGIEIGVLVGVGVSLAFVIHESANPHIAVLGRLPGTTVYRNVKQYPEAYTYNGIVIVRVDAPIYFANTSYIKDRLREYEVDVDRSKRRGPEVERIYFVILEMAPVTYIDSSAVQALKDLYSGVQITGHSGRIRL

SEQ ID NO: 109296 - protein, 285 aa, Glycine max
  Coding DNA Sequence Number=SeqID_17611
  Gene Ontology: Mol. function=beta-N-acetylhexosaminidase activity; Cellular component=plasma membrane; Biological process=carbohydrate metabolic process
  Homolog annotation: Hit_ID=Q9M3C5; Match level="QueryCoverage=80%, HitCoverage=41%, E-value=2e-93, Identity=72%"; Hit description=Beta -N-acetylhexosaminidase-like protein
  Pfam annotation: Domain name=Glyco_hydro_20b; Domain location=61-208; Score=51.5; E_value=2.8e-12; Accession=PF02838.6; Description =Glycosyl hydrolase family 20, domain 2
  Subcellular localization annotation: CTP_CleavageSite=20; ConfidenceScore=5.13e-01
MFVFKPTSSLLFLLLSISYSASSVTSLTVPPRGGAPLDLTTTPQQQTDGDDDSLTYLWPLPAEFTSGGDTLSVDPALTLSVAGNGGGSAILREAFGRYRGIVFKNTAGVGFSFIRKLRERLVSSVSAFDVDTLKITVHSDNEELQFGVDESYTLLVPKAKESSQVTIEANTVYGALRGLETFSQLCSFDYTTKTVKIYKAPWSIQDKPRFAYRGLMLDTSRHYLPIDVIKQIIESMSYAKLNVLHWHIIDEQSFPLEIPTYPNLWKGSYTKWERYTVEDAYEIVK

SEQ ID NO: 109297 - protein, 252 aa, Glycine max
  Coding DNA Sequence Number=SeqID_17612
  Gene Ontology: Mol. function=transporter activity; Cellular component= integral to membrane; Biological process=response to stress
  Homolog annotation: Hit_ID=O82598; Match level="QueryCoverage=100%, HitCoverage=100%, E-value=1e-117, Identity=80%"; Hit description =Aquaporin TIP1-3
  Pfam annotation: Domain name=MIP; Domain location=13-234; Score =373.7; E_value=3e-109; Accession=PF00230.11; Description=Major intrinsic protein
MAMHRIAIGTPGEAAQPDAIRAAFAEFFCMIIFVFAGEGSGMAYSKLTNNGPATPAGLIAASLSHAFGLFVAVSVGANISGGHVNPAVTFGAFIGGNITLLRSILYWIAQLFGSVVACILLKHATGGMETSGFSLSPGVSVWNALVFEIVMTFGLVYTVYATAVDPKKGNAGVVAPIAIGFIVGANILVGGAFDGASMNPAVSFGPAVVTWSWTHHWVYWVGPFIGAAIAAIIYDNIFIGDDGHEPLSSSDF

SEQ ID NO: 109298 - protein, 191 aa, Glycine max
  Coding DNA Sequence Number=SeqID_17613
  Gene Ontology: Mol. function=calcium ion binding; Cellular component =oxygen evolving complex; Biological process=photosynthesis
  Homolog annotation: Hit_ID=A7PJ10; Match level="QueryCoverage=98%, HitCoverage=86%, E-value=6e-56, Identity=56%"; Hit description =Chromosome chr13 scaffold_17, whole genome shotgun sequence
  Pfam annotation: Domain name=PsbP; Domain location=28-187; Score =25.9; E_value=2.5e-07; Accession=PF01789.7; Description=PsbP
  Subcellular localization annotation: CTP_CleavageSite=52; ConfidenceScore=5.41e-01
MTSLQNSPTLHRTMLHNSFPQKHATRSSRRDAISFIVKAAQEPSASLASQVAAENKKGFLPVLDKKDGYSFLYPFGWQEVVIEGQDKVFKDVIEPLENVSVNVIPTGKQDITEFGSPQEVAETLIKKVLAPPNQKTKIVEAKETLIMTCSIYVMLQQDVEGKKYYQFEFIAKAPNYTRHALSTVSIGNGMI

SEQ ID NO: 109299 - protein, 287 aa, Glycine max
  Coding DNA Sequence Number=SeqID_17614
  Gene Ontology: Mol. function=ATP binding; Cellular component =membrane; Biological process=defense response
  Homolog annotation: Hit_ID=A7PZ72; Match level="QueryCoverage=78%, HitCoverage=86%, E-value=3e-34, Identity=40%"; Hit description =Chromosome chr15 scaffold_40, whole genome shotgun sequence
MADTIVVFLIEKLTRLLAEEAKLLGSAHDKVTSLRNELRFMNLFLNNSQGKRKDHNMVAELVDQIRDIAHEAEDVIDNYISDMIKQRRRNMLEKFGRGVDHALMLRNLTVKIDRIKTTINDIFDNKVKYGIEAGRRDSEEEAERIRKQRRDVEEQEVVGFAHDSKVVVIEKLMASGSRLKLVSIVGMGGLGKTTLARKIYNSNRVKNTFPCRAWGYASNDYRPREFFLSLLKCLLSTSKYNDLFKKREEASRSEEELKMKVRECLSRSGGKYLVVVDDVWQSQVWDE

SEQ ID NO: 109300 - protein, 623 aa, Glycine max
  Coding DNA Sequence Number=SeqID_17615
  Gene Ontology: Mol. function=nucleotide binding; Cellular component =chloroplast; Biological process=response to stress
  Homolog annotation: Hit_ID=P27322; Match level="QueryCoverage=87%, HitCoverage=84%, E-value=0.0, Identity=67%"; Hit description=Heat shock cognate 70 kDa protein 2
  Pfam annotation: Domain name=HSP70; Domain location=5-567; Score =820.8; E_value=7.5e-244; Accession=PF00012.11; Description=Hsp70 protein
  Pfam annotation: Domain name=MreB_Mbl; Domain location=47-341; Score=- 274.2; E_value=0.031; Accession=PF06723.4; Description=MreBMbl protein
  Pfam module annotation: Pfam domain module=HSP70::MreB_Mbl; Domain location=5-567::47-341
MKKIGEHQTLLALKETLVYFAGAKRLIGRRFSNPEVQSDMKQWPFKVIADVNDKPMIAVNYNCEERHFSAEEISSMVLEKMRAIAESFLGSTVKNAVITVPAYFNDSQRQATKDAGAIAGLNVLRIINEPTAAAIAYRLERKNCNNERRNVFVFDLGGGTLDVSLLVFEKDYIRVKATSGDTHLGGEDFDNNMVTYCVKEFQRKNKKDISGNERALRRLRTACEKAKRILSSTVMTTIEVDSLYDGIDFHSSISRAKFEELNMDYLNKCMEFVEKCLIDAKMDKSSVHDVVLAGGSTRIPKLQQLLSDFFDGKDLCKCINADEAVAYGAAVHASMLNGESSEKVQNTLPREVTPLSLGLEKEGGIMKVIIPRNTSIPTKMEDVFTTHLDNQINILIHVYEGERQRTRDNNLLGKFVLEIPPVPRGVPQIIVCFEVDDEGILHVSAKENSLGITKKVTIINDKGRLSEEEIKRMISEAERYKAEDEMYRKKVEARYALEKYAYNIRNAIKHKGISLKLSPEDKEKINDAVDRALEWLEVSVDAEKEDVDNFRGNLSSVFDTIMVKMIKGEDNGAPPGAVASSGSKSGKNRWLSILAKFGLQAVYSAVTGDIIGFVSVIVDCLAN

SEQ ID NO: 109301 - protein, 245 aa, Glycine max
  Coding DNA Sequence Number=SeqID_17616
  Gene Ontology: Mol. function=sequence-specific DNA binding; Cellular component=nucleus; Biological process=regulation of transcription, DNA-dependent
  Homolog annotation: Hit_ID=Q9ZRZ4; Match level="QueryCoverage=94%, HitCoverage=82%, E-value=2e-75, Identity=65%"; Hit description=HB2 homeodomain protein
  Pfam annotation: Domain name=Homeobox; Domain location=84-145; Score =72.3; E_value=1.6e-18; Accession=PF00046.20; Description=Homeobox domain
MVNVMEWQKQRWQPNGNAEMMYVKVMTDEQLETLRKQIAVYATICEQLIEMHKNISSHQDLAGIRLGNMYCDPLLGSGGHKIASRQRWTPSAMQLQILERIFDQGTGTPTKEKIKEITNELSQHGQISETNVYNWFQNRRARSKRKQQNVAPSANAESEVETEVDSKDKKTKPDEFQSPPSVSAVPADDNLGFQNHGSLQYLNPESNKPDSVFPSDATSDYLTGKMEAPENYDLYQPAGDFNMAG

SEQ ID NO: 109302 - protein, 28 aa, Glycine max
  Coding DNA Sequence Number=SeqID_17617
MATGKNIAGAQNGGSGQRDLNNYSLMGH

SEQ ID NO: 109303 - protein, 309 aa, Glycine max
  Coding DNA Sequence Number=SeqID_17618
  Homolog annotation: Hit_ID=A7PWX4; Match level="QueryCoverage=88%, HitCoverage=90%, E-value=8e-52, Identity=41%"; Hit description =Chromosome chr12 scaffold_36, whole genome shotgun sequence
MKSLSSVGLGLSIIFGCLLLALVAEVYYLLWWKKRITNREIENNYGNPVKELFYMFCWKRPSSSSLRQTSFTPPELCSSMRIGDTLVHNPEQVQSQSGKDFVFKPFGEDGMDAEYMSQQDLLGPPRFLFTIVEESKEDLESDDGKFKCDKSGKGSRGRSLGDLLVVETPYMTPTTSPPFFTPPFTTPISPYNQRGFNPLFETATDAEFNRLKSSPPPKFKFLQEAEEKLRRKLQQDENKGNGDEVDGSFITIVVDKKTEREVNHQPRPPQYHSGTSQHYGLIYQASCEMYYHSQCIKAHGGQYFLLINA

SEQ ID NO: 109304 - protein, 308 aa, Glycine max
  Coding DNA Sequence Number=SeqID_17619
  Homolog annotation: Hit_ID=A7PIU6; Match level="QueryCoverage=99%, HitCoverage=99%, E-value=1e-114, Identity=64%"; Hit description =Chromosome chr13 scaffold_17, whole genome shotgun sequence
MKRNKATVLTFAEKCKNILASNWQGSLNTIKADAKGSKGNIHTSKIKYIVRRGQPYLWVPENDLHNVNTIIDERGSFAVTSPYPGPLGILLKSLKKLPARIALSGDVLPLKEDKAKSLAEKLQEVMLSEKKAIKEFTYTVSGVLSSSASSSTSRSDNLQDLLGDNERYTIYRFKTRSCTFVDGLGGTFDVDVEDLETSRADPLAPFSAKIVDGINQSEARRTALMLFCFVYKDANAKDAYITSIDRKGFDVLAKVSSPVLKDGIDGYQWKEFRFMFKEEANDVEMFCSQLVEMEEEVINKVSTSSGLK

SEQ ID NO: 109305 - protein, 122 aa, Glycine max
  Coding DNA Sequence Number=SeqID_17620
  Subcellular localization annotation: CTP_CleavageSite=34; ConfidenceScore=5.19e-01
MITVITIVVATDKTVTTTTFVIGVMTTAIAIAVVAMIVMLVGMRMVTTMMIMMMVIVVIEVVVVMILTETTEGQRMVEVVDKAASYCGEEEGMTGRGGEAPQPCMDSDMEDGTHCALCIKKS

SEQ ID NO: 109306 - protein, 572 aa, Glycine max
  Coding DNA Sequence Number=SeqID_17621
  Gene Ontology: Mol. function=pyridoxal phosphate binding; Cellular component=chloroplast; Biological process=amino acid metabolic process
  Homolog annotation: Hit_ID=Q9XFG0; Match level="QueryCoverage=100%, HitCoverage=100%, E-value=0.0, Identity=83%"; Hit description =Cystathionine-gamma-synthase precursor
  Pfam annotation: Domain name=Cys_Met_Meta_PP; Domain location=148 -570; Score=586.7; E_value=2.3e-173; Accession=PF01053.11; Description=CysMet metabolism PLP-dependent enzyme
  Subcellular localization annotation: CTP_CleavageSite=36; ConfidenceScore=5.52e-01
MAVSSSHMRFTFECRSDPDFSPPPPSFDNLRRRNFRSSAGSGAAFHGISSLILRFPPNFQRQLSTKARRNCSNIGVAQIVAASWSNNSDNSPAAGAPAPPAATAADAATVPLPVDLAAAEDVVVSAAAAENGTVQLNSSSYSFLKSDASKTIHAAERLGRGIETDGITTPVLNTSAYFFKKTADLIDFKENRQVSYEYGRYGNPTTVVLEEKIRFVVIINPSILEGAESTVIMASGMCASVVLFMALVPAGGHLVTTTDCYRKTRIFIETFLPKMGITTTVIDPADVGALESALEQHNLIDGLELTWYDTIIQVSLFFTESPTNPFLRCVDIKLVSELCHKKGTLLCIDGTFATPLNQKALALGADLILHSLTKYMGGHHDLFRVKRQGAFFLFQALGGCISGSTKVVSQIRTLHHVLGGTLNPNAAYLFIRGMKTLHLRVQQQNSTGMRMAELLEAHPKVKRVYYPGLPSHPEHELAKRQMTGFGGVVSFEIDGDLHTTIKFIDSLKIPYIAASFGGCESIVDQPAILSYWDLPQSERAKYKIYDNLVRFSFGVEDFEDLKADVLQALEAI

SEQ ID NO: 109307 - protein, 86 aa, Glycine max
  Coding DNA Sequence Number=SeqID_17622
  Gene Ontology: Mol. function=pyridoxal phosphate binding; Biological process=carboxylic acid metabolic process
  Homolog annotation: Hit_ID=Q9SXL2; Match level="QueryCoverage=74%, HitCoverage=13%, E-value=2e-21, Identity=78%"; Hit description =Serine decarboxylase
MECVKINTLWSGEIDCDGFEAKLLCHKDKPAIVNVNIGTTVKGAMDDLDLVIKKLEEAGFSRDRIMRYIRSEESSTGDVVEHIILD

SEQ ID NO: 109308 - protein, 597 aa, Glycine max
  Coding DNA Sequence Number=SeqID_17623
  Gene Ontology: Mol. function=nucleotide binding; Cellular component =cytoplasm; Biological process=response to stress
  Homolog annotation: Hit_ID=A2Q405; Match level="QueryCoverage=99%, HitCoverage=99%, E-value=0.0, Identity=65%"; Hit description=Heat shock protein Hsp70
  Pfam annotation: Domain name=HSP70; Domain location=8-595; Score =1010.5; E_value=6.1e-301; Accession=PF00012.11; Description=Hsp70 protein
  Pfam annotation: Domain name=MreB_Mbl; Domain location=6-392; Score= -229.1; E_value=3.3e-05; Accession=PF06723.4; Description=MreBMbl protein
  Pfam module annotation: Pfam domain module=HSP70::MreB_Mbl; Domain location=8-595::6-392
MAKNQGFAVGIDLGTTYSCVAVWQGQQNRVEIIHNDQGNRTTPSFVAFTDDQRLIGDAAKNQAAANPENTVFDAKRLIGRKYSDPTIQNDKMLWPFKVIADNNDKPMITVKYKGHEKLLSAEEVSSMILMKMREIAEAYLETPVKSAVVTVPAYFNDSQRKATIDAGTIAGLNVMRIINEPTAAAIAYGLDKRINCVGERNIFIFDLGGGTFDVSLLTIKDKVFQVKATAGNTHLGGEDFDNRMVNYLVQEFKRMNKVDISGNPRALRRLRTACEKVKRTLSFAVTTTIEVDSLSKGIDFCISITRAKFQELNMDLFEECLKTVNKCLTDAKTDKSSVHDVVLVGGSSRIPKVQELLQEFFEGKDFCKSINPDEAVAYGAAVQAALLSDDIQNVPNLVLLDVAPLSLGISTKGDLMSVVIPRNTTIPVYEGERTRANDNNLLGFFSLLGLVPAPRGHPVDVCFTIDVNGILSVSAEETTTGYRNEITITNDQKRLSAEQIKRMIHEAEKYQVNDMKFMKKANTMNALDHYVYKMRNALNNKNISSKLCLQERKKIKSVITKVTDLLEGDNQRDKIEVFEDHLNELVNLFDRVIGKFA

SEQ ID NO: 109309 - protein, 325 aa, Glycine max
  Coding DNA Sequence Number=SeqID_17624
  Gene Ontology: Mol. function=nucleotide binding; Cellular component =cytoplasm; Biological process=response to stress
  Homolog annotation: Hit_ID=A2Q405; Match level="QueryCoverage=64%, HitCoverage=43%, E-value=4e-71, Identity=54%"; Hit description=Heat shock protein Hsp70
  Pfam annotation: Domain name=HSP70; Domain location=22-323; Score= -57.0; E_value=5.5e-12; Accession=PF00012.11; Description=Hsp70 protein
MAKEDEICCRNRSWYNIFVRCNNQRLIGGAAKNQAVSNPESTVFDAKRLIGRKYSDPVIQKEKMLWPFKVVASINDKPMIVVKYKGQEKHLCAEEVSSMVFTKMWEIAEAYLETPVKNAVVTVPAYFNDSQRKATAAAIAYDLDKRTNFVGEQNIFIFDLGGEEFKKKNKVDISENPRALRRLRTACERAKITLSYDVITNIELVVLFKGIDFCSSITRAKIPNPDEAVAYGAAVQAALLNEGIENVPNLVSIYRKPCEKNVVAIVPAYLNDSQRKDGANVADATAGLNVMQIVNEPTAAFEFKRKNEADISDNRKVLGRLRSAC

SEQ ID NO: 109310 - protein, 88 aa, Glycine max
  Coding DNA Sequence Number=SeqID_17625
  Homolog annotation: Hit_ID=A7QT90; Match level="QueryCoverage=29%, HitCoverage=10%, E-value=3e-08, Identity=100%"; Hit description =Peptidyl-prolyl cis-trans isomerase
MDAENILSAQLCSIFWVLQLCFEDRSLCTLMFRIIVPPELGYPENDFNKSGPRPTTFSVYLFTEDERIHANNCPVEILLILILDACVK

SEQ ID NO: 109311 - protein, 483 aa, Glycine max
  Coding DNA Sequence Number=SeqID_17626
  Gene Ontology: Mol. function=drug transporter activity; Cellular component=membrane; Biological process=multidrug transport
  Homolog annotation: Hit_ID=A7QTE8; Match level="QueryCoverage=94%, HitCoverage=92%, E-value=1e-145, Identity=55%"; Hit description =Chromosome undetermined scaffold_167, whole genome shotgun sequence
  Pfam annotation: Domain name=MatE; Domain location=260-423; Score =122.9; E_value=9.3e-34; Accession=PF01554.9; Description=MatE
  Pfam annotation: Domain name=MatE; Domain location=38-199; Score =98.9; E_value=1.6e-26; Accession=PF01554.9; Description=MatE
  Pfam module annotation: Pfam domain module=MatE::MatE; Domain location=260-423::38-199
MMDKEEATPLLRKSEVAPLEDDDAFCVELKRVGSMAAPMLAANMCQYLLQVVSLMMVGHLGLLVSFSGVAIAISFAEVTGFCVLMGMAGALETLCGQTYGAEEFTEIGNYTFCAIVTLLLVCLPISLLWIFMDKILLLFGQDPEISHVAHKYCICSIPALYGFAVLQCQIRYFQTQSMIFPMVFSSIAVLCLHVPICWGLVFKLGLGHVGAAYAIGISYWLNVIGLGIYMNYSPACEKTKIVFSFNALLSIPEFCQFAIPSGLMFCFEMWSFELLTLFAGLLPNPQLQTSVLSVCLNTTTLHYIIPYAVGASASTRISNELGAGNPKAAQGIVRVVVILGIVDGVIVSTFFVCCRHILGYAYSNDKEVVDYVSDIVPILCGSFTADSLIGALSGIARGGGFQQIGAYVNLGAYYLVGVPLAFLLGFVLHFNAKGLWMGSLTGSVLQVIILTVVTVLTDWQKEATKARERIVEKSIKVHNDSVI

SEQ ID NO: 109312 - protein, 401 aa, Glycine max
  Coding DNA Sequence Number=SeqID_17627
  Gene Ontology: Mol. function=DNA ligase (ATP) activity; Cellular component=nucleus; Biological process=DNA recombination
  Homolog annotation: Hit_ID=Q9C9M5; Match level="QueryCoverage=96%, HitCoverage=34%, E-value=1e-145, Identity=56%"; Hit description=DNA ligase I, putative
  Pfam annotation: Domain name=DNA_ligase_A_C; Domain location=256-327; Score=54.8; E_value=3e-13; Accession=PF04679.6; Description=ATP dependent DNA ligase C terminal region
  Pfam annotation: Domain name=DNA_ligase_A_M; Domain location=85-231; Score=21.2; E_value=5.5e-07; Accession=PF01068.12; Description=ATP dependent DNA ligase domain
  Pfam module annotation: Pfam domain module=DNA_ligase_A_C::DNA_ligase_ A_M; Domain location=256-327::85-231
MEAGGMLLKRLYIDRNLRIGAMLRTVLPALAHAVAMNSCPTLHQEGTAENIKEKLQDLIVPSLMNKGIDFSVSSLSMVPGIPIKPMLAKNGDESTSRFPDLIDIIKESSKPVASTFIMDAEIVGIDRKNGYRIMSFQELSSRGRGGKDTLVTSESIKDLFYDEKPGYFEYAKETTVEADDACLTCEATLTKINAFLEDALRSSCEGIMVKTLDVDAGYSPSKRSDKWLKVKRDYVEGLNDTLDLVPIGAWHGNGRKAGWYSPFLMACFNPETEEYQSVCRVMSGFSDSFYIEEIDIAVQMKQFFSGDKVLSKKPPYYQTREAPDMWFCPQVVWEIRGADFTVSPVHHAAIGLVHPSRGISIRFPRFISCVSDRSPEECSTAADIGEMFHSQTRKMDITTGD

SEQ ID NO: 109313 - protein, 707 aa, Glycine max
  Coding DNA Sequence Number=SeqID_17628
  Homolog annotation: Hit_ID=A5C9E2; Match level="QueryCoverage=83%, HitCoverage=81%, E-value=1e-118, Identity=43%"; Hit description =Putative uncharacterized protein
  Pfam annotation: Domain name=DUF827; Domain location=12-521; Score =13.5; E_value=1.7e-11; Accession=PF05701.2; Description=Plant protein of unknown function (DUF827)
  Pfam annotation: Domain name=FlaC_arch; Domain location=301-421; Score=-16.0; E_value=0.1; Accession=PF05377.2; Description=Flagella accessory protein C (FlaC)
  Pfam module annotation: Pfam domain module=DUF827::FlaC_arch; Domain location=12-521::301-421
MDGVKLGSKRVGSVNAAVNFYDDKKPSSRTKELHRARRDIGRYKESKWTAESAKAQAESELSNAKKTANHLSSMLEESNYKAKTQMRDVERLEKWGKGQHGTIVVAKRNENFEYAQVMRELEYLKKELFKLKLDVAYVMEQKSRAEKEIEASNSKMLSCLTTAEELRREIEEANEEQVLAELARIEASKELTDIETQRKQEANEFSFKLESTRRKLKEAIEEIDESKELEMKLAVTISDVDFLQNELKSVKEMDKRVQGDGSAKQLEGRFKKGEESEDSIVLQTITEELEAARKELALVREEGFQFMASLDVIRNELKHVTAETDRLKKKEGKVDSTVQNLNFKILRAKSKLEAVSAAEEKARSIVMSLSHTLEKLKTETEEAKKENEDVSQEVAATKEEIQKVELDIDTTEERLQGVMQELEVAKASEALALEKLKTLTERTMRERALTAQHSSMITISKFEYEYLTNHAASAEEIADKKVAAAEAWIEALKASEKEILMETKIAQRELKESKLEQELEVYTKEKMLSRRVSSSEELDNWPRKREKTSSKNFQRALSRKSIKLNGTITPARGAKFQKTASPAARHISPFTIKKRKKNSTGGSLSSDSRGSSSYVLNNIQLASRKKLIPYDPSSQCFEDKKQFHCSAWNAKKTISLITQFSPATLVNKWLIPAVRADDEVKDACRMLTPCTNIVKFTVTAKSSGKPI

SEQ ID NO: 109314 - protein, 308 aa, Glycine max
  Coding DNA Sequence Number=SeqID_17629
  Gene Ontology: Mol. function=zinc ion binding; Cellular component =intracellular
  Homolog annotation: Hit_ID=A7QTF1; Match level="QueryCoverage=60%, HitCoverage=75%, E-value=2e-38, Identity=47%"; Hit description =Chromosome undetermined scaffold_167, whole genome shotgun sequence
  Subcellular localization annotation: CTP_CleavageSite=43; ConfidenceScore=5.49e-01
MKPKKITSECPLSLLNPVSNFRTPFLSFRRHFRTRFSLPLHILAVAAKFIEPAERFRSVLLQQLGSRQKMIKRRFYKLDHGDREALDPSSSSSSDSEIEAEAEVDASEEESEEDVTAEVKPNDDEAGSTSSGYASEDGSASDVDVNSAGLLFSEDDAGAINERQVLINRELLIKCDTEKSNVLAEKKSLPTDTPSCVLKCKSVFKCKICPRIICLSEETLRDHLQSKRHARSEKLLSEGRLKAMLNSDGEIDNQEISEIQTKDTEDNAEKNHKRKNQHKKRLRKKKSDKANTRKILSTKGAAKRGRNK

SEQ ID NO: 109315 - protein, 261 aa, Glycine max
  Coding DNA Sequence Number=SeqID_17630
  Gene Ontology: Mol. function=protein serine/threonine kinase activity; Biological process=protein amino acid phosphorylation
  Homolog annotation: Hit_ID=Q53VE0; Match level="QueryCoverage=92%, HitCoverage=34%, E-value=2e-51, Identity=45%"; Hit description =Ser/Thr protein kinase
MKQLLLEPCFIFILLVISVTNTPTCLCVDDASYTNCSNAFSCGNNNFNLKYPFWGENRDNHCGGPNSESEKLTCEAQVPKITINFIKYRVLGWENTSQILKVARDNYWDNNVCVNGDRNSTFDNTPFQYDYDGLVNVTLFYDCPASSSPPTISSLPASSVLTFPCGGAVYYTVQPLPSSYESPCNIVVIPIFNDSLYTPDRIIEALQGGFQIEWTGNYDKCEKCTGSGGECGSVDGNFQCFCKDGPHSASCKDKVVDTRWE

SEQ ID NO: 109316 - protein, 448 aa, Glycine max
  Coding DNA Sequence Number=SeqID_17631
  Gene Ontology: Mol. function=RNA binding; Cellular component =ribonucleoprotein complex; Biological process=regulation of translation
  Homolog annotation: Hit_ID=A7PAT8; Match level="QueryCoverage=87%, HitCoverage=47%, E-value=8e-87, Identity=48%"; Hit description =Chromosome chr14 scaffold_9, whole genome shotgun sequence
  Pfam annotation: Domain name=CRS1_YhbY; Domain location=171-280; Score=52.2; E_value=1.8e-12; Accession=PF01985.12; Description=CRS1 YhbY domain
  Subcellular localization annotation: CTP_CleavageSite=21; ConfidenceScore=5.42e-01
MLFLSFHPSLFPNSYSRFHISSSLPPNSNNGHNHQHTSPSQVPIKSPTPPWMKVPLLLQPHELVDLSNPKSKKFKPEKHELSDKALMGKEVRGKRAMKKIVDRVEKLHKTQNSNETRVDSLNVENFGGYLEILKENEEVRSKGRMPWEKDEKFGFVKVKREKAVTAAELTLDKALLRRLRNEAARMRTWIKVKKAGVTQDVVDQIKRTWRRNELAMIKFDIPLCRNMDRAREIVEMIERWVIEGHVDPMSEKGVTFGVVVVTKTGGLVVLSKKDFLVVYRGCNHQLTTKGSPSLRTNHYEMNRVELATKGDIFRVESNHSSSEMLNWNADHKDSISTGIQDVNCQLVNGSLYERETERLLDGLGPRFIDWWMHKPLPVDADLLPEEVPGFQPPFRLCPPHSSAKLTDYELTYFRKLAQSLPTHFVLGTLLLPAILQYRFQAETTYLFS

SEQ ID NO: 109317 - protein, 158 aa, Glycine max
  Coding DNA Sequence Number=SeqID_17632
  Subcellular localization annotation: CTP_CleavageSite=60; ConfidenceScore=5.50e-01
MDGFGDILHVKGQGTSRHALHVFNASSRFLHSSSSRIPRKAPPSDVVYPSSSSLLSDLVSCATDDAHIRRVFSRHKRDLTSPLVLRVLKSYKQLGRAKTLKFFSLAGTHLGFRFDDSVVEYMADFLGRRKLFDDIKCLFNTMSFHKGRVSPKALSICI

SEQ ID NO: 109318 - protein, 944 aa, Glycine max
  Coding DNA Sequence Number=SeqID_17633
  Homolog annotation: Hit_ID=A7PAS7; Match level="QueryCoverage=99%, HitCoverage=99%, E-value=1e-170, Identity=40%"; Hit description =Chromosome chr14 scaffold_9, whole genome shotgun sequence
MNDSTVKNLAITEKKVQQHKPGGCVGIFFQLIDWKRKLSKKKLFSKKLLPPARAKKFKGDEKMPNSKLHLIANENSGGFPGAKKVGNHGLDVEQKSEMRVPSLVARLMGLESIPAAQRDKSKKALCADGKKESLGDHCELDRQGVDLEMGVVKHDSRPQKLQKTGSYERRAVTRFGAEALQIKSVLSRARKYNHHHHQKLASLRTPRIPSGKSASRSSRLIGAATKILEPGLQSRSRAKNSLTYPASMYPPKTGIVTNGVEDGSAIMQNQSCFETSSCKQLMGQTSCKNCGNLLDVLDCKLEVGRQSLVPPPIVSDVITATSMVSLEKKGKSFPPHGHERDVVLPRSQEKLISLVTEGKGKNNAQQSWSEPTARRMPMPHDGPAKWNSSCQPSRALEDDASSFALKHKTQTQEQMLSSERYSSGSTTSDMQVKRVSSSMSAVNGTKDFVAMNRSLSGRSRIRSLTKADGSKFDLEKKPYNRQQSSLSHVRTLERKRRIPNVTQLEGTGSVYSVGTKQRNLHSGGMGGKRRDFNASSLNNSIVKNKQDGQGERVIKVNDNKINDVVSFTFNSSLKQKIEIPGKREETSSDNESMVYFQRPSPLRVDALGAFLEQKLMELTSQRDEELATGAPPKKSSAMILQELISALSSEHLICHDGHHMFNENVCFHFLEKGHVQLISVTAVIPDIVFPSFFTSMEQNKKGHGFHPDPMNYSYYGQPEHDTELSDSATSFNKGRMDEILSDVVNQIPRALESLLTFGTELTRSKLNHMKDILLNSELVLRIATDRREDQGPQLLIYQFLVDDLDSMVSDAMWTDANGIVGCEDSKQRKELKGFLLDCVIEYLESNCCQYFNSGFKKWTKLPLCMEAEMLAQEVKREINKWLSMVGMVPDEIIEWEMSHSLGKWTDFDIEAFEAGVDIDGDILQILVDEVVQDLQVASRGTIYF

SEQ ID NO: 109319 - protein, 124 aa, Glycine max
  Coding DNA Sequence Number=SeqID_17634
  Gene Ontology: Mol. function=helicase activity
  Homolog annotation: Hit_ID=A2Q378; Match level="QueryCoverage=70%, HitCoverage=5%, E-value=2e-17, Identity=47%"; Hit description =Putative uncharacterized protein
MVHGSCGILQSKSPCYDRVTVVIYDANDALENPITQNDEIKEYVDCRYISPCEATWRIFGFPIHARKPAVERLHFHLPGQHNVLYEDDDDIDDILSKPSISDSKFLAWMNSNKCFSEGRNLTYS

SEQ ID NO: 109320 - protein, 447 aa, Glycine max
  Coding DNA Sequence Number=SeqID_17635
  Gene Ontology: Mol. function=voltage-gated chloride channel activity; Cellular component=integral to membrane; Biological process=chloride transport
  Homolog annotation: Hit_ID=A5B8N3; Match level="QueryCoverage=30%, HitCoverage=11%, E-value=6e-25, Identity=43%"; Hit description =Putative uncharacterized protein
  Pfam annotation: Domain name=CBS; Domain location=255-354; Score =21.7; E_value=0.00041; Accession=PF00571.19; Description=CBS domain
GTSFVVLVEGTSTWVVVTENKRGYISCGSVQVEDTSTWLLQREQGRVHPLWIFACKGFYKVEKKSQGPQGAWGLDALWGEVSACLNWASCLTCASRPWSLLCTFRACVRLDGLLSRIWTFLPSICNPWLTRAARPCYRIFDLDGRAPKFVHEFSEELVVCLWQNVQGDQGYAVKHVGGILRTESFDEGVKTVYGPRQKSTVPEISSRSSIESSAGNTFAEDVSYLSNLCQVESSLRVEDDNIETTYFVRRTFVSEAMKMRYVVVSMCTPLIEVIDLMLAEKQSCVVIVDTDDTLIGFLTLRDIQEYATPDTELHYAQMIMKKRRFNHVPVVRNIYERTYPVGIIDPESISLTCRIEKFNGKNSFNLWRIKKHALLKEQRVWAPVAFASVKKEVAFESKEKASVSKTEELAEQEEKAHSLILLSLSDEVLYEVANEETASGLWLKLEK

SEQ ID NO: 109321 - protein, 797 aa, Glycine max
  Coding DNA Sequence Number=SeqID_17636
  Homolog annotation: Hit_ID=A2Q4W6; Match level="QueryCoverage=31%, HitCoverage=40%, E-value=6e-09, Identity=22%"; Hit description=RNA -binding region RNP-1
  Pfam annotation: Domain name=DUF1777; Domain location=2-207; Score= -78.0; E_value=0.034; Accession=PF08648.3; Description=Protein of unknown function (DUF1777)
  Pfam annotation: Domain name=RRM_1; Domain location=158-228; Score =23.1; E_value=0.001; Accession=PF00076.13; Description=RNA recognition motif. (a.k.a. RRM, RB
  Pfam module annotation: Pfam domain module=DUF1777::RRM_1; Domain location=2-207::158-228
MMREREKHVREREKESQGERQALCRGRAPERGRARLLERQRGSLRNREPARDRSYDNNSIHRRSRERGRDRDRRYVEYLPRCRSISRKTRQDETYGSSKGGNQEHNRQDAEPDQEVWTKVTRRREAKAAKKNYTQNRSLHNLSANHPSWRDKEDITSFYFTNFTDNVNEVRLWGKFKSWGDVREVFIAKRRNKEGRRFGFVRFKDVSDVKLLETHLDNIFIDDHKLFVNLPRFTRLASNAHTHTKVDKKEKQSKEAVKDSQATNRPRVRSYVEVVVQKGGLGGTTTAVDGIPTITIVPNKGREVWCEGAWVGRLKKPMQAEKMEDYISWELGYSISARSLGDDIVLITGLSADKAQQLINSETNGGNTLFYSLERWRPGYRVSNRIVWLQVWGFPIEAWEVDHMKQVVSTIGDVIEVDEDTEDRRRLDRARLLVRTPLPPAIIKETIVRCGEEDHRVWLVEEVGDGGDMRRTRSSMSGEWTEEVTSEEEGVAEEDDDGDTAFSFSPELAVTNNNFFLNHQSKVLPSGPCGQTRDRSEPVGKSPNPDSCRLNAGGAARHSQGPTLTKVDQGYVCAEEMQGNLSPVVITSEPELDVLRKSEEDQNGKVSNSEEPIGQQCITHGDYKTCATDRGDFYDTGHIQGQKNVGPSSTSGLITNLEECIKKKHLTMTQTASRNMDGFPKVYARQRNGPLKGCLLKPVAEENTLDMEDKAAPDPKDSLTKGPLGRNRGEMKGEAEEVNSVDGNPLEDLEDANQQWTLAKSLGLQHASDQEGIHSFKNMETRDRKEALQLGNRSIHK

SEQ ID NO: 109322 - protein, 162 aa, Glycine max
  Coding DNA Sequence Number=SeqID_17637
  Subcellular localization annotation: CTP_CleavageSite=39; ConfidenceScore=5.12e-01
MASASTSAPPPPPPLPRNDGSLLGSSTVITAKEFLYSISQKLNNSNYLLWCQQQQDQPLLSWLQSTISGEAIPVRIQGIGLESQESQFDDESNDFGLAGHDSKPGFLIHDLYPDSTTMFRTDATFIPNKVPLISSKGTAAARRATAKAIAKAGSSDKGNLKP

SEQ ID NO: 109323 - protein, 185 aa, Glycine max
  Coding DNA Sequence Number=SeqID_17638
MEKLTLAMKIEIVLILVIQHKERQAKKNTDIDQSQKVEQTIDCINNPGNSFLQDLQTGERRKRSIEKIRLDVIHQVLGWVAPAFGLLVHVLNGTFRAWFLIPNKEPITHAILKCLTVQLIWFASYLGIRIELLDHLSFADWSYQYFQLGEDELLDHIVAIAWAIWKRRNCWVFNNKEIHFVQVLA

SEQ ID NO: 109324 - protein, 196 aa, Glycine max
  Coding DNA Sequence Number=SeqID_17639
  Gene Ontology: Biological process=sorocarp development
  Homolog annotation: Hit_ID=A7QA70; Match level="QueryCoverage=73%, HitCoverage=14%, E-value=2e-64, Identity=79%"; Hit description =Chromosome undetermined scaffold_69, whole genome shotgun sequence
MRGCIGKNSSFILARDKAKIEFRNEGQPSPHELAFGVELGRHVHSRSVLEVPVFWFIYSEPLLLDKYFQAKALSDMIIVVQSEPSSWESHLHCNGHSLLLNLRQPIKAAVAATAEHLAGLLPLHLVYGQAHETAIEDWLWSVGCNPFSITSQGWHLSQFQSDSIARSYVITTLEESIQLLEVAAGKGLQKSYWKDL

SEQ ID NO: 109325 - protein, 57 aa, Glycine max
  Coding DNA Sequence Number=SeqID_17640
MSLLSYQKPGEKAFCSAECRETHISISNDDHQDVVKCRSRVVEHNPVTLTSSILAAA

SEQ ID NO: 109326 - protein, 650 aa, Glycine max
  Coding DNA Sequence Number=SeqID_17641
  Pfam annotation: Domain name=RRM_1; Domain location=220-290; Score =16.6; E_value=0.0043; Accession=PF00076.13; Description=RNA recognition motif. (a.k.a. RRM, RB
MPAYAKFMKKVLTKKKNIEKDNIEVLVKTSTTTDRCTIIRGMRNKGRALPDRRGKVSKSMQCGETQQLLLNHVIDYSAIKQSSLPRYVYMSAFSNLMFVKGGFGLGTATEQHCLGAGAVVGCANEFFAGDKGSFVKVMTEEADPKLDEAIAKEQLNTTKRSQTAKKDHWRNRSTPEIEKKERYSESWREDSHQNHAGIRNGHKPSYNRVNWRGWNDIISFYFTRFPKEATVKDLWHHFKKFGDVREVFISKNRNKNGRRYGFARFKGVEDVHSLEKKLDDIVYGGLKMGEEAIRLRQLQPKSNKGSYVEVVSGNKSGTGSRRPVGSEIRSYEGSWSSVYLDVPETEFTRVKEAWVGRLKNLAMFDKVEDDLYWDDGEDVVPNQADDRGRTVRGATPFYSLEKWSPKLCTGYRLTWVNCWGIPLLAWDTKQISKIMAAIGDLVDVDDDVKVVRRLDRTRVLLKTSRRPLKQHIVNVHIHGEMHSVHIVEEGRSNPERGHCRRWCEYGSSEEIQTIDSDKDDECDFTMALRNAEVQPLSNEALPEGGSSYVPGQLPNRREMMLAAEQEASPTMDAAVNSTEQDSTVYEAKEEELAAAAKEEEVEALPSGTVLHATTQLSTEQRIISNHKTTALPSGFLAQRLMKYVRADKRA

SEQ ID NO: 109327 - protein, 1633 aa, Glycine max
  Coding DNA Sequence Number=SeqID_17642
  Gene Ontology: Mol. function=transferase activity, transferring nitrogenous groups; Cellular component=mitochondrion; Biological process=biosynthetic process
  Homolog annotation: Hit_ID=Q9SEJ6; Match level="QueryCoverage=25%, HitCoverage=91%, E-value=0.0, Identity=83%"; Hit description=1 -aminocyclopropane-1-carboxylate synthase 5
  Pfam annotation: Domain name=Aminotran_1_2; Domain location=48-429; Score=355.7; E_value=7.6e-104; Accession=PF00155.12; Description =Aminotransferase class I and II
  Pfam annotation: Domain name=Beta_elim_lyase; Domain location=97-352; Score=-132.2; E_value=0.1; Accession=PF01212.12; Description=Beta -eliminating lyase
  Pfam annotation: Domain name=DUF292; Domain location=590-711; Score =256.5; E_value=5.6e-74; Accession=PF03398.5; Description=Eukaryotic protein of unknown function, DUF292
  Pfam module annotation: Pfam domain module=Aminotran_1_2::Beta_elim _lyase::DUF292; Domain location=48-429::97-352::590-711
MGIEMEQPCVELSKVAVSETHGEDSPYFAGWKAYDENPYAELTNPSGVIQMGLAENQVSFDLLEKYLEEHSEASTWGKGAPGFRENALFQDYHGLKTFRTAMASFMEQVRGGRAKFDPQRVVLTAGATAANELLTFILANPGDALLVPTPYYPGFDRDLRWRTGVNIVPIHCDSSNNFQITPEALEAAYKDAEAMNSKVRGVLITNPSNPLGVTIPLSVLEEILDFVTRKNIHLVSDEIYSGSVFSSSEFFTSVAEVLEARQYRNAERVHIVYSLSKDLGLPGFRVGTIYSYNDKVVTTARRMSSFTLISSQTQHLLASMLSDKEFTENYIKTNRERLRKRNQMIIEGLRSAGIECLKGNAGLFCWMNLSPLLEKNKPKGREGELELWNAILHQVKLNISPGSSCHCSEPVVKLCLGDLLVMDSNLETASLHMQGASPGAAVKLCLGDLLVMGSNPETASLHLQGSTIDHPFLLILPTNMSRAAASFGILLCLFLAAAAVVNCSDQANCSTTCIAEQCDTVGIKYGKYCGVGYWGCAGEKPCDDLDACCMAHDDCVDKFGVSLQQSCTYDDKRHGLGHLAKPIGKTTLKLAVSRIKLLKNKREAQIKQLKRELAQLLESGQDRTARIRVEHVVREEKTMAAYDLVEIYCELIAARLPMIESQKNCPIDLKEAVSSVIFASPRCSDLPELMDVKKQITSKYGKEFVSAAIELRPDCGLVEKLSAKAPDGPTKIKILAAIAEEHNIKWEPKSLGENDVKSSQDFLVGPSTSEKVAYAEPSQIHVPPAHDEKGPSNLHAPSQVKPVHHSSTNSYEQTASGAARKDQSTTSGVSNSEVGSSGTGSQETKFQDSYSGNNSSFPMNRQNWSMEFKDAASAAEAAAESAERASMAARAAAELSNRENMTRQYSSGSHSSSRSGLRDERSQEYTFHDDKNLSTSPVDASFHRSSSGMHNEQITATEQDNLVGPPNEYYRNSHENVVRHAQSASLMPGSVFNDDKPFTDGSQMADIYQHNNSFGQKSSDLPEMSIKTQAGRSEEDFVTDLYDDSDLNAENNYHFGDARTNRQSSKVSSSHFITPTDDHNDNLDLDDWNTRNKAVEDPFVTDEVNTQRNNMETSSYNDTTVVFDDSGSEDDDHKFDVDKKYNGEGSSLFVSSPASKSQVDPFENTNSLAYGQNIDEKVTSSGTQSHFSVVSERLTSAVSSEKEDLPSVTFDDSDDPGSDSDMNFVNKSKVSGLSDYGKFFLDPIASHGVPGSSSRNEKNVGTDRKSWLSPLSVDSDTVEEHFERRVDTTTVSEKNLGYDDLPASQPPTKERSSILGLDLEANNDTETLEEYHKESGKELSYGTLKGGLRNKGFKRPPYIKNTLDDVSSSLGDTSVQNEGSLPTARTSIGSDARVQDKYTREVSRGNRNVGLGAHKIPSDSDSYRVVANSQETLASTNEPRIQKEQREVKKKSSSRASVTYFGSDNSDSEDELTKQNSPSLARPISGISRRTSASSKAATGLSSRDAPLSKASVTSAATLGWKSSRTSYESNNQNASTIMKSSENGTGSKPGSAKNKASEPISEPNRSLDGEISKSSARVQPFSSPKTVIQDNEEAQEVDGDTSSKQKVGHVHPKLPDYDSFAAHFLSLKKGRQ

SEQ ID NO: 109328 - protein, 278 aa, Glycine max
  Coding DNA Sequence Number=SeqID_17643
  Gene Ontology: Mol. function=nucleic acid binding; Cellular component= nucleus; Biological process=regulation of transcription
  Homolog annotation: Hit_ID=Q0PJG7; Match level="QueryCoverage=93%, HitCoverage=94%, E-value=1e-125, Identity=87%"; Hit description=MYB transcription factor MYB129
  Pfam annotation: Domain name=Myb_DNA-binding; Domain location=95-142; Score=47.5; E_value=4.7e-11; Accession=PF00249.22; Description=Myb -like DNA-binding domain
  Pfam annotation: Domain name=zf-CCHC; Domain location=3-20; Score =15.9; E_value=0.0059; Accession=PF00098.14; Description=Zinc knuckle
  Pfam module annotation: Pfam domain module=Myb_DNA-binding::zf-CCHC; Domain location=95-142::3-20
  Subcellular localization annotation: CTP_CleavageSite=87; ConfidenceScore=5.67e-01
MGRKCSHCGNIGHNSRTCASFRATNFVGVRLFGVQLADISSTSSNSLSMKKSFSMDSFPSSSSPSSSFSSSRTSIGYLSDSDGLIVGAQEIRKKGVPWTEEEHRTFLVGLEKLGKGDWRGISRNYVTSRTPTQVASHAQKYFIRLATMNKKKRRSSLFDMVGNGITNPISSSNCKSSKCEIEDDVTLSLVQLQDTKLDEQKDSDKYCEAGPAGAEHEAVPLWLHLQMKSSNNNVAAVVPDLELTLAVSKGKAKTLLGLEQTQTKSSPDSFLLGPISVT

SEQ ID NO: 109329 - protein, 166 aa, Glycine max
  Coding DNA Sequence Number=SeqID_17644
MEDDLERSMEARAIGCRGGRGTHGRDMEASEGGGGVEGRRSVEVGMVQVLMCGSNLGSMYPGMEILKMKDLKQLIDELTFQVRIAQMLLCSLWRRRNDKLWENMVVSDSSVVQRGDDFLQAWVNAKMKSNSGQLQTDQHPSVVFTIILGVPTRGHCVIFKREKLGL

SEQ ID NO: 109330 - protein, 247 aa, Glycine max
  Coding DNA Sequence Number=SeqID_17645
  Gene Ontology: Mol. function=molecular_function; Cellular component =cytoplasm; Biological process=multicellular organismal development
  Homolog annotation: Hit_ID=A7PEA8; Match level="QueryCoverage=100%, HitCoverage=69%, E-value=1e-114, Identity=79%"; Hit description =Chromosome chr11 scaffold_13, whole genome shotgun sequence
  Pfam annotation: Domain name=Abhydrolase_1; Domain location=21-243; Score=-4.9; E_value=0.013; Accession=PF00561.11; Description =alphabeta hydrolase fold
  Pfam annotation: Domain name=Ndr; Domain location=1-247; Score=333.3; E_value=4.4e-97; Accession=PF03096.5; Description=Ndr family
  Pfam module annotation: Pfam domain module=Abhydrolase_1::Ndr; Domain location=21-243::1-247
MSCFQGLFFCPEAASLLLHNFCIYHISPPGNELGAAAICPDDPVPSAEDLADQIIEDLNYFRLGAVMCMGISSGAYILSLFATKYRERVLGLILVSPFCKSPSWTEWFYNKVMSNLLYFYGVCGLLKECLLQRYFSKEVRDNAEFPESEIVQASRKLLDERKGINVFRFLQQLVRRRPDIMEGLKRLKCGTLIFLGDSSPFHSEALHMTSKLARRYTALVEVQGCGSMVTEEQPHAMLVPMEYFLMG

SEQ ID NO: 109331 - protein, 162 aa, Glycine max
  Coding DNA Sequence Number=SeqID_17646
  Gene Ontology: Cellular component=endoplasmic reticulum
  Homolog annotation: Hit_ID=A7PEB2; Match level="QueryCoverage=69%, HitCoverage=37%, E-value=3e-49, Identity=80%"; Hit description =Chromosome chr11 scaffold_13, whole genome shotgun sequence
MKMKGVLWVVVVSVVVAAWIPLSHCSKKPVGVARKEDIPYIKCQVCEKLAKELYQQVQNKQAEIAPKKISEYQIIEIAENVCNLKKVEADWILRIDIVEKEDRLELVEQDSEGQCNSECKTIERACQEKDEIPSSMEMIGRGVSNAVLIRISGCTKDKSTLS

SEQ ID NO: 109332 - protein, 456 aa, Glycine max
  Coding DNA Sequence Number=SeqID_17647
  Gene Ontology: Mol. function=methyltransferase activity; Biological process=metabolic process
  Homolog annotation: Hit_ID=A7PE95; Match level="QueryCoverage=41%, HitCoverage=60%, E-value=1e-103, Identity=94%"; Hit description =Chromosome chr11 scaffold_13, whole genome shotgun sequence
  Pfam annotation: Domain name=Methyltransf_11; Domain location=300 -390; Score=34.8; E_value=3.1e-07; Accession=PF08241.3; Description =Methyltransferase domain
  Pfam annotation: Domain name=PRA1; Domain location=28-179; Score =184.9; E_value=2.1e-52; Accession=PF03208.10; Description=PRA1 family protein
  Pfam module annotation: Pfam domain module=Methyltransf_11::PRA1; Domain location=300-390::28-179
MTTYGTISEEAEPSSNSNSVFVSQAKEHIQGGLGTRRPWREMLQTSHFKFPSSFFGAIQRINTNAKHFRANYVIIILLVLFLSLLGHPISLIILIVMMIAWLYLYFLRDTPLVILRFEIDERLVVISLLLITIGLLVLTNVTYNVIVGICVALVIVLVHAMIRETEDLFTMDEDVGVMKGLRDIVKVPLRQPVKCERMTNFVGLRLHTRLSLPLPLPVLGGASHSCSATATTLSRAVIRKWNWGIKGPRRMVLGLGLGVSFLSMAAPRFVTHIDDPAIAALTKYYSKVFPPSNTPGVSILDMCSSWVSHFPSGYKQERVVGLGMNEEELKRNPVLTEYAVQDLNVNPKLPFEDNSFDLITNVVSVDYLTKPLDVFKEMCRILKPGGLAIMSFSNRCFWTKAISIWTSTGDADHVMIVGSYFHYAGGFEPPQAVDISPNPGRSDPMYIVYSRKLSTA

SEQ ID NO: 109333 - protein, 443 aa, Glycine max
  Coding DNA Sequence Number=SeqID_17648
  Gene Ontology: Mol. function=DNA binding; Cellular component=nucleus; Biological process=regulation of transcription
  Homolog annotation: Hit_ID=A5BJQ5; Match level="QueryCoverage=92%, HitCoverage=91%, E-value=1e-168, Identity=72%"; Hit description =Putative uncharacterized protein
  Pfam annotation: Domain name=NAM; Domain location=47-190; Score =184.3; E_value=3.1e-52; Accession=PF02365.6; Description=No apical meristem (NAM) protein
MSKISNLSSVSSSDLIDAKLEEHQLCGSKQCPGCGHKFEGKPDWLGLPAGVKFDPTDQELIEHLEAKVEAKNMKSHPLIDEFIPTIEGEDGICYTHPEKLPGVTRDGLSRHFFHRPSKAYTTGTRKRRKIQNECDLQGGETRWHKTGKTRPVMVNGKQKGCKKILVLYTNFGKNRKPEKTNWVMHQYHLGQHEEEKEGELVVSKIFYQTQPRQCNWSDRSATTGEGSGEPNNSGRRDSGSGSCSSKEIVTHRDEMSAVVGVPPMTSFTHHHPLDIQQLKPDHFSFIPFRKSFDERMQVGIGEASTAREVMQASGSCEEVHERHLAQVTPHHHQLQQHAHHHQISNSAFHISRPSHPISTIISPPPLHHTSIILDDNSYHVSRIMLQNENFQQQQQQHHKLGGRSASGLEELIMGCTSTEIKEEKRPLTFDTFDHDRGGKTSTS

SEQ ID NO: 109334 - protein, 640 aa, Glycine max
  Coding DNA Sequence Number=SeqID_17649
  Gene Ontology: Mol. function=aminoacyl-tRNA ligase activity; Cellular component=mitochondrion; Biological process=embryonic development ending in seed dormancy
  Homolog annotation: Hit_ID=A7PEF7; Match level="QueryCoverage=74%, HitCoverage=82%, E-value=1e-110, Identity=66%"; Hit description =Chromosome chr11 scaffold_13, whole genome shotgun sequence
  Pfam annotation: Domain name=Arg_tRNA_synt_N; Domain location=81-173; Score=59.1; E_value=1.5e-14; Accession=PF03485.7; Description=Arginyl tRNA synthetase N terminal do
  Pfam annotation: Domain name=tRNA-synt_1d; Domain location=185-594; Score=184.9; E_value=2.1e-52; Accession=PF00750.10; Description=tRNA synthetases class I (R)
  Pfam module annotation: Pfam domain module=Arg_tRNA_synt_N::tRNA-synt_ 1d; Domain location=81-173::185-594
  Subcellular localization annotation: CTP_CleavageSite=92; ConfidenceScore=5.65e-01
MVCTLLSGGGPLVIFSGGCLNLNRFSHFPSPPSLPSSRSDLLKVASRRFALSVTKTQQSPVTKPQSTSTAIIANNPASVKRQLAQLFDLSLRATVPDEPDVVPLIDACAVKGGVKFGDYQCNNAMGIWSKMKGKQTGFRGPPAIGQAIVNNLPPSEMIDSCSVAGPGFVNVVLSKKWIAEGEYVKVKRMLIDGINSWAPRLPVKRALIDFSSPNIAKEMHVGHLRSTIIGDTLARMLEFSRVECVIRRNHVGDWGTQFGMLITNLFEKFPNPDDVSEADIGDLQDYLPKHVMPPPIRNPEHVLHKTQWLAIFALFGACSLFAPPHFRSECVLSHMLIGEAVMMLFRSEFVRDGSGNIVEIRAFYKASKVRFDSDPEFKLRAQQAVVRLQSGEIKYRKAWKQICDVSRAEFDKVYQRLGVQLEERGESFYNPYIPGVLEKLDNLGLIEESDGARVIYVEGVDIPLIAVKRDDIGQQQHFDMLFKAYRRAGWLPKDENAYPKCTHIGFGLVLGEDGKRFRTRSSEVVRLVDLLDEAKRRCKIAILERGEAPVLFLLLPSKDWSEEEIEKTSEAIGYGAVKYADLKINRLTNYTFNFDQMLNDKGNTAVYLLYAHARICSIIRKSGKDIEEVKRVSLASFLPG

SEQ ID NO: 109335 - protein, 128 aa, Glycine max
  Coding DNA Sequence Number=SeqID_17650
  Gene Ontology: Mol. function=DNA-directed RNA polymerase activity; Cellular component=membrane; Biological process=transcription
  Homolog annotation: Hit_ID=A7QMF0; Match level="QueryCoverage=96%, HitCoverage=10%, E-value=2e-37, Identity=63%"; Hit description=DNA -directed RNA polymerase
MGITASVTSSTEKIKTKTVIVMENEKLWLQLNKFPKKVPLMVVMKAMGMESDQEVIQMVGRDPRYSFLLLPSIEECRKCKVYTKEQALEYLDKLVKRPTYSSNSAEKEGAAFSALRDVFLANVPVRLL

SEQ ID NO: 109336 - protein, 57 aa, Glycine max
  Coding DNA Sequence Number=SeqID_17651
MNEAKNIKDFMTTIEDNNTWQLVDKLEDKNSIGVLYFMHCIYELLSLLGRSNYCSVL

SEQ ID NO: 109337 - protein, 259 aa, Glycine max
  Coding DNA Sequence Number=SeqID_17652
  Homolog annotation: Hit_ID=A7P7X6; Match level="QueryCoverage=48%, HitCoverage=64%, E-value=3e-39, Identity=61%"; Hit description =Chromosome chr3 scaffold_8, whole genome shotgun sequence
MTTESGGNNWRHQQRVVNGTRRSETQRRRGRTNNIIEIKRRHGNLQRKKRELMMEVTKDEAATPGSGGAQPPNPISNGNPNPNPNPNPNMPHTPRGSKGKSCKGCTYYTSLHKAKSKNPTCVGFSRALQQVPPFVVGETELEASKEGRSLANFKYACIGYSVYLDNKDSSAGSQDKTAKLPFCVGLEVVLVEKASNSDAGHVPATHKTDDEHAAPQPRRYIPPNHATEFLNRQVEVFSIVNSCSFKEMQAWWHLVLPKT

SEQ ID NO: 109338 - protein, 117 aa, Glycine max
  Coding DNA Sequence Number=SeqID_17653
  Gene Ontology: Mol. function=receptor activity; Cellular component =photosystem II; Biological process=photosynthesis
  Homolog annotation: Hit_ID=A5JVZ6; Match level="QueryCoverage=49%, HitCoverage=14%, E-value=3e-14, Identity=68%"; Hit description =Plastid high chlorophyll fluorescence 136 precursor
MQDTLYLENIEERETGGTPPIIQTVRAWDLVKSTPKEKQKKQERDDGMNNGFVSFGISGASYFTGTFTTVDRSTDGRYVVVSSRGNFYLTWESGQVVEASQDFVPLILRQVFTNNKK

SEQ ID NO: 109339 - protein, 340 aa, Glycine max
  Coding DNA Sequence Number=SeqID_17654
  Homolog annotation: Hit_ID=A5BWY3; Match level="QueryCoverage=31%, HitCoverage=61%, E-value=2e-09, Identity=31%"; Hit description =Putative uncharacterized protein
VPKALSKQLPIDQQLECDEPEVALLELSHEPEVCYLVNSNRRSNTLRGVFVNGVWIDESRRVKEEICLFFKNRFQEEEWVRPKLDGVSFKAIGQQDNDRLLELFTEKEIKNAVDVLCLMNEFFVHETLPKGCNASFIALIPKGQNGLMREAMEKNLFQGFLVGRNEVEVLYCVFMASAPSNSVSQSFSNSIAEKLDDSNYLHWRQHVEPVIKSHKLQQFAINPIVPPRYLTEDDHITDRVNPEVLGSNHSYEVLNKIHEYISLHTKSHGRQLCYAMRAVSLDEKLIEEYLRKIKGYVDELVGVGVPVRHEEYVDALLELVGVGVPVRHEELEAYSLHCRN

SEQ ID NO: 109340 - protein, 96 aa, Glycine max
  Coding DNA Sequence Number=SeqID_17655
MLTSNLVLLVKHSTAHLDKSLTNKQPQLLAIRARGSCDLNCLRYMNEDLKHRRRHRIELKAYRLSLNAPYALSVTRSLSGLSSLNAKKPLCESDVT

SEQ ID NO: 109341 - protein, 448 aa, Glycine max
  Coding DNA Sequence Number=SeqID_17656
  Gene Ontology: Mol. function=transferase activity; Cellular component= mitochondrial outer membrane; Biological process=glycolysis
  Homolog annotation: Hit_ID=Q9FVD3; Match level="QueryCoverage=90%, HitCoverage=82%, E-value=0.0, Identity=79%"; Hit description =Hexokinase
  Pfam annotation: Domain name=Hexokinase_1; Domain location=9-193; Score=134.6; E_value=2.9e-37; Accession=PF00349.12; Description =Hexokinase
  Pfam annotation: Domain name=Hexokinase_2; Domain location=196-441; Score=287.9; E_value=2e-83; Accession=PF03727.7; Description =Hexokinase
  Pfam module annotation: Pfam domain module=Hexokinase_1::Hexokinase _2; Domain location=9-193::196-441
MNDDLAVGRYFLQGGYDTVVNVPLDDNSLVVHKALDFFVVCSGDEKGLFYALDLGGTNFRTLRVHLGGKEKGVVKIESDEVSIPPHLMTGSSQELFDFIASKLAKFVSSEPEELHPPPGRQRELGFTFSFPVRQTSIASGNIIKWTKGFNIEDAVGEDVVGELTKSLEKIGLDMHVAALVNDTVGTVARARFSNQDVIAGVILGTGTNAAYVECAHAIPKWHGLLPKSGEMVINMEWGNFRSSHLPLTEYDHALDAESLNPGEQIFEKIISGMYLGEIVRRVLLKLAEEVDFFGDTVPPKLRIPFVLRTPDMSAIHQDTSSDLKVVGNKLKDILEINNTSLKMRKIVVELCDIVANRGARLSAAGIFGILKKIGRDTVKDGKKSVVALDGGLFEHYTKFRSSLESTLKELLGDEAAETIGIEQSNDGSGIGAALLAASHSQYLEVQES

SEQ ID NO: 109342 - protein, 875 aa, Glycine max
  Coding DNA Sequence Number=SeqID_17657
  Gene Ontology: Mol. function=methyltransferase activity; Cellular component=chromatin; Biological process=chromatin assembly or disassembly
  Homolog annotation: Hit_ID=A7P020; Match level="QueryCoverage=90%, HitCoverage=81%, E-value=0.0, Identity=62%"; Hit description =Cytosine-specific methyltransferase
  Pfam annotation: Domain name=BAH; Domain location=132-245; Score =44.1; E_value=5e-10; Accession=PF01426.9; Description=BAH domain
  Pfam annotation: Domain name=Chromo; Domain location=413-469; Score =56.4; E_value=9.8e-14; Accession=PF00385.15; Description='chromo' (CHRromatin Organisation MOdi
  Pfam annotation: Domain name=DNA_methylase; Domain location=295-839; Score=32.8; E_value=2.6e-14; Accession=PF00145.8; Description=C-5 cytosine-specific DNA methylase
  Pfam module annotation: Pfam domain module=BAH::Chromo::DNA _methylase; Domain location=132-245::413-469::295-839
  Subcellular localization annotation: CTP_CleavageSite=45; ConfidenceScore=5.63e-01
MPSKRKTRSSASPAAAPPSKRASRSSASRVADSAPVKSEAEEVVAASSVVKEEAQASFTDVTDGNVSDGEGTNARFVGEPVPDEEARRRWPKRYQEKEKKQSAGPKSNRNDEDEEIQQARRHYTQAEVDGCMLYKLYDDAHVKAEEGEDNYICKIVEIFEAIDGALYFTAQWYYRAKDTVIKKLAYLIEPKRVFFSEVQDDNPLDCLVEKLNIARITLNVDLEAKKETIPPCDYYCDTQYLLPYSTFVNLPSENGESGSETSSTISSETNGIGKYEVNSQPKEAFLPEESKDPEMKLLDLYCGCGAMSTGLCLGGNLSGVNLVTRWAVDLNQHACECLKLNHPETEVRNESAENFLSLLKEWQELCSYFSLVEKKVSHEKYVNLFSEDDDDTSSNEEVNSEDDNELNEDDEIFEVSEILAVCYGDPNKKKEQGLYFKVHWKGYESALDSWEPIEGLSNCKEKIKEFVSRGFKSQILPLPGDVDVICGGPPCQGISGFNRFRNKESPLDDEKNKQLVVFMDIVQYLKPKFTLMENVVDLVKFAEGFLGRYALGRLLQMNYQARLGIMAAGAYGLPQFRLRVFLWGAAPSQKLPQFPLPTHDVIVRGVIPLEFEINTVAYNEGQKVQLQKKLLLEDAISDLPRVQNNERRDEIKYDKAAQTEFQRFIRLSKHEMLELQSRTKSSKSLLYDHRPLELNADDYQRVCRIPKKKGGCFRDLPGVRVGADNKVEWDPDVERVYLDSGKPLVPDYAMTFVNGTSSKPFARLWWDETVPTVVTRAEPHNQAILHPEQDRVLTIRENARLQGFPDFYKLCGPVKERYIQVGNAVAVPVARALGYTLGLAFEGSTSTSDDPLYKLPDKFPMIRDRVSSVSSEDDV

SEQ ID NO: 109343 - protein, 155 aa, Glycine max
  Coding DNA Sequence Number=SeqID_17658
  Gene Ontology: Mol. function=signal transducer activity; Biological process=signal transduction
  Homolog annotation: Hit_ID=A7PEH5; Match level="QueryCoverage=94%, HitCoverage=97%, E-value=6e-18, Identity=36%"; Hit description =Chromosome chr11 scaffold_13, whole genome shotgun sequence
  Pfam annotation: Domain name=Hpt; Domain location=46-133; Score=22.0; E_value=0.0022; Accession=PF01627.14; Description=Hpt domain
MESSDEMHSKIITMKQSFFDEGFLIPTQFQELELLQDRDNMNFVRDVFCLFFTDMTRQFSEIEQILREEIDGQPREDMNRLLQRLKGSVLSIGALKILNGVNKMIQLFEEGNLERIMAAFEQVKMESVNLRAKVEPYFQLLESQAESFTESQAPK

SEQ ID NO: 109344 - protein, 587 aa, Glycine max
  Coding DNA Sequence Number=SeqID_17659
  Gene Ontology: Mol. function=oxidoreductase activity, acting on the CH-OH group of donors, NAD or NADP as acceptor; Cellular component =cytoplasm; Biological process=malate metabolic process
  Homolog annotation: Hit_ID=P34105; Match level="QueryCoverage=100%, HitCoverage=100%, E-value=0.0, Identity=79%"; Hit description=NADP -dependent malic enzyme
  Pfam annotation: Domain name=Malic_M; Domain location=303-556; Score =450.7; E_value=2e-132; Accession=PF03949.6; Description=Malic enzyme, NAD binding domain
  Pfam annotation: Domain name=malic; Domain location=103-301; Score =392.4; E_value=7e-115; Accession=PF00390.10; Description=Malic enzyme, N-terminal domain
  Pfam module annotation: Pfam domain module=Malic_M::malic; Domain location=303-556::103-301
MESTLKALRDGESVLDLSPRSTVSGGVEDVYGEDHATEDQLVTPWNFSVASGYCLLRDPQYNKGLAFTEKERDAHYLRGLLPPTITSQQLQGKQLINNIRQYQETNERLFYKLLIDNVEELLPIVYTPVVGEACQKYGSIFKRPQGLFISLKEKVIKLLAFFRGKILEVLKNWPEKSIQVIVVTDGERILGLGDLGCQGMGIPVGKLALYTALGGVRPSACLPITIDVGTNNEKLLNDEFYIGLRQKRATGQEYSELLHEFMTAVKQNYGEKVLVQFEDFANHNAFELLAKYGTTHLVFNDDIQGTASVVLAGVVAALKLIGGTLADHTFLFLGAGEAGTGIAELIALEMSKQTKTPIEETRKKIWLVDSKGLIVGSRKASLQHFKQPWAHEHEPVGSLLEAVKVIKPTVLIGSSGVGKTFTKEVIEAVTSINEKPLVLALSNPTSQSECTAEEAYQWSEGRAIFASGSPFDPVEYKGKVYYSGQANNAYIFPGFGLGLVISGAIRVHDDMLLAASEALAKLVSNENYEKGLIYPPFSNIREISANIAASVAGKAYELGLATRLPRPQNLVKYAESCMYSPVYRNYR

SEQ ID NO: 109345 - protein, 60 aa, Glycine max
  Coding DNA Sequence Number=SeqID_17660
MTATEGKEEGGRGGGRRRKRKKKKCMRGGRGRKERKRKYKLRGKKVFNFPEYHVNLTSNT

SEQ ID NO: 109346 - protein, 96 aa, Glycine max
  Coding DNA Sequence Number=SeqID_17661
MVDLVMEERCEVEWMDFLNYGVGKCGHVQNGMMFNNKDMQVMDIIESVKNKSGKKVIGCGVITLTGDGVHDANDFAGGKLGGDYGVGFEKAGIKNI

SEQ ID NO: 109347 - protein, 159 aa, Glycine max
  Coding DNA Sequence Number=SeqID_17662
  Gene Ontology: Cellular component=chloroplast thylakoid membrane
  Homolog annotation: Hit_ID=A9JPD0; Match level="QueryCoverage=98%, HitCoverage=97%, E-value=2e-41, Identity=60%"; Hit description =Putative uncharacterized protein
MTKKGKKQLMSSAPWRGEESEESFKEGKLKVTRQGDGTSTMHVPASKSKHHHHDLHDDLGIEIDPELRYSFQRNFQVPIARKLGPPSIAIVGFWFLQFLQRVFSIDTMVKPLPPVMAYNVSRNLNFFTRIFTQFFDPEGIANAQKSLGIGQEDKVRKVR

SEQ ID NO: 109348 - protein, 97 aa, Glycine max
  Coding DNA Sequence Number=SeqID_17663
MWQGQGIYLWTFEGFRSAADKVDTADSDCWEFRSQLKSMKGYIILGEHRGKGNWGHASNNPDSESMGPVVQLKSTPKEKQKMQERDDGVIAARSDTD

SEQ ID NO: 109349 - protein, 248 aa, Glycine max
  Coding DNA Sequence Number=SeqID_17664
  Gene Ontology: Mol. function=triacylglycerol lipase activity; Biological process=lipid metabolic process
  Homolog annotation: Hit_ID=Q8W4L6; Match level="QueryCoverage=94%, HitCoverage=36%, E-value=1e-50, Identity=47%"; Hit description =Putative uncharacterized protein Z97340.15
  Pfam annotation: Domain name=Lipase_3; Domain location=144-248; Score= 43.6; E_value=6.9e-10; Accession=PF01764.16; Description=Lipase (class 3)
MEVKNEKKAPSVERRHIEAPKNLMEVVSILTEAIKSLGYKEKWHILNLPIAIASAVLDMGKKTVARECGERSDCVQLKAPEVIKELYEIKKLLTRTLLFSRKRFHGFLFAAGFDKEDVLLRKRTARILRPVFTVIRDIESKSVLVFIRGTRSLNDTLTAALCAPVSFEHRRNNNIVSGHAHRGMVAAAYWILDYCTPVLKKALDQYPHFKIKIVGHSLGGGTAALLTFKLREIQEFSSSTCVTFGPGM

SEQ ID NO: 109350 - protein, 518 aa, Glycine max
  Coding DNA Sequence Number=SeqID_17665
  Gene Ontology: Mol. function=triacylglycerol lipase activity; Biological process=lipid metabolic process
  Homolog annotation: Hit_ID=Q8W4L6; Match level="QueryCoverage=97%, HitCoverage=92%, E-value=2e-58, Identity=32%"; Hit description =Putative uncharacterized protein Z97340.15
  Pfam annotation: Domain name=Lipase_3; Domain location=136-238; Score= -10.2; E_value=0.0034; Accession=PF01764.16; Description=Lipase (class 3)
AAGKLEKRPAEAPKTLMDTVLTLAEAIRFGYAETLGKWHLLDLPRAILYSVMDKGKKTVAVECAERSDCVQLKDPELLKELYELKKCLTQTMLFSKKRFRAFLFAAGFVKEDVLLRKRRARPAFTVILNKESKCLLVFIRGTRSIKDTLTDAIGAPVSFSHFICSDGELKKRDTVSGHGHRGMVAAARWIKKHCTTILLDALRQYPDFQIKLAEFGKPFITSIINGYDIVPTLSGSSVHDFVAEGKIKRKKILNAARSSITAIGSRLPFASTAKAIADHAVTRGTQVVMKNKQKTRSLLPWSRREKTEALPSSKSDNLAEACGSSETSCGVVEEIKISDSTSDEYDESKSSSEESDNDDDIDEEEQIISAAQNVTTHTACDISENDLLNELKELELEAQDDNPKINAQEKEGAKTKDITEEEINDQVVDTKDKLDTHLYPPGRIMHIIPSPSSENNSNSSNHNSSEEKEVYLYETPRQLYGKLRLSRGMIIDHLTRNYLKVLQQLINQLEKEKSHYGG

SEQ ID NO: 109351 - protein, 515 aa, Glycine max
  Coding DNA Sequence Number=SeqID_17666
  Gene Ontology: Mol. function=triacylglycerol lipase activity; Cellular component=integral to membrane; Biological process=lipid metabolic process
  Homolog annotation: Hit_ID=Q8W4L6; Match level="QueryCoverage=98%, HitCoverage=83%, E-value=1e-74, Identity=36%"; Hit description =Putative uncharacterized protein Z97340.15
  Pfam annotation: Domain name=Lipase_3; Domain location=79-234; Score =82.2; E_value=1.6e-21; Accession=PF01764.16; Description=Lipase (class 3)
MECGERSDCVQLKDPKILDELYEIRKCLTRTMLFSKKRFRAFLLAAGIPKEDVLLRKKRARILKPAFTVIRDKESKCLLVFIRGTQSLKDTLTDAIGAPVSFNHFICSDDGELKRNNKVSGHGHRGMVAAARWIKKHCTTILLEDLRRHPDFQIKIVGHSLGGGTAVLLTYMLREIKQFSSCTCVTFGPGICRITSALCRSASVSLELAEFGKPFITSIINDSDIVPTLSAYSIHDFIFEGQIKHKKILNAARSAVVSRLPFASTAKAIADHAVTRGTQVVKKHKERTRLLLSLSQQPENVGALSSSKSDNLAEASRSTETSYEVSEEIIISESTSDEDESIFSSDDESQHDDTDEEEQIISAFQNITASTAASDEELLNQLEKLELEKHDDIPNIHVKENQEATTSIDVTEGEKKVVLVHAEESAGAVTASYNLEKHPLYPPGRIMHIVPAPSNSSENSNSDDYDPDEKYLYLYETPKQLYGKLRVSRRMILDHMTNKYLKMIQQLINQLENQS

SEQ ID NO: 109352 - protein, 172 aa, Glycine max
  Coding DNA Sequence Number=SeqID_17667
  Gene Ontology: Mol. function=2-oxoglutarate decarboxylase activity; Biological process=menaquinone biosynthetic process
  Homolog annotation: Hit_ID=Q15KJ0; Match level="QueryCoverage=58%, HitCoverage=31%, E-value=5e-13, Identity=41%"; Hit description =Truncated PHYLLO protein
MNLAVSALGGWRVCNGAMFLLEGGGNGLGMGSGRVCSRSRSEVSGVRVGVRLDGPVPLKDDVLEKEVVFEQCVTRTLSPALTLEEGLEKLKEALQILNSPSPSSPTGFLRFQVALPPSPKTFTLFCSQPHSSSVFPLIYVSKNDADSKSLYVNLDDNVSHQKERFFLVFHPS

SEQ ID NO: 109353 - protein, 248 aa, Glycine max
  Coding DNA Sequence Number=SeqID_17668
  Gene Ontology: Mol. function=triacylglycerol lipase activity; Cellular component=integral to membrane; Biological process=lipid metabolic process
  Homolog annotation: Hit_ID=Q8W4L6; Match level="QueryCoverage=94%, HitCoverage=36%, E-value=7e-49, Identity=46%"; Hit description =Putative uncharacterized protein Z97340.15
  Pfam annotation: Domain name=Lipase_3; Domain location=144-248; Score= 46.6; E_value=8.9e-11; Accession=PF01764.16; Description=Lipase (class 3)
MEVKNEKKAPSVERRHIEAPKNLMDVVSILMEAIKSLGYKEKWHILNLPRAIASAVLDTGKKTVARECGERSDCVQLKAPEVIKELYEIKKLLTRTLLFSRKRFHGFLFAAGIDKEDVLLRKRTAGIVRPAFTVIRDIESKSVLVFIRGTRSLKDTLTDALCKPVSFEHRRNNNIVSGHAHHGMVSAASWILHRCTPVLKEALDQYPHFKIKIVGHSLGGGTAALLTFKLREIQEFSSSTCVTFGPGM

SEQ ID NO: 109354 - protein, 133 aa, Glycine max
  Coding DNA Sequence Number=SeqID_17669
  Gene Ontology: Mol. function=triacylglycerol lipase activity; Biological process=lipid metabolic process
  Homolog annotation: Hit_ID=O23456; Match level="QueryCoverage=93%, HitCoverage=17%, E-value=7e-22, Identity=45%"; Hit description =Putative uncharacterized protein dl4075c
MITSIVVRKAAGKLEKRPAEAPKTLMDTVLTLAEAIRFGYAETLGKWHLFDLPRAILYSIMDKRKKTVTIECSERSDCVQLTDPEILKELYELKRCLTLTMLFSKKRFRTFLFAAQFAKDDVLLRKKKARVPV

SEQ ID NO: 109355 - protein, 106 aa, Glycine max
  Coding DNA Sequence Number=SeqID_17670
  Homolog annotation: Hit_ID=Q6WAY3; Match level="QueryCoverage=31%, HitCoverage=1%, E-value=5e-07, Identity=66%"; Hit description =Gag/pol polyprotein
EWRSICGHVGSPTRLMIVKHQLELNFFGDALPLVVPIDVVLLPKRMISLESSEVDMEAMKGQMTIMMATMMSMNKVMKEFCEDFKIQHHDSTPYWPKMNDAIEVVN

SEQ ID NO: 109356 - protein, 326 aa, Glycine max
  Coding DNA Sequence Number=SeqID_17671
NTIQLPAFYHTQWAPQYPEFVHLRYNGAIYEIRVRQHKEKVYLADGLEKFRKDLKIYESTTINFFACGHHSVFDIHFIPPLEQQTCGRHRHSSRKHIWTLRLTQEMLGAPEPLKLPRCTEVPLKACGNHMTVLRRHGYPLQWKVETQNPAIGGKGVVQPWYDFLEEMDFDDGDEISIYYRHYEKIWDIIIRKQEIGRIVITIRLPLVPTNSVNVYSWPQNQGPSLYERTTKLDETLAQFMQVTMSNHKSTESAIKNLEIHVRQLAKQIAENSSGSFRANTEKNPKEECKVVMTRGKKAIIVENEGRNVDEQELGAEEEKEKEKEKD

SEQ ID NO: 109357 - protein, 60 aa, Glycine max
  Coding DNA Sequence Number=SeqID_17672
MGPGPALARGRGSLLEGGGGPGEGMGWGMALLGAKRKETNDPNATMVVVVVDGGESALSW

SEQ ID NO: 109358 - protein, 130 aa, Glycine max
  Coding DNA Sequence Number=SeqID_17673
SAKVDISLSELNALSECHPLSEAPARLADRRNLEGNLSRRHVLSASLAHSASHLSPSRLNASLARSENSLTRAKRENDAKRDVEHFIIARLWLDHPYVCTVRGFSIERCIVSSELDKAGLGYRMSGHGMQ

SEQ ID NO: 109359 - protein, 54 aa, Glycine max
  Coding DNA Sequence Number=SeqID_17674
MAEWFKATVLKTVECNSSQSHQFDSGSRHHDRGPSSDAGAFCYELYTSAGTNSI

SEQ ID NO: 109360 - protein, 69 aa, Glycine max
  Coding DNA Sequence Number=SeqID_17675
MNESRMSLTVATYPSAGGRRVTRGMRVPRKEYAQSRHQRLFEENVGKTGKDAIYELLSERFGSCIYARG

SEQ ID NO: 109361 - protein, 368 aa, Glycine max
  Coding DNA Sequence Number=SeqID_17676
KVDVPAADDHAHARAAHRHHALQHGRGRQAAGRFHHHLHALGEELHGRDQLVIRHRDDVAHVLLDEREGQVAQVGGGGAVGQGLGRGDADDFALAQRLLAVVAGLGLDAVDQAARAERVRRQRRPRQQAAAAQAHEQVIQFADVLEQFLGRGALPRDHVLVVVGRDQRGAGLGLDAARDLFAIFGVAVVGDDLAAIAFGGGALGRRRVQRHDDGGLDALQLGGQRDRLRVVARRERDHAGGALLGRQARDGVEAAAELERPHALEVLALEEQRGAGDGSRPWSRSAPACGARGRPGARWRARHRRKWAVRATWKQSFERGKSRKRNLRIINPWRRSRRRHARTVYLPNSSPLVLAAPAGGVRPRWRQV

SEQ ID NO: 109362 - protein, 109 aa, Glycine max
  Coding DNA Sequence Number=SeqID_17677
MIDSGDDDYMISNSYFEDSLDEEEDIDDIFDTDEEVAYMIQPLTIMQPREGGSETTFWESASNYSNINWSHPDEEDIRGFDMASTFNIGQELFFGMEFESKKAVKNALQ

SEQ ID NO: 109363 - protein, 137 aa, Glycine max
  Coding DNA Sequence Number=SeqID_17678
  Gene Ontology: Mol. function=phosphoprotein phosphatase activity; Biological process=intracellular signaling cascade
  Homolog annotation: Hit_ID=A7R8Y3; Match level="QueryCoverage=94%, HitCoverage=40%, E-value=3e-22, Identity=41%"; Hit description =Chromosome undetermined scaffold_3090, whole genome shotgun sequence
MSSAAHYQTKSIGGMCILIQLWAWKRCTTLAPKRTPPVIENKPLEHRWLRRGNQHIGNDDLIVFHRKLDIMKRHEFLWESYTTTVMSALPSICLIGSVAWCAVVPLICFHVVEWHQPDRVLRQFGMQQPILGCPSQP

SEQ ID NO: 109364 - protein, 81 aa, Glycine max
  Coding DNA Sequence Number=SeqID_17679
MQSEGLALPPEPEKILPAWLPYEGSTTIHNIHLGNDQVKVGVEEVRDANAHILVPTQEVQLVGQTLNIFIAWLIHLVKHLS

SEQ ID NO: 109365 - protein, 69 aa, Glycine max
  Coding DNA Sequence Number=SeqID_17680
MSNPKVNIGSLLNLDSSTFSQYFDSLGGYATSNWVKPTENSTCLKQLIFTKHKRALIKHGRALRKTSIS

SEQ ID NO: 109366 - protein, 66 aa, Glycine max
  Coding DNA Sequence Number=SeqID_17681
MKDDRSRLKKEASPDDADRTLPNRHHPNNIQGLNRKLKAQAEKDEGPSGEGQSPRVEKDEGPSGEG

SEQ ID NO: 109367 - protein, 240 aa, Glycine max
  Coding DNA Sequence Number=SeqID_17682
  Gene Ontology: Mol. function=motor activity; Cellular component=cell projection
  Homolog annotation: Hit_ID=UPI00016621D1; Match level="QueryCoverage =99%, HitCoverage=41%, E-value=2e-18, Identity=31%"; Hit description =UPI00016621D1 related cluster
PIAFRGLHVLAFRGLHALTFRGLHALACTGLHALTFRGLQVLAFRGLQVFAFRGLHVLTFRGPHVLAFRGLHVLTFRGLHVLAFKGLQVLAFRGLHFPSFRGPHALAFRGLHTLTFRGLHVLDFKGLQVLTFRGLHALLFKGLHVLAFRGLHVLACRGLHALAFRGLHALDFKGLHILAFGGPHVLDFRGLHVLAFRGLNILLFRGLHAIAFRGLHVLAFRGLHILVFRGLHAIAFRELH

SEQ ID NO: 109368 - protein, 197 aa, Glycine max
  Coding DNA Sequence Number=SeqID_17683
  Homolog annotation: Hit_ID=A5B5G7; Match level="QueryCoverage=98%, HitCoverage=14%, E-value=3e-08, Identity=25%"; Hit description =Putative uncharacterized protein
MASRKRKTPSTPTQVKFDRSRFTSQEAWERYTDVIVPRKLLPERNVDEELTDFIDDNIDVAIVKEFYANLYDPEEKSPKQVRVRGQFIKFDKDTLNTFLKTFVIMEEGESLCAYSRFALLRPDPQELAAKLCIPGRGFELNVDGQPLKILRKNMTSLAQTWSVLSFSNLIPTFHTSDVTLDRAKLIYGIIMKMDMNL

SEQ ID NO: 109369 - protein, 19 aa, Glycine max
  Coding DNA Sequence Number=SeqID_17684
MANQQATKSKAKGKENPKP

SEQ ID NO: 109370 - protein, 195 aa, Glycine max
  Coding DNA Sequence Number=SeqID_17685
  Gene Ontology: Mol. function=chitin binding; Cellular component =extracellular region; Biological process=chitin metabolic process
  Homolog annotation: Hit_ID=UPI00006A17C9; Match level="QueryCoverage =63%, HitCoverage=99%, E-value=4e-10, Identity=29%"; Hit description =UPI00006A17C9 related cluster
MLVRMTRTPLFAAARVKSCPGMHSSCAIASSSGCAHIVGALPGSGGGPGTELIKGNYWPPYPRAQVSVRIWNPLKVRTRSPLKARACSPLRACSPRKVRTCSPRKTRTCNPLKERMRSPLKERACSPLKESTCSPLMARTCSPLMAKACSPLTVRTCSSLMARVRACSPTKARTYSLLKARACSPLKVRARSPQK

SEQ ID NO: 109371 - protein, 160 aa, Glycine max
  Coding DNA Sequence Number=SeqID_17686
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
RKRKSAQYANRLSPRVGRFINAAGTTGFPTGKRAVGDSAKVVIKQDMKGRRHKYGFNNNEREKAQKKRVVDDETVDKHQLDEHQERLRKKFALEEGRIFAANEQIVRGMQAWHWPSFYNVVTGKTLALPNLIALQHIPLSPAGVIAKRPAPIALPNSCAA

SEQ ID NO: 109372 - protein, 42 aa, Glycine max
  Coding DNA Sequence Number=SeqID_17687
MRLEDLCQKVPTLETRPLSPSSSYANPSTVPSSVTSHRLKLE

SEQ ID NO: 109373 - protein, 79 aa, Glycine max
  Coding DNA Sequence Number=SeqID_17688
SEVGQVHLRMRKMLLVEVLDPAFPTSMIRPYKVGMIPPPGILPVAGEVIIVLLWLILLLRLRRLLHRRAKVCVVVDRGA

SEQ ID NO: 109374 - protein, 121 aa, Glycine max
  Coding DNA Sequence Number=SeqID_17689
MARADKLWSSVHLFYPDTCKSDGTQRQIMVICPFLKMTMSSVIACFQKATITLIYISKTTMSSFIACFQKVTMTFIYISKTMSSVIACFQKATMTLIYILKTTMSSVIQCFQKSTISSYAF

SEQ ID NO: 109375 - protein, 95 aa, Glycine max
  Coding DNA Sequence Number=SeqID_17690
MQQGQADILIARFPDPNYGVKMENHEGQTRASFLTETARQVWKIPLRLKDSSLCGVSMENNGGPWWPPVVMGDGEGAWDVGNGFGRRKEKEMAVF

SEQ ID NO: 109376 - protein, 195 aa, Glycine max
  Coding DNA Sequence Number=SeqID_17691
  Homolog annotation: Hit_ID=Q2HW90; Match level="QueryCoverage=81%, HitCoverage=35%, E-value=3e-09, Identity=30%"; Hit description =Putative uncharacterized protein
MGTNQTEKRFYQVKIKGLDVTTLKELGRLMGPLQMQAFRKAYEKILDLTIAEIFTKVVVSLTQLVPTVEEFEEILGCPLWGRKPYLFSGFLPSLSKIAVVVRDSAREFDRVKQTRNGVVGLPRKYLEGKARDMVNQEDSVPFIDVLALLIFGVVLFPNVNGLVDLAAIDAFLAYHHSIEFLQPGGSTSSRAAATA

SEQ ID NO: 109377 - protein, 152 aa, Glycine max
  Coding DNA Sequence Number=SeqID_17692
  Gene Ontology: Mol. function=nucleoside-triphosphatase activity; Cellular component=nucleus; Biological process=transport
  Homolog annotation: Hit_ID=P0A9U5; Match level="QueryCoverage=100%, HitCoverage=88%, E-value=2e-77, Identity=57%"; Hit description =Uncharacterized ABC transporter ATP-binding protein ybiT
  Pfam annotation: Domain name=ABC_tran; Domain location=2-151; Score =96.2; E_value=1e-25; Accession=PF00005.18; Description=ABC transporter
MLKTLVGELEADNGTVKWSENARIGYYAQDHAEDFENDLTVFDWMSQWKQEGDDEQAVRSILGRLLFSQDDIKKPAKVLSGGEKGRMLFGKLMMQKPNILVMDEPTNHLDMESIESLNMALEMYQGTLIFVSHDREFVSSLATRVLEITPER

SEQ ID NO: 109378 - protein, 131 aa, Glycine max
  Coding DNA Sequence Number=SeqID_17693
MKTNMEALKDQMTSMMEAMLSMNRMIESNMAAIAATSAAAEVDSTHPPAINQANQPIPNVLGQGGEVLGSTSDPHVGHNRNAYPYGLPPNYTPPTMHMPNENANHAVPVTFEGQQPQPIRGAREEPQEHAQ

SEQ ID NO: 109379 - protein, 236 aa, Glycine max
  Coding DNA Sequence Number=SeqID_17694
  Homolog annotation: Hit_ID=A5B5G7; Match level="QueryCoverage=81%, HitCoverage=13%, E-value=7e-11, Identity=27%"; Hit description =Putative uncharacterized protein
MASRKRHAVPSPGEAANWDTSRFTSEIAWHRYQDNIQLRNILPERNVELGPRMFDEFLQELRRRRWDQVLTHLPEKRIDVALVKEFYSNLYDPEDHSPRFCRVRGQVVRFDADTINDFLDTPVILEDGEEYPAYTRYLSTHPDPDTIAATLCTPGGRFVLNADGLPWKLLRKDMMTLAQTWSVLSYYDLAPTSHTSDVNLDRARLIYGLLYITADQPDCPVQHLEARVPSVDYSAV

SEQ ID NO: 109380 - protein, 44 aa, Glycine max
  Coding DNA Sequence Number=SeqID_17695
MGVQIAPRPIWALQKIPPEGGSRKGLNRSSTFFIRSSSFFDLQP

SEQ ID NO: 109381 - protein, 44 aa, Glycine max
  Coding DNA Sequence Number=SeqID_17696
KESIDEEDPRPRSSNGACITKASLNHSAILHTQGHVLARKTLVQ

SEQ ID NO: 109382 - protein, 114 aa, Glycine max
  Coding DNA Sequence Number=SeqID_17697
MVRIRGLARVVGSGTDRGMGRDEHDVDVSRRCRPIAFTCRQRVQVDVTEEVPQVTEDVPPQVIEDIPDVTKDVPHVDEDIPTVDVDVVDVATDGDEGSPADHGEGFPGGPRDTL

SEQ ID NO: 109383 - protein, 345 aa, Glycine max
  Coding DNA Sequence Number=SeqID_17698
  Homolog annotation: Hit_ID=Q6WAY6; Match level="QueryCoverage=86%, HitCoverage=54%, E-value=2e-20, Identity=27%"; Hit description =Putative uncharacterized protein
NLAGKGEWVPFIDILALLIFGGVLFPNVDGLVDLAAINTFLAYHDHKESPIVAMLADLYDTFDRRHACPLESHRSCTEKGGASWDQLLANKEGASVKWFPRWKKGRTGVLILCGGFPNVPLMGTRGCISYNPILAIRQLGCPMRGALLEEELAPIISREVLQKKDKELRGSNNGPIDGYRKWLKAHVQGLDWISSLRTAKREEVEAPEEDEEVQALRIELEQAQTVKERFKSAALKIRKENAKLRDINVATTKALEQETKRAHREEHDRNKFRGALWGSNSELKLRRKERDQSRVDSLILKDELKTNMLAIISKYQEELNLATSHEHRVADEYAQVYVEKEARGR

SEQ ID NO: 109384 - protein, 107 aa, Glycine max
  Coding DNA Sequence Number=SeqID_17699
MTTLTQIWMMLLLSNIPPDDHNADLPPTEVSVGLCHHDIGIAPTRHPVNPEKSNRALGFPALVTGLCHSYRVPVPPTRSCHHDIGVAPIRHQVDPEKSNRGPGVSNS

SEQ ID NO: 109385 - protein, 172 aa, Glycine max
  Coding DNA Sequence Number=SeqID_17700
  Gene Ontology: Mol. function=aspartic-type endopeptidase activity; Cellular component=small subunit processome; Biological process=DNA integration
  Homolog annotation: Hit_ID=A5CB76; Match level="QueryCoverage=96%, HitCoverage=57%, E-value=2e-16, Identity=31%"; Hit description =Putative uncharacterized protein
  Pfam annotation: Domain name=zf-CCHC; Domain location=126-143; Score =13.4; E_value=0.014; Accession=PF00098.14; Description=Zinc knuckle
MKVTALKQTSHDMIAHIGKARAAVEELKRFLVADSLEEVNKKLDKFYMVLILRSLHSDFDHVRDQVLAGDQVPSMDSLITRLLRVPHVLKEENLADTMETSAMVATRGRGGGRNSRGGRSGRGGRPQCSYCKRMGHTQENCYSLHGFPDKVARWLRQKNQSPSSLMKSTKSI

SEQ ID NO: 109386 - protein, 95 aa, Glycine max
  Coding DNA Sequence Number=SeqID_17701
  Gene Ontology: Cellular component=integral to membrane
  Homolog annotation: Hit_ID=A6TFQ4; Match level="QueryCoverage=100%, HitCoverage=66%, E-value=3e-37, Identity=77%"; Hit description =Putative uncharacterized protein yiiR
  Pfam annotation: Domain name=DUF805; Domain location=6-91; Score =53.5; E_value=7.5e-13; Accession=PF05656.5; Description=Protein of unknown function (DUF805)
MTLQQWLFSIKGRIGRRDFWIWIVIWVLTMSALFTLAGSNLLSLQTAAFILVCLLWPTAAVVVKRLHDRGRSGLWALLMILAWMLLAGNWAMLPQ

SEQ ID NO: 109387 - protein, 208 aa, Glycine max
  Coding DNA Sequence Number=SeqID_17702
  Gene Ontology: Mol. function=ATP-dependent DNA helicase activity; Cellular component=intracellular; Biological process=DNA recombination
  Homolog annotation: Hit_ID=Q8XD86; Match level="QueryCoverage=100%, HitCoverage=30%, E-value=1e-108, Identity=93%"; Hit description=ATP -dependent DNA helicase recG
  Pfam annotation: Domain name=Helicase_C; Domain location=27-104; Score=81.2; E_value=3.3e-21; Accession=PF00271.22; Description =Helicase conserved C-terminal domain
AYWVCTLIEESDLLEAQAAEATWEELKLALPELNIGLVHGRMKPAEKQTVMQAFKQGEMHLLVATTVIEVGVDVPNSSLMIIENPERLGLAQLHQLRGRVGRGAVASHCVLLYKSPLSKTAQKRLQVLRDSNDGFVIAQKDLEIRGPGELLGTRQTGNAEFKVADLLRDQAMIPDVQRIARHIHERYPLQAQALIERWMPETERYSNA

SEQ ID NO: 109388 - protein, 106 aa, Glycine max
  Coding DNA Sequence Number=SeqID_17703
  Homolog annotation: Hit_ID=Q9KHC4; Match level="QueryCoverage=39%, HitCoverage=8%, E-value=2e-07, Identity=69%"; Hit description=SocE
MEYKGKELKINLVRVSLSANESVLAFQADKRCCTLSTTWLSGYRARIRNHGHSCFLRETCRASCINESANARGEAVCVLGALPLPRSLTRCARSFGCGERYQLTQR

SEQ ID NO: 109389 - protein, 96 aa, Glycine max
  Coding DNA Sequence Number=SeqID_17704
  Homolog annotation: Hit_ID=A6FJQ2; Match level="QueryCoverage=39%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGSSRSTFSCSDSDSSEVVSSIRHRLASPSTFSLKGVLSMSSQLLMRLLDL

SEQ ID NO: 109390 - protein, 146 aa, Glycine max
  Coding DNA Sequence Number=SeqID_17705
  Gene Ontology: Mol. function=signal transducer activity; Cellular component=membrane; Biological process=signal transduction
  Homolog annotation: Hit_ID=A8AMG5; Match level="QueryCoverage=80%, HitCoverage=31%, E-value=2e-43, Identity=81%"; Hit description =Putative uncharacterized protein
  Pfam annotation: Domain name=MCPsignal; Domain location=1-144; Score =106.4; E_value=8.7e-29; Accession=PF00015.12; Description=Methyl -accepting chemotaxis protein (MCP) signaling domain
TNILALNASVEAARAGEQGRGFAVVANEVRTLAGRSASAAKEIRELISESQTRVKEGSDMATRAGETMDEISSEVMRVTALMKEISIASEEQSRGIEQVNQAVTQMDEAAQQNAALVEQASAATQSLEAQSQQLQASMAQFRVATA

SEQ ID NO: 109391 - protein, 99 aa, Glycine max
  Coding DNA Sequence Number=SeqID_17706
  Homolog annotation: Hit_ID=A7MM55; Match level="QueryCoverage=72%, HitCoverage=84%, E-value=2e-27, Identity=77%"; Hit description =Putative uncharacterized protein
  Pfam annotation: Domain name=DUF1107; Domain location=32-99; Score =155.5; E_value=1.5e-43; Accession=PF06526.3; Description=Protein of unknown function (DUF1107)
MFYSYASFALQGLVPNLATAKRITSVQELNSMKIFQRYNPLQIAKYVKTLFKGRLYIKDVGAFEFDKGKVMLPRVKDKQHLSVMSEINRQVLRLQAEYN

SEQ ID NO: 109392 - protein, 121 aa, Glycine max
  Coding DNA Sequence Number=SeqID_17707
  Gene Ontology: Biological process=type I hypersensitivity
  Homolog annotation: Hit_ID=Q87NM1; Match level="QueryCoverage=86%, HitCoverage=69%, E-value=2e-14, Identity=37%"; Hit description =Putative uncharacterized protein VP1847
  Pfam annotation: Domain name=DUF1311; Domain location=13-107; Score =42.8; E_value=1.2e-09; Accession=PF07007.3; Description=Protein of unknown function (DUF1311)
MAQQNPIDQQLNQCLNKESSTAGMSQCYSSANKAWDKEMNAQYSQLMKKLTGEPKDKLRNAQRAWLAYRDSWTEASRSYFLSSQGSMAALSVGAQGVSLVRNQALMLQSINKGSCANPDDC

SEQ ID NO: 109393 - protein, 181 aa, Glycine max
  Coding DNA Sequence Number=SeqID_17708
  Gene Ontology: Mol. function=inorganic diphosphatase activity; Cellular component=cytoplasm; Biological process=phosphate metabolic process
  Homolog annotation: Hit_ID=P65749; Match level="QueryCoverage=97%, HitCoverage=100%, E-value=7e-96, Identity=96%"; Hit description =Inorganic pyrophosphatase
  Pfam annotation: Domain name=Pyrophosphatase; Domain location=22-180; Score=212.4; E_value=1.1e-60; Accession=PF00719.10; Description =Inorganic pyrophosphatase
MKESQMSLNQVPAGKDLPEDIYVVIEIPANADPIKYEVDKESGALFVDRFMSTAMFYPCNYGYINHTLSLDGDPVDVLVPTPYPLQPGSVIRCRPVGVLKMTDESGEDAKLVAVPHTKLSKEYDHIKDVNDLPELLKAQITHFFEHYKDLEKGKWVKVDGWDNAEAAKAEIISSFERAQKK

SEQ ID NO: 109394 - protein, 447 aa, Glycine max
  Coding DNA Sequence Number=SeqID_17709
  Gene Ontology: Mol. function=hydrolase activity; Cellular component =integral to membrane; Biological process=metabolic process
  Homolog annotation: Hit_ID=A7MM52; Match level="QueryCoverage=88%, HitCoverage=89%, E-value=0.0, Identity=85%"; Hit description =Putative uncharacterized protein
  Pfam annotation: Domain name=CBS; Domain location=216-333; Score =64.5; E_value=3.7e-16; Accession=PF00571.19; Description=CBS domain
  Pfam annotation: Domain name=CorC_HlyC; Domain location=346-426; Score=85.3; E_value=1.9e-22; Accession=PF03471.8; Description =Transporter associated domain
  Pfam annotation: Domain name=DUF21; Domain location=3-197; Score =243.0; E_value=6.4e-70; Accession=PF01595.11; Description=Domain of unknown function DUF21
  Pfam module annotation: Pfam domain module=CBS::CorC_HlyC::DUF21; Domain location=216-333::346-426::3-197
MLDSLLVILLLIVISSFFSLSEISLAAARKIKLKLLADEGNINAQRVLKMQEQPGMFFTVVQIGLNAVAILGGIVGDAAFSPAFSSLFNRFMEPELADQLSFICSFTIVTSLFILFADLTPKRVGMIAPEAIALRIINPMRFCLLVFRPLVWLFNGLANVFFRIFKLPMVRKDDITSDDIYAVVEAGALAGVLRKQEHELIENVFELESRTVPSSMTSRENIVWFDLHEDETSLKTKIAQHPHSKFLVCDGDIDHIVGYVDSKELLLRVLGNQSMTLNSGVQIRSALIVPDTLTLSEALESFKTAGEDFAVIMNEYALVVGIITLNDVMTTLMGDLVGQGLEEQIVARDENSWLVEGGTPIDDVMRVLDIDEFPQSGNYETIGGFMMYMLRKIPKRTDFVKFSGYKFEVVDIDSYRIDQLLVTRIDDRPPVLNVSKNTLDESEGPAA

SEQ ID NO: 109395 - protein, 801 aa, Glycine max
  Coding DNA Sequence Number=SeqID_17710
  Gene Ontology: Mol. function=acid phosphatase activity; Cellular component=cell outer membrane; Biological process=transport
  Homolog annotation: Hit_ID=O66049; Match level="QueryCoverage=28%, HitCoverage=85%, E-value=1e-116, Identity=86%"; Hit description =Phytase
  Pfam annotation: Domain name=Acid_phosphat_B; Domain location=1-240; Score=322.2; E_value=9.2e-94; Accession=PF03767.5; Description=HAD superfamily, subfamily IIIB (Acid
  Pfam annotation: Domain name=Pro_CA; Domain location=275-430; Score =66.2; E_value=1.1e-16; Accession=PF00484.10; Description=Carbonic anhydrase
  Pfam annotation: Domain name=Sulfate_transp; Domain location=514-801; Score=-10.1; E_value=4e-10; Accession=PF00916.11; Description=Sulfate transporter family
  Pfam module annotation: Pfam domain module=Acid_phosphat_B::Pro _CA::Sulfate_transp; Domain location=1-240::275-430::514-801
  Subcellular localization annotation: CTP_CleavageSite=60; ConfidenceScore=5.00e-01
MMKNTSWLAAAGLIALTLTGCAQPQKQQAQQQLGQQSVLAVNWFQQSGEYQALSWQAFNTARMAFDNAPSLTGKPKAVIVDLDETMIDNSAYSAWQAKNGQPFSGKTWSAWTQARQATAVPGAVEFANYVNSHGGTMFYVSNRDQKDYAATVDNLNKLGFSGVSDKTVRLSTGNSNKQARFDAIKNAGYNVVLYIGDNLNDFGGATWHQGNAQRQQFVTLNHQRFGTQFIVLPNPLYGDWESGMAENYNKLTPEQQLQVRESRMKAWNDYFEQYLHQQKPHSLWIGCSDSRVPAEVLTGSHPGELFVHRNIANMVLPDDDNFISVLQYAIFYLGVERIVLCGHYGCGGVQAALGLPASPLAQEDSALARRIAALRRALQQGLVAYHASPAQEEESSKLNRLVEANVIAQFSQLVRCEPVQQAWQAGQQLDRNPHHESANASSGYSCWSGGVSGGAATVSGHRAGQRSAALCRSAHRGDRRSAGYRAQSLALCRERPGGGAGDHCCGLNPDARQLFRVSHRADSGWRAAVHARPAARRSFYLAASDAGLQSLVSGEFSFSLSAMLVAGSGLLILWLWTTPAIKAVKALSWMPGPLVAVLFGCLATVLGDRLFPSLGEGLPRIVLPAFDSMSALVAELETPDWLAWQNPSVWVVAITLALVASLETLLSQEALKKLRPQHPAPSPNKEMFAQGIGNLTAGLLGAMPITAVIVRSSVNVSVGAQTKLSILLHGVLLLICGLWFSALLNAIPLASLAAVLLYTGYKLATPRLFVEQIRMGAQQYVPFLATIGGIIVFGMLAGIGI

SEQ ID NO: 109396 - protein, 1074 aa, Glycine max
  Coding DNA Sequence Number=SeqID_17711
  Gene Ontology: Mol. function=L-idonate 5-dehydrogenase activity; Cellular component=integral to membrane; Biological process=D -gluconate metabolic process
  Homolog annotation: Hit_ID=A8GGZ5; Match level="QueryCoverage=31%, HitCoverage=98%, E-value=1e-129, Identity=65%"; Hit description =Alcohol dehydrogenase GroES domain protein
  Pfam annotation: Domain name=ADH_N; Domain location=163-276; Score =132.3; E_value=1.4e-36; Accession=PF08240.3; Description=Alcohol dehydrogenase GroES-like domai
  Pfam annotation: Domain name=ADH_zinc_N; Domain location=305-441; Score=138.7; E_value=1.6e-38; Accession=PF00107.17; Description=Zinc- binding dehydrogenase
  Pfam annotation: Domain name=CitMHS; Domain location=667-1022; Score=- 127.5; E_value=0.066; Accession=PF03600.7; Description=Citrate transporter
  Pfam annotation: Domain name=DctM; Domain location=667-1072; Score= -229.4; E_value=0.024; Accession=PF06808.3; Description=DctM-like transporters
  Pfam annotation: Domain name=GerE; Domain location=77-138; Score =24.8; E_value=1.6e-05; Accession=PF00196.10; Description=Bacterial regulatory proteins, luxR family
  Pfam annotation: Domain name=GntP_permease; Domain location=667-1072; Score=626.8; E_value=1.9e-185; Accession=PF02447.7; Description=GntP family permease
  Pfam annotation: Domain name=KR; Domain location=472-592; Score= -73.7; E_value=0.0046; Accession=PF08659.1; Description=KR domain
  Pfam annotation: Domain name=Sigma70_r4; Domain location=76-124; Score=5.8; E_value=0.065; Accession=PF04545.7; Description=Sigma-70, region 4
  Pfam annotation: Domain name=Sigma70_r4_2; Domain location=70-122; Score=17.1; E_value=0.013; Accession=PF08281.3; Description=Sigma-70, region 4
  Pfam annotation: Domain name=Voltage_CLC; Domain location=667-1031; Score=-170.5; E_value=0.017; Accession=PF00654.11; Description =Voltage gated chloride channel
  Pfam annotation: Domain name=adh_short; Domain location=469-620; Score=71.2; E_value=3.5e-18; Accession=PF00106.16; Description=short chain dehydrogenase
  Pfam module annotation: Pfam domain module=ADH_N::ADH_zinc _N::CitMHS::DctM::GerE::GntP_permease::KR::Sigma70_r4::Sigma70_r4 _2::Voltage_CLC::adh_short; Domain location=163-276::305-441::667 -1022::667-1072::77-138::...
  Pfam module annotation: Domain location=667-1072::472-592::76-124::70- 122::667-1031::469-620
MESPAIVKMVLSAGVKGFIGKSHNMQEIVQAIRQVAQGRLFLSQEVAYEVENLYVMNEDAINENLDLSSKGNMYEKVKTLSPREVEVVRCFLDGLSVSQIAVKFKRSRKTVSGQKQDGRRLLFRLSASRSRTEGATMNIETQSCVITGKKQVSVAQQQVQWDGTGTLVRITRGGICGSDLHYYQEGKVGSFEVKMPMILGHEVIGYVVESDDPQLQPNQKVAVNPSKPCGSCKYCLREQQNQCTSMRFFGSAMYLPHVDGGFTQYKVVDSAQCVPFPQEADDSVMVFAEPLAVCIHATQQAGDLSGKTVFISGVGPIGCLIAAAAKARGAAEIICSDISERSLSLAQQMGATGVIHAADGDFTPYLADKGFFDVAFEASGHPSSLQRCLDVVCAKGTLVQVGMGGTIPDFPLMTLIAKEINLVGSFRFTHEFNTAVDWLARGVVNPLPLFSGEYDLQDIDAALQFAGDKTRAAKAGAEVIINATTEGGAEQGAAKLRELGYHARAKAFDVTQSAQVQQAVEEIESQWGAIDILVNNAGIQRRRPFLEFPEQDWNDVIAVNQTAVFLVSQTVAKRMVQRQRGKIINIGSMQSELGRDTITPYAASKGAVTMLTRGMCVELARHNIQVNAIAPGYFVTEMTQTLADDPAFTGWLTKRTPAARWGKPEELIGAAVFLASGASDFVNGHLLFVDGGIAEGMTPLNVMASIQKGIGSTLGGLAMILGFGAMLGRLVSDTGAAQRVATTLIAAFGKQRLQWAAGGHRTDRRSGDVLRSRLRTVAAAALSVTHCFLPPHPGPTAIATIFGANLGTTLLYGLIITIPTVIIAGPIFSKFLKSFEKSPPEGLYNPKIFTEEEMPGFFISIFAAVIPVVLMAIAAVCELTMPKENALRQFFEFIGNPAVALFIAVVIAVFTLGLRNGRKMEQVMDMCGDSIAAIAMIVFIIAGGGAFKQVLVDSGVGNYIADLMKGSSLSPLLMCWTVAAMLRIALGSATVAAITTAGIVTPIIAATHTDPALMVLAVGSGSVIASHVNDPGFWLFKGYFNLSVVETLKTWTVMETLISILGLAGVLALNAIIH

SEQ ID NO: 109397 - protein, 565 aa, Glycine max
  Coding DNA Sequence Number=SeqID_17712
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=Q3K942; Match level="QueryCoverage=96%, HitCoverage=45%, E-value=1e-107, Identity=39%"; Hit description =Multi-sensor hybrid histidine kinase precursor
  Pfam annotation: Domain name=HATPase_c; Domain location=309-424; Score=135.7; E_value=1.3e-37; Accession=PF02518.17; Description =Histidine kinase-, DNA gyrase B-, and HSP90-like ATPase
  Pfam annotation: Domain name=HisKA; Domain location=198-263; Score =82.4; E_value=1.5e-21; Accession=PF00512.16; Description=His Kinase A (phosphoacceptor) domain
  Pfam annotation: Domain name=PAS; Domain location=63-175; Score=39.2; E_value=1.5e-08; Accession=PF00989.15; Description=PAS domain
  Pfam annotation: Domain name=PAS_4; Domain location=69-180; Score =39.5; E_value=1.2e-08; Accession=PF08448.1; Description=PAS fold
  Pfam annotation: Domain name=Response_reg; Domain location=445-564; Score=116.2; E_value=9.7e-32; Accession=PF00072.15; Description =Response regulator receiver domain
  Pfam module annotation: Pfam domain module=HATPase_c::HisKA::PAS::PAS_ 4::Response_reg; Domain location=309-424::198-263::63-175::69 -180::445-564
MAHWRQAEPPFLSGSWKNYKQTILLIVSVSLGLILLILLWNHHLRKVIQQRMQAENALKNQLNFTHTLFNDSPVAMYIRDKQTRLVDCNNAYLRFLHIKRDEVIGKRLSDVFNTNNASIHTIEDGYQQTLLDGEAVMRDVQLMFGQQAFHLYHWTLPFRDRLGEVAGVIGGWVDVTERNALLQELQLAKDTADKANRSKSEFLASMSHEIRTPLHAIIGLLELETRSQPCETLSENIRVAYSSARALLSLIGDILDLSKIESGQYQPTPETVYLPDVIDQAVTLFRNKAESKGIDLRVEMDIAAYWVQTDPLMINQILSNLLSNAIKFTDRGSVTVVLMQGIGQEEEGCEFVIEVSDDGCGMTEEQQQAIFEPFVQVGERQQQQIGTGLGLSICRNLAELLDGELIVESTPGEGSVFSFYFRAPAGEPRDQTQPHLSQPLVTDKLSVLVIDDHAPNRLLLGKQLELAGHQVVVSESAVEALKLWQQDPLRFDLIITDCNMPGMNGFEFAQALRQHERQHHLPPIMLYGLTASAEQHIMQRCLQAGMNDCLFKPLNLDTLLAQITH

SEQ ID NO: 109398 - protein, 599 aa, Glycine max
  Coding DNA Sequence Number=SeqID_17713
  Gene Ontology: Mol. function=methyltransferase activity; Biological process=DNA methylation
  Homolog annotation: Hit_ID=A7MIS8; Match level="QueryCoverage=62%, HitCoverage=99%, E-value=1e-135, Identity=64%"; Hit description =Putative uncharacterized protein
  Pfam annotation: Domain name=CBS; Domain location=4-115; Score=4.2; E_ value=0.017; Accession=PF00571.19; Description=CBS domain
  Pfam annotation: Domain name=MTS; Domain location=422-594; Score =272.0; E_value=1.2e-78; Accession=PF05175.5; Description =Methyltransferase small domain
  Pfam annotation: Domain name=Methyltransf_11; Domain location=457 -562; Score=2.3; E_value=0.051; Accession=PF08241.3; Description =Methyltransferase domain
  Pfam annotation: Domain name=Methyltransf_12; Domain location=457 -560; Score=22.8; E_value=0.0013; Accession=PF08242.3; Description =Methyltransferase domain
  Pfam module annotation: Pfam domain module=CBS::MTS::Methyltransf _11::Methyltransf_12; Domain location=4-115::422-594::457-562::457-560
MRVEQLIIPGAALQPAESVGQALAVSSLKRERYVYVINQAGQFLGVVSIHDISRKVLAQEITLDSPVSSVMDDNFPCIYQHQSMREGWEAFARVTLERLPVRQFVYHDHAQKGFRREAEKGRDANFGLGFQVTALHAGNGGVQAKRMLHHFDFIIPDDLAHRRRAAHIAVFQRLRVVIERRSLTTSCVSGYAAAKRRLIADYQSALAPVRGCFQGRKSRKVYHAGDSMSQLELTDRTLTLQRFPPMREESPLQAWDAADEYLLQQALPAGPVLVFNDSFGALTCGLNDREIWHVSDSWLSQQAARQNLRLNGLDEASVHFLDSLAPLPAAPAAVLIKLPKALALLEHQLRALRTVVTPDTLILAAGKAKDIHNSTLQLFERILGESKTSLAWKKARLIYSHFSAPALADVPATTVWPLDETPYHIHNHANVFARAALDIGARFFLQHLPHDIEGEIVDLGCGNGVIGLQALEQNPQAEVLFVDESYMAVASSQLNVELNRPQDLARCQFRVNNVLSGFPSDRLHAVLCNPPFHQQHAVTDHLAWQMLRDAKRCLQYGGELRIVGNRHLGYHQKMKKLFGNCELVASNAKFVVLRSVKLR

SEQ ID NO: 109399 - protein, 781 aa, Glycine max
  Coding DNA Sequence Number=SeqID_17714
  Gene Ontology: Mol. function=oxidoreductase activity; Cellular component=integral to membrane; Biological process=metabolic process
  Homolog annotation: Hit_ID=A7MIS9; Match level="QueryCoverage=39%, HitCoverage=95%, E-value=1e-141, Identity=81%"; Hit description =Putative uncharacterized protein
  Pfam annotation: Domain name=DUF81; Domain location=405-636; Score= -67.5; E_value=0.036; Accession=PF01925.10; Description=Domain of unknown function DUF81
  Pfam annotation: Domain name=GFO_IDH_MocA; Domain location=26-145; Score=141.3; E_value=2.7e-39; Accession=PF01408.13; Description =Oxidoreductase family, NAD-binding Rossmann fold
  Pfam annotation: Domain name=Semialdhyde_dh; Domain location=27-144; Score=-9.9; E_value=0.0044; Accession=PF01118.15; Description =Semialdehyde dehydrogenase, NAD binding domain
  Pfam annotation: Domain name=TerC; Domain location=432-550; Score =212.1; E_value=1.3e-60; Accession=PF03741.7; Description=Integral membrane protein TerC family
  Pfam module annotation: Pfam domain module=DUF81::GFO_IDH _MocA::Semialdhyde_dh::TerC; Domain location=405-636::26-145::27 -144::432-550
IKFRLPAPPGNMLLCRFQSAGEPAVIRFAIVGTNWITRQFIDAAHESGKMKLSAVYSRSQQQADAFVADYPCPLTFTSLEALAASAEIDAVYIASPNALHCEQALLFMSHGKHVICEKPLASNLREAEAMIGCARQHQVVLFEAFKTASLPTFLRLQQALPQLGTLRKALFNYCQYSSRYQRYLDGENPNTFNPRWSNGSIMDIGYYCLAAAVTLWGAPQQAKAEASLLASGVDAHGVVVLDYGDFDVTLLHSKVSDSLIPSEIQGEAGSLVIEKISECQQLRLIPRGGESQNLTQPQHINTMLYEAETFARLVETRQVEHPALEVSRITARLLTEIRRQTGVVFPADRKEDTTMHSVGTPLLWGSFAVVVLIMLAIDLFLQGRRGAQTMSFKQAAVWSLVWISVSLLFAAAFWWYLDGSAGREVATAQTLAFLTGYVLEKALAVDNVFVWLMLFSYFAIPSNLQRRVLIYGVLGAIVLRTIMIFAGSWLVTQFSWILYIFGAFLLFTGIKMAFAKEGDDAAVGDKPVVRWLRKHLRMTDELHGEKFFTRKNGVLFATPLLLVLIMVELSDVIFAVDSIPAIFAVTTDPFIVLTSNLFAILGLRAMYFLLANVAERFSMLKYGLAIVLVFIGIKMLIVEFYHIPVAISLTVVGVILGGTLLIMPGKPGKTNHDRPDCRRGAGVAFTRCRAGRGPAGRGTAAGTGAGDLLDCQPSAGAKNQYSPDHYAVPAQYLLRGGGRGDFQPSVPADAVDGRRRDRNYPAVRHHRSAARPADEHGRQSD

SEQ ID NO: 109400 - protein, 250 aa, Glycine max
  Coding DNA Sequence Number=SeqID_17715
  Gene Ontology: Mol. function=transcription factor activity; Cellular component=intracellular; Biological process=regulation of transcription, DNA-dependent
  Homolog annotation: Hit_ID=A7MIR8; Match level="QueryCoverage=99%, HitCoverage=96%, E-value=1e-103, Identity=74%"; Hit description =Putative uncharacterized protein
  Pfam annotation: Domain name=FCD; Domain location=96-220; Score=86.3; E_value=9.7e-23; Accession=PF07729.3; Description=FCD domain
  Pfam annotation: Domain name=GntR; Domain location=9-72; Score=89.7; E_value=9.4e-24; Accession=PF00392.12; Description=Bacterial regulatory proteins, gntR fam
  Pfam module annotation: Pfam domain module=FCD::GntR; Domain location= 96-220::9-72
MDLNESRRLYQQLASELKQRIEAGSYAVGAKLPAERMIAEAHQVSRTVVREAIIMLEVEGYVEVRKGSGIHVISDQPQPRDSAADQLEFASYGPFELLQARQLIESNVAEFAATQIRPQDIVALLTIQEKARQEDHARDSTWDMEFHVRIAQSTQNSALAAIVEKMWRHRLHNPYWLKLHEHIDARHITSWCDDHDQILKALMRKDPAASKLAMWQHLENTKQMLFDATADDFEFNVDRYMFAENPVILP

SEQ ID NO: 109401 - protein, 263 aa, Glycine max
  Coding DNA Sequence Number=SeqID_17716
  Homolog annotation: Hit_ID=A9N615; Match level="QueryCoverage=33%, HitCoverage=87%, E-value=6e-28, Identity=64%"; Hit description =Putative uncharacterized protein
  Pfam annotation: Domain name=DUF883; Domain location=11-90; Score =76.5; E_value=8.8e-20; Accession=PF05957.4; Description=Bacterial protein of unknown function (DUF883)
MENTMAKDTTSEHLRAELKNLADTLEEVLSSSADKSKSELDKLRHKARGAIESSRERLGESGERIAQTTREAAEKADVYVRENPWHGVARGDNAGWHGRDTRAAGRCRAGRGKGQSDPDADHDRPDHAVYRLRIDEPDGADYLGGGCAVPADGDCHHHRRAIRAGADFWFMDREREARIHELLNQVQQQRLDLSAARRDWLESTAQYDRGWLTFLSLRRYLAIGSSALAIWSIRSPNRIMRWAKRGLGLWSTWRMIKSAMPPR

SEQ ID NO: 109402 - protein, 1222 aa, Glycine max
  Coding DNA Sequence Number=SeqID_17717
  Gene Ontology: Mol. function=protein-N(PI)-phosphohistidine-sugar phosphotransferase activity; Cellular component=cytoplasm; Biological process=phosphoenolpyruvate-dependent sugar phosphotransferase system
  Homolog annotation: Hit_ID=A8AME9; Match level="QueryCoverage=51%, HitCoverage=97%, E-value=0.0, Identity=68%"; Hit description =Putative uncharacterized protein
  Pfam annotation: Domain name=Beta_elim_lyase; Domain location=25-305; Score=-91.9; E_value=0.00019; Accession=PF01212.12; Description=Beta -eliminating lyase
  Pfam annotation: Domain name=DUF1341; Domain location=367-584; Score =497.7; E_value=1.4e-146; Accession=PF07071.2; Description=Protein of unknown function (DUF1341)
  Pfam annotation: Domain name=HTH_11; Domain location=593-649; Score =53.9; E_value=5.5e-13; Accession=PF08279.3; Description=HTH domain
  Pfam annotation: Domain name=HTH_11; Domain location=678-736; Score =17.7; E_value=0.0032; Accession=PF08279.3; Description=HTH domain
  Pfam annotation: Domain name=HTH_DeoR; Domain location=593-644; Score= 0.4; E_value=0.057; Accession=PF08220.3; Description=DeoR-like helix -turn-helix domain
  Pfam annotation: Domain name=Mga; Domain location=648-752; Score =13.7; E_value=0.00094; Accession=PF05043.4; Description=M protein trans-acting positive regulator (MGA)
  Pfam annotation: Domain name=PRD; Domain location=884-974; Score =67.8; E_value=3.7e-17; Accession=PF00874.11; Description=PRD domain
  Pfam annotation: Domain name=PTS_EIIA_2; Domain location=1080-1218; Score=-12.0; E_value=0.00085; Accession=PF00359.13; Description =Phosphoenolpyruvate-dependent sugar phosphotransferase system, EIIA 2
  Pfam annotation: Domain name=SelA; Domain location=13-338; Score= -196.2; E_value=2.6e-05; Accession=PF03841.4; Description=L-seryl -tRNA selenium transferase
  Pfam module annotation: Pfam domain module=Beta_elim_lyase::DUF1341::H TH_11::HTH_11::HTH_DeoR::Mga::PRD::PTS_EIIA_2::SelA; Domain location =25-305::367-584::593-649::678-736::593-644::648-752::884-974::1080 -1218::13-338
MSSIYEKYDLKQVINASGRMTILGVSTPSADVVDTVSYGLNHYFEIKDLVNKTGAYIARLLEVENAVVVSCASAGIAQCVAAVIVKDNDWLLDNLHAAPLSVPHDIVVPKGHNVNYGAPVGSMVALGGGRLIEAGYSNECSPEQLAAAITPTTAALLYVKSHHCVQKSHLSVEQAAVVARKHGIPLIVDAAAEEDLQCYYQMGADLVIYSGAKAIEGPTSGLVIGRSQYVEWVKRQSNGIGRAMKVGKEGILGLTQAIENYLLQSKTSGADMVAKMTPFIDNLNTLNGVSARVVWDAAGRDIARAEIKFDEAVTGWPTGELVQALKNGDIAIYFRGYKANEGIIEADPHPGAAQRRKTRMNLNANFYQGRLCLNVLAGSKQNAQAIWQAAEGHVLVGVLSKNYASNEAAIADMREYAALIDNALSVGLGAGDPNQSAMVSEISAELQPQHVNQVFTGVATSRALLGQSHTIVNGLVSPTGTPGKVKISTGPRSSQAADGIVPIATAIAMLQDMGGSSVKYFPMGGLKAVEEYRAVADACARHDFWLEPTGGIDLNNFEEIVRIALEAGVSKVIPHVYSSIIDSASGDTRIDDRLAQLFAALQSETLPQDELARRFSVSTRTVRTDITALNALLEQHGAQFVLARGAGYQLKIDDAVRFGRLQQESAAPLRVPRTSQDRVRYLLSRFLTAAYSLKLEDLSEEWFVSRATLQSDMAEVREWLGRYHLNIETKPRYGMKLFGSEAAIRTCLTDLLWQIDQQTPDSPLLTVEALHSGMLAQLQPLLAQCFTQHAIRLSDEGERYLLIYCAVAVRRISEGFPLSDPGAEDVGEEIREAAHDLVNLMRPLVGKGISQAEENWLRVNIAARQIQALAPSTINADDADALVDYLLNYINTHYNYRLQQDEQLRADLLTHIKTMITRVRYQIHIPNPLLSNIKQHYPMAYDVTLAAVTSWGKYTPYTISENEIGFLVLHIGVGLERHYDVGYQRHPQVLLVCDSGNSTLRMIEALLLRKYPQLVVTARLSQRDYEVRAHIDEDFVISTARLSEKNKPVVMMSPFPTEFQLEQLGKLVLVDRTRPYMLEKYFDAQHFMVLDRPMSQSALFRLLCDRLEAEGYVDADFYPSVEEREAIVSTMLGEGIALPHSLGLLAKKTVVYTVLAPHGVSWGDETASVIFLLAISKSEYEEAMAIYDLFVTFLRERAVTRLRDCADFVSFKAVAMDCLSRL

SEQ ID NO: 109403 - protein, 326 aa, Glycine max
  Coding DNA Sequence Number=SeqID_17718
  Homolog annotation: Hit_ID=A1JRF8; Match level="QueryCoverage=66%, HitCoverage=90%, E-value=9e-97, Identity=76%"; Hit description =Putative exported protein precursor
MRSVDEGVTAIDESASVLGFGFMDKEELGERLGKGDSKAKAFADALSKVQQQVLRTSQKILLRIEPLDVRRGAGNYRQRHCDRHRERDLHSNSLIIGGLVGVGVGAGAARMFHAPVTQGMGAFRTLGELNSCEGDPASHFSFGLGFFFNAWASSVAAGSFTQDVDHRILPNWGAAALMVKNRNVAETLHNPKRMAIACGIIGMIVVAFLNSTASAVPAALQVTAVKVLVPAANLLVNTVMPVIFWLAAMMPLIMGNAVPGLVLGILIGKGVEESGWNKVTKVMMAAIVLLFVLSGFFRGFDVKLLQSFQLGIPGWLDMIHNSLSGK

SEQ ID NO: 109404 - protein, 453 aa, Glycine max
  Coding DNA Sequence Number=SeqID_17719
MSLLSGDFHLRQQHRSALYIAARFNVVTDRYHIEPHIFEVARNCDLAHRVLNFTVFNPEARRTARVVAGHGADAGTHHLGNDQTASHLLHQIVKAVALTGDAPVMNAARVAGALQAELTRRIAGQQPVLQHAIFHDFARFGAYAFAVERRRRQPFQQVRLLFNRQPRRQNLLAQRVEQEGGFAVNAAAADHAHQMAEQASGHFRRKQHRRFHGWQLTRRKTCQHAARALRAHPVGALQIAHRAANGIGVVALHVTIVLGNDAARQRMPARAVALQHAVAVTKDFDADVAVKAATFGIGDALISLQRGLLGLRGQLNGAIGVDLPRVIEIEIRRLERQQIALGRRSTGIGRGVARDIDRRLHGALNRVRAEIGRGSTAFAVLVIDGDAKRAIAVEFDVFHFAVAGTDTDSGGFGDRHFCSVGAGLRQFQRLRDSLFQHFTLFCNLSRYVHRPAV

SEQ ID NO: 109405 - protein, 108 aa, Glycine max
  Coding DNA Sequence Number=SeqID_17720
MTYKTWKQVPAAQKDWIWEDIQALAADKDSVDDTICKKYDISKEKWTQFCQSRRDPSWEDVWKKTQAIQKQNIVPHVLSRRGYEYLENKMMDEKRNKKNRRKLLNPKA

SEQ ID NO: 109406 - protein, 131 aa, Glycine max
  Coding DNA Sequence Number=SeqID_17721
  Homolog annotation: Hit_ID=UPI0000D9FA36; Match level="QueryCoverage =74%, HitCoverage=100%, E-value=9e-09, Identity=39%"; Hit description= PREDICTED: similar to CG3868-PA, partial
TYQGNPCGVYPDLSSFIGSGVYPDLSSLTGSGVYPDLSSFTGSGVYPDLSSLTGSGVYPDLSSFTGSGVYPDLSSLTGSGVYPDLSSFTGSGVYPDLSSFTGSSVIQISVTCIKRSAPTQVHIIWYQSFGS

SEQ ID NO: 109407 - protein, 122 aa, Glycine max
  Coding DNA Sequence Number=SeqID_17722
  Homolog annotation: Hit_ID=B0HC01; Match level="QueryCoverage=27%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTRDGELVVILRRIL

SEQ ID NO: 109408 - protein, 93 aa, Glycine max
  Coding DNA Sequence Number=SeqID_17723
MYDTFDRGCEKSGARIVCCALALYVWAGFTPFFLQEGRPVYPLQGHRSSQELPRLLAKDKAVADTYSAPEEIHGLLSYCQHMIDLMDHMIGNR

SEQ ID NO: 109409 - protein, 97 aa, Glycine max
  Coding DNA Sequence Number=SeqID_17724
MTSSSGITGKIKDATGVSGVDKYPLSVQNIKFGSKLYVNADITEIHEFRQSLSVPFYSGGIINDKDGSQSQSSQSNVVEKFLQNAQVVSIGEINNLR

SEQ ID NO: 109410 - protein, 92 aa, Glycine max
  Coding DNA Sequence Number=SeqID_17725
  Gene Ontology: Mol. function=aspartic-type endopeptidase activity; Biological process=proteolysis
  Homolog annotation: Hit_ID=A5B3J2; Match level="QueryCoverage=89%, HitCoverage=18%, E-value=6e-10, Identity=45%"; Hit description =Putative uncharacterized protein
MTKEPDQRITLEDYSSSSVPQFFTSIARPEVQANNINYPHSLIQLIHGNLFQELPNEDPHAHLEMFIEICNIVKIASVPDEAIRLSLFSFSL

SEQ ID NO: 109411 - protein, 63 aa, Glycine max
  Coding DNA Sequence Number=SeqID_17726
  Subcellular localization annotation: CTP_CleavageSite=37; ConfidenceScore=5.43e-01
MKHFSDTLISANIVSQVHFASAQYANRLSPRVGRFINAAGPTGFPTGKRAVGATAINVRSYQH

SEQ ID NO: 109412 - protein, 132 aa, Glycine max
  Coding DNA Sequence Number=SeqID_17727
MKDKRDEEEKLEKQKKKKDSKALSSKANGKEKEEKDSSKKIVKKENHFATKGDIKRALLLEQSFNFLLSRETSLSTVIPLELEVIPQVKELLDEGLVRVEGRSPEFQEPLDLRSNPFQGGGNDAILLPKGIG

SEQ ID NO: 109413 - protein, 127 aa, Glycine max
  Coding DNA Sequence Number=SeqID_17728
MLKGEPPDAVSFAIGSINRRLDESIRRQAAHDRQQQSQNTCDEHRHDTRQPRYPDSLHCNLNHQIVDEIDGIAGISQMDQQPMPCNITVLFKEDAAGNQQQSRNAPGQRPHNVVVIELESRACREND

SEQ ID NO: 109414 - protein, 23 aa, Glycine max
  Coding DNA Sequence Number=SeqID_17729
GIGKEDWWHPLKNFSQEARGQPS

SEQ ID NO: 109415 - protein, 255 aa, Glycine max
  Coding DNA Sequence Number=SeqID_17730
  Gene Ontology: Mol. function=hydrolase activity, acting on glycosyl bonds; Cellular component=extracellular region; Biological process =metabolic process
  Homolog annotation: Hit_ID=A3HWH4; Match level="QueryCoverage=95%, HitCoverage=62%, E-value=2e-78, Identity=55%"; Hit description =Putative neuramidase
  Pfam annotation: Domain name=BNR; Domain location=132-143; Score =13.6; E_value=0.76; Accession=PF02012.11; Description=BNRAsp-box repeat
  Pfam annotation: Domain name=BNR; Domain location=214-225; Score =15.7; E_value=0.17; Accession=PF02012.11; Description=BNRAsp-box repeat
  Pfam annotation: Domain name=BNR; Domain location=64-75; Score=13.3; E_value=0.91; Accession=PF02012.11; Description=BNRAsp-box repeat
  Pfam module annotation: Pfam domain module=BNR::BNR::BNR; Domain location=132-143::214-225::64-75
MGAFALLAGICQAQEVNVFVSGEEGYKSYRIPAIVKDKTGQLIAFAEGRVDHTGDFGNVDIVYKISQDNGKTWGPLHVAVDNDNLQVGNPAPVVDLLDPAYPKGRLLLFYNTGNNHEGEVRKGNGLRECWSISSADGGKTWSNPQNITLETHRPNQPSVNAQYNFQEDWRTYANTPGHALQFDSGKYKGRIYIPANHSEGNPKSDGKDYFAHSYYSDDHGKTFKIGASVKFEGSNETMAAQISGTGLYMNSRNQQ

SEQ ID NO: 109416 - protein, 17 aa, Glycine max
  Coding DNA Sequence Number=SeqID_17731
NGIRYPDTVPVLIPPKN

SEQ ID NO: 109417 - protein, 124 aa, Glycine max
  Coding DNA Sequence Number=SeqID_17732
MQISIRDVPSLVLFEQPSGCTSTRTDPQEMYPLLFSVTTTQVDVPSTCTTKDVPSNVLRQSSQTGRIKRILRLCRFEFFDKGEGRHKRIQTVSPLFFWKREKRDTKRIQAISSWQILFGKGRRE

SEQ ID NO: 109418 - protein, 39 aa, Glycine max
  Coding DNA Sequence Number=SeqID_17733
MPLQGEDESRRSSPPQEAMDKSLKPTNPRSSPRFSTNCD

SEQ ID NO: 109419 - protein, 176 aa, Glycine max
  Coding DNA Sequence Number=SeqID_17734
ARTNEGRYGGLEGSSSFHDGSHVKHEEEAMLSMKRIMESNAAAVTAASATAEADPTHPFATNQAHQPTSDMVGQKGEVLGNTGGPQIGYNRNAYPYGLPPNYTLPTMHMPNENANHVVLITLEGGAREEPQEHAQGDFDPYPTFTTEGMPFNVVPQPNTVGAPQPHPLQPLHFSVG

SEQ ID NO: 109420 - protein, 48 aa, Glycine max
  Coding DNA Sequence Number=SeqID_17735
MFAKFLIFFCNASIFRIACTSSMVATTNDSTRKCRRTVTCRHGEIKAH

SEQ ID NO: 109421 - protein, 148 aa, Glycine max
  Coding DNA Sequence Number=SeqID_17736
MPSFRDLEQKWAPKVEALLGNNGGGRNGINIGLKEHSNQVYLPPRPTLQRVHQGLSLLIQDEKTIIADMNKSMVKSRNILLTLKEHNANSCTTIKEIYTISLTTLWMSKVTVWVKILGRWFATISLKNLPNGQMTISSSSVAQTDSRN

SEQ ID NO: 109422 - protein, 96 aa, Glycine max
  Coding DNA Sequence Number=SeqID_17737
MTKEWRRKRERICHFKEKMSLEEAHHHRRPWIRAWRKKEMNEGRGREEHEILCSKRALKSEIWFSPLIQDQVQDSPLSVGVMRHVKHEGHAQSVTI

SEQ ID NO: 109423 - protein, 73 aa, Glycine max
  Coding DNA Sequence Number=SeqID_17738
MDGLVDLAAIDAFLGFHNSKESPVVALLADMLMRKVCEVLIFILSLSQSAGLASHPLNATLLWFSTRKNLEEG

SEQ ID NO: 109424 - protein, 105 aa, Glycine max
  Coding DNA Sequence Number=SeqID_17739
MVLCLPLPAPFGVVGVQCPGDFYVCGLHADVLLILALITDLEPAKVSPLLPLRGTTPASYRASKINPLQATTSSKCLGRSDPHTSTAFTVKQCSIECPAVPPWYA

SEQ ID NO: 109425 - protein, 137 aa, Glycine max
  Coding DNA Sequence Number=SeqID_17740
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=3e-23, Identity=98%"; Hit description=LacZ protein
RPPPRWSSNSPYSESYYNSLAVVLQRRDWENPGVTQLNRLAAHPPFASWRNSEEARTDRPSQQLPSLNGEWDAPCSGALSAAGVVVTRSVTATLASADVRRCFCRYAPPPSVTEQEGQLIETEATGAPQKHHHTLNQ

SEQ ID NO: 109426 - protein, 150 aa, Glycine max
  Coding DNA Sequence Number=SeqID_17741
HLTETCMRARNFDIYGFFEPQSIQRSGQSQFESESYIKSWMQSSQRDVYLGAYLNGFHCSGHWQMVVILPKEHLVFCAIKGLDDAPQPKSKAFARWIVIKCNRQKGSTECGYYVMYWMSTIILGTFRNNWEAYFNDPRPLEPERLKALRI

SEQ ID NO: 109427 - protein, 104 aa, Glycine max
  Coding DNA Sequence Number=SeqID_17742
MTRGNPSNLQPFDPEIDRTFHRLVRRHLIPFEHPEHSVIGDFEHYSFEHSENMAQPPPRERTLREMAAPDFTYESLCIQYHDEDVPYILKTGLIHLLPKFHGLA

SEQ ID NO: 109428 - protein, 101 aa, Glycine max
  Coding DNA Sequence Number=SeqID_17743
IVPTRHPVDSKKANRVLELPTLITGLCQFYGVPVTPNKVIRPPTNRAFIKRYCAPRQAQGETPQRPGDGQQQTTNAPPPPPKPLSSSTKRLEYCLRHMADQ

SEQ ID NO: 109429 - protein, 197 aa, Glycine max
  Coding DNA Sequence Number=SeqID_17744
MVVYYTEFDEFKEELERRHWDEKLTDFSDSSIDIAIVKEFYANLYDPEDKSSKPDPQELAAKLCIPGRGFELNADGQPLKILRKNMTMLAQTWSVLSLSNLIRTSHKSDVTLDRAKLIYGIIMKMDMNLGYLISHQISRIAQHDKSRLGFLAVATCPFAGERGEPHGCAFQRRKDARSHHQRLFVGNIGKIEGNRSK

SEQ ID NO: 109430 - protein, 145 aa, Glycine max
  Coding DNA Sequence Number=SeqID_17745
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MTKNLEHCDMTKMDFLSFCFLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 109431 - protein, 285 aa, Glycine max
  Coding DNA Sequence Number=SeqID_17746
  Gene Ontology: Mol. function=motor activity; Cellular component=cell projection
  Homolog annotation: Hit_ID=UPI00016621D1; Match level="QueryCoverage =67%, HitCoverage=40%, E-value=1e-20, Identity=36%"; Hit description =UPI00016621D1 related cluster
MSLPSEGRVPSPSEDYLSLPSEDYMSSPSEDYTSSPSEDYTSSPSEDYTSSPSEDYTSSPLEDCMSSPSGLHALTFRGLHDPYLQRTTRPFRGLRVLAFRGLHVLAIRGLYVLTFRGLHVLTFRGLCVLTFRGLHVLAIRGLHVLTFRGLHALTFKGLHVLLFRGLHALALRGLHVLAFRGLHVLAFRGLHVLTFRGLHVLAIRGLHALTFKGLHALTFRGLHALTFRGLHTLAFRGLHILTFRALHVLTIRGLHALAFRGLHILTFRGLHVLTIRGLHALAFKG

SEQ ID NO: 109432 - protein, 116 aa, Glycine max
  Coding DNA Sequence Number=SeqID_17747
MHSHPRLSSEEDVANMCLMADSMDDSSTIEDIEVNFKFEEVLEAINEMHDEAQRLAISNNKLRSDLKLQITKLASIQSELDKLRQENEKLVSSYKASGCVCASTSLNMNDYKSLQI

SEQ ID NO: 109433 - protein, 254 aa, Glycine max
  Coding DNA Sequence Number=SeqID_17748
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
LEPLTCPINVSFRQKLGPGLPGINRDTRDLFILRSDLPSQWLLFLSAVPPVQLLTGWCVTAKAPPDISAGKCSGRVPFAIQAAQLLGRAIGAGLFAITPAGERGMCCKAIKLEYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 109434 - protein, 55 aa, Glycine max
  Coding DNA Sequence Number=SeqID_17749
MVETSQINTKRGVKDKLFRWLAPCFLTQILQDMAPILLPNSLYGNSQARKQRDKQ

SEQ ID NO: 109435 - protein, 278 aa, Glycine max
  Coding DNA Sequence Number=SeqID_17750
  Homolog annotation: Hit_ID=Q6WAY6; Match level="QueryCoverage=33%, HitCoverage=16%, E-value=1e-11, Identity=38%"; Hit description =Putative uncharacterized protein
EGKEGVLFSCGDYPNVPLIGTRGCINYNPALAIRQLGYPMRGAPTEESLSPFLVRDLGAQSLKVIQRVHKAWRSPLRKDKELRGIRNGVIDGYHGWLRVHTRGLDWLSKLKVINEENFEAPEEDEEVQALKLELGKARLAKEKFKSAATHIRKECTDNNELKLRREERDRSRVHGMILKEELAELKLRREERDRSRVHGMILKEELAASARSKRSLAQHVEATEQSMLAIIGQYKEELNQSVTHEQKLAEDFAQVYAEKEARGRVIDALHQEATMWMD

SEQ ID NO: 109436 - protein, 246 aa, Glycine max
  Coding DNA Sequence Number=SeqID_17751
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=21%, HitCoverage=50%, E-value=1e-23, Identity=100%"; Hit description=LacZ protein
MTPVNRKAGTGERTREPPGGNAWYLIVLSGFATTDLSVRFRDACQGGGAYGKTALPRPSHFPVKYLPGIFQEISAPFPFFSCHMKHFTDTLISANIETAMTMITPSSKLTLTKGNKSWYRAPPRGRRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 109437 - protein, 43 aa, Glycine max
  Coding DNA Sequence Number=SeqID_17752
EVSGLWKAKFSVGSSLGNWSDSKVLDSTGLSCCAITRDRGTRT

SEQ ID NO: 109438 - protein, 151 aa, Glycine max
  Coding DNA Sequence Number=SeqID_17753
  Homolog annotation: Hit_ID=A5AK77; Match level="QueryCoverage=41%, HitCoverage=7%, E-value=5e-07, Identity=39%"; Hit description =Putative uncharacterized protein
MTRSNPSDLQPFDPEIDRTFHRLLGHSVHPNHSVHFEHSKYFVAGDSKHSDFEHSTTNFHTENMAQPPPRERTLREMVAPDFTYESLCIQYPDKDVSYVLKTRLIHLLPKFHGLAGEDPHKHLKEFHIVCSTMKPPDVQEDHCWIKWSRNN

SEQ ID NO: 109439 - protein, 141 aa, Glycine max
  Coding DNA Sequence Number=SeqID_17754
LDESISCFLIRVDPWVLVPITFRGLHVLALRGLHVLAIRGLHVLAIRGLHVLAIRGLHALTSRGLPVLALRGLHAFTLVTLTVERTTRPRLERTTCPHLQRATCPRHQRTSCPRHQRAARPHLQRTTCPRLERATRLHLGY

SEQ ID NO: 109440 - protein, 41 aa, Glycine max
  Coding DNA Sequence Number=SeqID_17755
MSQPTLGGRATRGLTGASSKEGKCAESPPTFIRGKRRKTGK

SEQ ID NO: 109441 - protein, 166 aa, Glycine max
  Coding DNA Sequence Number=SeqID_17756
  Subcellular localization annotation: CTP_CleavageSite=85; ConfidenceScore=5.37e-01
MDFNKLDTREMLGAPSNIADTVCSNNFFFSPGKPASSSLLCEPSSPRGAPKVFFFFSANRGEKTRVRQKKWGKRLTAESSGRPVRGSVLPEVTKRLLEEHFFRKTPGTPLPEVSEEPFPESFRKKWFFRKNSGRRALPEELSNFRKNFPKEVVLPEKFQKNHFFRK

SEQ ID NO: 109442 - protein, 114 aa, Glycine max
  Coding DNA Sequence Number=SeqID_17757
MLVSARQRARLPLVDKRCGTIRFPRMSLDFTGQDDKRLVGRDCQRVQKTTLVYACYHALSLRDRKRKFAGYRQVSPHATGLLGHGNKRGVIDKSRAFAPMYPQFVMRNYDLRSS

SEQ ID NO: 109443 - protein, 39 aa, Glycine max
  Coding DNA Sequence Number=SeqID_17758
MDPSSHHSDSDWPIDIRKAKITTVRLFLAMAAMRHWPLH

SEQ ID NO: 109444 - protein, 348 aa, Glycine max
  Coding DNA Sequence Number=SeqID_17759
  Gene Ontology: Mol. function=nucleoside-triphosphatase activity; Cellular component=cytoplasm; Biological process=protein metabolic process
  Homolog annotation: Hit_ID=A6ESQ9; Match level="QueryCoverage=100%, HitCoverage=40%, E-value=1e-126, Identity=67%"; Hit description =Putative heat shock ClpB protein
  Pfam annotation: Domain name=AAA; Domain location=1-154; Score=-5.8; E_value=6e-05; Accession=PF00004.20; Description=ATPase family associated with various cellular activities (AAA)
MGALIAGAKYKGEFEERLKSVVNEVIKSDGQIILFIDEIHTLVGAGGGEGAMDAANILKPALARGELRAIGATTLNEYQKYFEKDKALERRFQKVMVEEPDTESAISILRGIKDKYEAHHKVRIKDEAIIAAVEMSQRYISDRFLPDKAIDLIDEASAKLRMEINSKPEELDVLDRKLMQMEIELAAISREGNQTKIDHLKEDISKISEQRNEINAKWLKEKQKSEDLTQIKKDIESLKLEAERASRAGDYAKVAEIQYGKIKEKEDDLQKLELEMQNHQNELIKEEVTAENISEVIAKWTGIPVTKLLQSEREKLLHLETELHHRVVGQEEAIQAVSDAIRRNRAGL

SEQ ID NO: 109445 - protein, 196 aa, Glycine max
  Coding DNA Sequence Number=SeqID_17760
MSKSCGFGMTGPLDESISCFLIRVDPWVLVPIAFRGLHVLTLRGLHVLALRGLHVLTIRRLHALTSRGLHVLALRGLPALALGLHALAIRGLHVLTFVGLHALTFRGLHVLANRGLHALTLRGLHVLTIRGLHALNSRGLHVLALRGLPALALGTSYPHLQRTTRPHLQRATRPRHQRTACPHLRRATRPHLRGPH

SEQ ID NO: 109446 - protein, 253 aa, Glycine max
  Coding DNA Sequence Number=SeqID_17761
MRGAPTEESLSPFLVRDLGAQSLKVIQRVHKAWRSPLRKDKELRGIRNGVIGGYHGWLRVHTRGLDWLSKLKLGKARLAKEKFKSAATHIQKECIELQEENAATARALEQETKRARKEEYGREKFRGALWGSNNELKLRREERDRSRVHGMILKEELAACARSKRSLAQHLEATEQSMLAIIGKYKEELNQSVAHEQKLVEDFAQVYAEKEARGRVIDALHQEATMWMDRFALTWNGSQDLPRLLAKEKAMAE

SEQ ID NO: 109447 - protein, 244 aa, Glycine max
  Coding DNA Sequence Number=SeqID_17762
GEGQGIGPSSPQGSSQRSSSEEHFSDEEAIQEAEAGGSDIFPASSTSKLSASIGIAEDTFIQMQDEDPAAALRLLLNTSQANTSSEKNPGASSSSDADITSTKKRENGARLDAQKQAHILLLEKARAAQHEVERLTKEAKEGSSEIKACDDNISSWEATITDLLSQVDDLRQKIVTEQAKRKELQEKAANSIQKQVAEKGREGLKAFSASQAVADEARVMESADQVLTKEMATLKKLYEDLVMH

SEQ ID NO: 109448 - protein, 216 aa, Glycine max
  Coding DNA Sequence Number=SeqID_17763
  Homolog annotation: Hit_ID=Q84VI1; Match level="QueryCoverage=100%, HitCoverage=31%, E-value=2e-64, Identity=64%"; Hit description =Envelope-like protein
MATSPKDTAAPGSPAVPSSPHQEQPEFNIQPIQIIPGQASVPEKLVPRRQQGVKIAENPSLATSPREVDTEMDKKIRSIVSSILKDASVPDAEKDVPTSSTPDVAVPDVDKDVPTSSAPNAEALPSPSEEESTEEEDQASEETPAPRAPEPAPGDLIDLEEVESDEEPIANRLAPGIAKRLQNRKGKTPLKRSGRIKTMAQKKSNPIIPATSRRSK

SEQ ID NO: 109449 - protein, 141 aa, Glycine max
  Coding DNA Sequence Number=SeqID_17764
  Subcellular localization annotation: CTP_CleavageSite=83; ConfidenceScore=5.30e-01
MTLSSWQNKLNMYFMCTTLVMKGGSWFYKGKQLVLMPKATPPATPPPSPPPPPSPAVALASSSTLKWTSKDTRLRSLATRPPRAERPVVHVNPATRKADDPYKKKLRTYLGIVARDKVDVTYKTWKEVLASQKDLIWEDIQ

SEQ ID NO: 109450 - protein, 83 aa, Glycine max
  Coding DNA Sequence Number=SeqID_17765
  Homolog annotation: Hit_ID=A5B167; Match level="QueryCoverage=61%, HitCoverage=9%, E-value=4e-08, Identity=52%"; Hit description =Putative uncharacterized protein
MPQQPMLFCEVFDVWGIDFMGPFPVSFGLEYLKQLLVIKEPIFATEQCMPCLKSTEWYTGYPHHTIPRPMDRQKFLTGKSREF

SEQ ID NO: 109451 - protein, 178 aa, Glycine max
  Coding DNA Sequence Number=SeqID_17766
TTKALEQETKRARREEHGRNKFRGALWGSNNELKLRREERDQSRVDSLILKDELKVCSRSKRNLSQRLCKTETNILAIVSRYQEELNLATAHEHRVADEYAQVYAEKEARGRVIDSLHQEETMWMDRFALTLNGSQELPRLLATAKAMVDTYSAPEEIHRLLSYCQHMIDLMVHMIRS

SEQ ID NO: 109452 - protein, 131 aa, Glycine max
  Coding DNA Sequence Number=SeqID_17767
SGDEIKVFPACVDQLLGKTWVVRFKHRIQMHQSYALDFSEQEHHIQSVISTLGLQDEQCISNKSAAVGVASSSQQDYHPTPSLSQSSEYDPGNVAFVTSAKRTSDQQGSSQFDSDDFTTYELSTNKHIKVE

SEQ ID NO: 109453 - protein, 31 aa, Glycine max
  Coding DNA Sequence Number=SeqID_17768
VTRQIILEKVKNISTVEVKGYIEQDEFKELP

SEQ ID NO: 109454 - protein, 140 aa, Glycine max
  Coding DNA Sequence Number=SeqID_17769
MDQLQRQAFCKTYGKIWDLAMIEVFVEAIASLIQYYDQPLRVFLFPNVDGLVDLVVIDAFLAYHHNKESSVVAMLVNAYDTLTEDARRVEQGLSVAHPLCMYGWLLTFFAMKVDMHVPYKVTACVPRKGKQIGSSSWLVR

SEQ ID NO: 109455 - protein, 105 aa, Glycine max
  Coding DNA Sequence Number=SeqID_17770
MWMLFYTNEHILKAYSAQWWPLGNEATIPPSDDAWTLIPGPTTIHAKEEHNKRRLMEACLWGFYGGWIFELQWDPLMVIFHHGDAAEDNGCTTQNIHHTTYFRDL

SEQ ID NO: 109456 - protein, 153 aa, Glycine max
  Coding DNA Sequence Number=SeqID_17771
LCQSFGVPVAPSKVIRPPITQAFVEKYCTQRQAQGDAPQATDVPPPHQAGPAGSIDTEQYLRHLVRQQAANHRANVQTHDGLYQLSLSLQSQGFTSFPCPTPDHFRAEVAWPGDWPEARAGEAPAEAPDEADEAREDEEMTDLFDFLGGSEAT

SEQ ID NO: 109457 - protein, 146 aa, Glycine max
  Coding DNA Sequence Number=SeqID_17772
ARLTGALSKGGKMRGVATNVYLWKTSEKPKETGTYPLKNEERMKNGEELATQLAQASSAHPGKQGCFLQKQPPSGGRNWKAQKLRKLTDCAKTPPFDFRHITKIGLSTLVPRWIVYVALKLPTMHLTNGVTFKFNSKDYFATLMQR

SEQ ID NO: 109458 - protein, 177 aa, Glycine max
  Coding DNA Sequence Number=SeqID_17773
MTTNLAKSITFILKKLRNMAIGMLEVLNKVIEDALRKANTHNILEFDRRDTRFLVKETINLREVQPVGDFTVKLDERGFWAFSYLRWKQPSSPGRAGQQPPPPVASGGSNLARLGELCGNLLPLFPIKRQKGVVPMNPDPPGYAFQLQGASVTLLRRFREQIREGFPSFFIRSSFFN

SEQ ID NO: 109459 - protein, 89 aa, Glycine max
  Coding DNA Sequence Number=SeqID_17774
MTLKPNECEKLCSIGACRPRIFFINGFLCFLEDEWQRNEERKRERRRHFKEKMSLEEAHHHRRPWIRAWRKKEMNEGRGREEHEILCSK

SEQ ID NO: 109460 - protein, 92 aa, Glycine max
  Coding DNA Sequence Number=SeqID_17775
  Subcellular localization annotation: CTP_CleavageSite=56; ConfidenceScore=5.45e-01
MHANIENNSETSQKSKGSRLVRSVKFRNVAEVEKRFFAQSVSFRSFFARRFLQKAVASGGSNLARLGELGGKLLPYFAINRGRSGEEKGSAP

SEQ ID NO: 109461 - protein, 244 aa, Glycine max
  Coding DNA Sequence Number=SeqID_17776
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARICKLWGWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 109462 - protein, 50 aa, Glycine max
  Coding DNA Sequence Number=SeqID_17777
MDKSLKVGEDEWRERERRGTKFMPQMSPLIQDQVQDSPISVLRCHETCKT

SEQ ID NO: 109463 - protein, 85 aa, Glycine max
  Coding DNA Sequence Number=SeqID_17778
  Gene Ontology: Biological process=transposition, DNA-mediated
  Homolog annotation: Hit_ID=Q1J7G7; Match level="QueryCoverage=38%, HitCoverage=47%, E-value=7e-12, Identity=100%"; Hit description =Transposase
MVKVGTSYVPINVSSSPKVGPGLPGINRDTRIYLFCEVLQWLLFLSAVPPVQLLTGWCVTAKAPPDISAGKCSGHAARNHHTRRA

SEQ ID NO: 109464 - protein, 154 aa, Glycine max
  Coding DNA Sequence Number=SeqID_17779
  Gene Ontology: Mol. function=lyase activity
  Homolog annotation: Hit_ID=Q8DE21; Match level="QueryCoverage=43%, HitCoverage=90%, E-value=3e-09, Identity=50%"; Hit description =Adenylosuccinate lyase-like protein
  Subcellular localization annotation: CTP_CleavageSite=84; ConfidenceScore=5.45e-01
MAPLPSLQNGQRTTRPRLERTTCPRHQRTTSPRLERTTRPRHQRTTCPRHQRTTSPRLERTTRPHHQRAARPYLQRTTFTLTVRGLHALTLRGLHVLTIRGLHALTSRGLHVLALRGLHALTLGTSYPHRQRATRPHLERTTRPHHQRAARPHL

SEQ ID NO: 109465 - protein, 308 aa, Glycine max
  Coding DNA Sequence Number=SeqID_17780
  Homolog annotation: Hit_ID=Q6WAY6; Match level="QueryCoverage=74%, HitCoverage=37%, E-value=7e-26, Identity=35%"; Hit description =Putative uncharacterized protein
ELDHRKQVENGVVGIPRKYLEAKARILAGKGKWAPFIDILALLIFRGVLFLNVDGLVDLAVIDAFLAYHDHKESPVVAMLADLYDTFDRRCEKSSTRIVCCTPALYVWLVSHLFRQEVRHACPLESHHSNTEKGDTNWDQLLANKEGASINWFPRWKEGRVRVLISCRGFPNVPLMGTRGCISYNLVLAIRQLGYPMRGAPLEEELAPVISRGFNKTNMETLQKVRKAWEVVQKKDKELRGSNNGPIGGYRKRLKAYVQGLDWLPSLRNAKKEEVEAPEKNEEVQALRTELKQAQTVKERFKSAALLR

SEQ ID NO: 109466 - protein, 89 aa, Glycine max
  Coding DNA Sequence Number=SeqID_17781
MESSDMRGYRMVTRTFRQLGANEPIAAQRLTSSSAPFVILTHGVWWHAEIPYGHPHLSSSWGEILMLGTDVEQDVTTSRFRTCRLCVTV

SEQ ID NO: 109467 - protein, 113 aa, Glycine max
  Coding DNA Sequence Number=SeqID_17782
MYPLLVPQRMYPPMEWEESKEFSDCIVLNSLTREKRDTKEFRRLVPCSFGKERRETQKEFRRLVLGEFFLAKGEENEKMNSTSFQGLENQKTSESFWYKRRRRRRTSKRFQGF

SEQ ID NO: 109468 - protein, 71 aa, Glycine max
  Coding DNA Sequence Number=SeqID_17783
  Homolog annotation: Hit_ID=Q8LNP1; Match level="QueryCoverage=60%, HitCoverage=11%, E-value=3e-08, Identity=65%"; Hit description =Putative uncharacterized protein T18N24.41
AGEERKLQLSELDEIYLEAYENSKFYKEKTKKFHDSLIAKKDFMLRSKGSPQIRASRSRDTGGNLSSQIPP

SEQ ID NO: 109469 - protein, 75 aa, Glycine max
  Coding DNA Sequence Number=SeqID_17784
MFGTGWCVAVGRAGSASTAVLATAAVAALLSISHFIPSMASIIEAIGSFKAYMSAFICSCTSSRSPIVLDLDLVR

SEQ ID NO: 109470 - protein, 139 aa, Glycine max
  Coding DNA Sequence Number=SeqID_17785
  Homolog annotation: Hit_ID=Q2HW90; Match level="QueryCoverage=42%, HitCoverage=11%, E-value=8e-07, Identity=44%"; Hit description =Putative uncharacterized protein
MEAVVSLTQYYDQPLRCFTFGDFQLVPTVEEFEEILGCPLGGRKPYLFSGFLPSLSKIVVVQREPGGSYLGGLSVWLVLHLFNHDIRHPCPLRSHRSCVEKRRVDWDQHLAGIRGRKGGSSLLMWGIPKHPIDRDEGLH

SEQ ID NO: 109471 - protein, 31 aa, Glycine max
  Coding DNA Sequence Number=SeqID_17786
MTCSIENSAINTPDRAAGMYFQPVEIPRLGI

SEQ ID NO: 109472 - protein, 38 aa, Glycine max
  Coding DNA Sequence Number=SeqID_17787
MELQRKIKKKSLGSFLEKLPWEASVTPLQLSSPPCQNT

SEQ ID NO: 109473 - protein, 165 aa, Glycine max
  Coding DNA Sequence Number=SeqID_17788
MWMDSKTIKDKATATASSTVREAESVLQPALNPGLDRNTTVFGRRYSPQAYPYGLTPDFIPRATPEDLSQAPTFEGQLPPYEDYPGQDDGEGDTHLGTLLHLKDLSPHELPQPNIVRHTPASPTPVKESVPFAEDKGKIEAHEERLRAVEGLGNYPFSDLADLCL

SEQ ID NO: 109474 - protein, 280 aa, Glycine max
  Coding DNA Sequence Number=SeqID_17789
  Homolog annotation: Hit_ID=A5BJL6; Match level="QueryCoverage=85%, HitCoverage=23%, E-value=1e-15, Identity=26%"; Hit description =Putative uncharacterized protein
MEIFIQSIDPGAWNAIIKGPFIPTKELNGELIPKEWNGELIPKEMRKDEKRKVQDDQKAKNIFTSGKKFEDEELNIKILNCLTRTFEPKITTIKESKNLATIMMEALFGKLLAYEHELTQQSYEEEIEKKMKGIALKVNSSREEYKDSSSSEVDAENFNLMVRKFGKILKKSKDKKFSKSSKKIENNNNYTFFECENMVKRKERMTKKQKRPYIAWEDSASTTSNSSDEEIANVCLMAKSMNDPSTSEKVEVSYPNFVRGPLLDDMRPFFGPCEVLGTHH

SEQ ID NO: 109475 - protein, 104 aa, Glycine max
  Coding DNA Sequence Number=SeqID_17790
MADQESAHEETTHGPNYTPSYSPSAHAPSATPNESIVAPEVEETTDNLEGTIEKGKSRLKSSLKSKILEQSSTLVNEIASDDEGETSIYASEMMGSGLTTHLEQ

SEQ ID NO: 109476 - protein, 92 aa, Glycine max
  Coding DNA Sequence Number=SeqID_17791
MTKLPKNVPSRENTSKPIEKKTTSEELKDLSEIDDGGSIIQIKRKAKDQQQIHAIQKKQKVAKRSTFEDPILHSKVPTKMKTKATRLNKAIR

SEQ ID NO: 109477 - protein, 139 aa, Glycine max
  Coding DNA Sequence Number=SeqID_17792
MAPIKLSVKRSRSDTVAEGTSAAPEFDSHRFRSAEHQQRFEPIKGWSFHRERRVQLRDDEYTDFQEEIARRRWMSLVTPMAKFDPEIVLEFYVNAWPTEEGVRDMRSWVRGQWIPFDADALSQFLGDLLVLEEGQECEF

SEQ ID NO: 109478 - protein, 139 aa, Glycine max
  Coding DNA Sequence Number=SeqID_17793
  Subcellular localization annotation: CTP_CleavageSite=55; ConfidenceScore=5.31e-01
MSSIICRGSAHKTPSGPGGAQQGPGVSNSSYGPLSVLQGARPPRKSCHRDIGITPARHLVDPEKSNRVLGFLALIMGLCQFYGVPITPSKVIKPPTNRAFIKKYCAPRQAQGETPQQPGMAGSRQQTHRRHLQSPSAHL

SEQ ID NO: 109479 - protein, 180 aa, Glycine max
  Coding DNA Sequence Number=SeqID_17794
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=50%, E-value=7e-24, Identity=100%"; Hit description=LacZ protein
  Subcellular localization annotation: CTP_CleavageSite=42; ConfidenceScore=5.23e-01
MKHFTDTLISANILVPGPPSRSTVSISLIHPATAADRPAAACANGGRARHGHRTSPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 109480 - protein, 231 aa, Glycine max
  Coding DNA Sequence Number=SeqID_17795
  Gene Ontology: Mol. function=leucyl aminopeptidase activity; Cellular component=intracellular; Biological process=protein metabolic process
  Homolog annotation: Hit_ID=A4WDA4; Match level="QueryCoverage=100%, HitCoverage=53%, E-value=1e-112, Identity=87%"; Hit description =Peptidase B
  Pfam annotation: Domain name=Peptidase_M17; Domain location=1-231; Score=326.9; E_value=3.6e-95; Accession=PF00883.12; Description =Cytosol aminopeptidase family, catalytic domain
MSYRITKGEDLREQNYMGIHTVGRGSERPPVLLALDYNPTGDKDAPVFACLVGKGITFDTGGYSLKQSAFMDSMKSDMGGAATITGALAFAITRGLKKRVKLYLCCADNMVSGNAFKLGDIIRYRNGKNVEVMNTDAEGRLVLADGLIDASAQKPELIIDMATLTGAAKTALGNDYHALFSFDDKLAARLLASAAAENEPFWRLPLAEFHRSQLPSNFAELNNTASAAYPA

SEQ ID NO: 109481 - protein, 45 aa, Glycine max
  Coding DNA Sequence Number=SeqID_17796
MGLSGLKEHSNPVTPKAYTPKSPLGSLPPDSGPTPKIILARRHCS

SEQ ID NO: 109482 - protein, 38 aa, Glycine max
  Coding DNA Sequence Number=SeqID_17797
GQIPRTPAFLDCICVCHTPNFVRGPLLDDVRPFFGPRE

SEQ ID NO: 109483 - protein, 18 aa, Glycine max
  Coding DNA Sequence Number=SeqID_17798
MPPFNSTALQVCQTSIFG

SEQ ID NO: 109484 - protein, 231 aa, Glycine max
  Coding DNA Sequence Number=SeqID_17799
  Homolog annotation: Hit_ID=O52175; Match level="QueryCoverage=30%, HitCoverage=80%, E-value=2e-31, Identity=97%"; Hit description =Salmonella berta plasmid pBERT, complete plasmid sequence
  Subcellular localization annotation: CTP_CleavageSite=22; ConfidenceScore=5.11e-01
MVKVGTSYVPINVSFSPKVEPRASRYQRHLIITTSANVYASFVTGCSHSPFGKPVGNCNEERAGDRGGPLRITPALKGGCVILAYYVGTVPGCSVEVLRGEKKATGASAEYVNTTHYRPLPAPDSYRSVVMRRRKALERGGFPRKLQEFDILTDSESRQSRFSIGSAPLTSITKSDAQISGGETRQDYKDTRRFPLAAPSCALLFLPFGLPVSFRCYGRVCLIPRLTLSSR

SEQ ID NO: 109485 - protein, 187 aa, Glycine max
  Coding DNA Sequence Number=SeqID_17800
  Gene Ontology: Mol. function=transcription factor activity; Cellular component=membrane; Biological process=regulation of transcription, DNA-dependent
  Homolog annotation: Hit_ID=P0ACQ6; Match level="QueryCoverage=100%, HitCoverage=61%, E-value=3e-99, Identity=96%"; Hit description =Hydrogen peroxide-inducible genes activator
  Pfam annotation: Domain name=HTH_1; Domain location=3-62; Score=82.4; E_value=1.4e-21; Accession=PF00126.18; Description=Bacterial regulatory helix-turn-helix protein, lysR family
MNIRDLEYLVALAEHRHFRRAADSCHVSQPTLSGQIRKLEDELGVMLLERTSRKVLFTQAGLLLVDQARTVLREVKVLKEMASQQGEAMSGPLHIGLIPTVGPYLLPHIIPMLHQTFPKLEMYLHEAQTHQLLAQLDSGKLDCAILALVKESEAFIEVPLFDEPMMLAIYEDHPWANRDRVPMADLA

SEQ ID NO: 109486 - protein, 308 aa, Glycine max
  Coding DNA Sequence Number=SeqID_17801
  Gene Ontology: Mol. function=oxidoreductase activity, acting on the aldehyde or oxo group of donors, NAD or NADP as acceptor; Cellular component=cytoplasm; Biological process=amino acid biosynthetic process
  Homolog annotation: Hit_ID=A4WG53; Match level="QueryCoverage=100%, HitCoverage=92%, E-value=1e-164, Identity=91%"; Hit description=N -acetyl-gamma-glutamyl-phosphate reductase
  Pfam annotation: Domain name=Semialdhyde_dh; Domain location=1-120; Score=110.2; E_value=6.4e-30; Accession=PF01118.15; Description =Semialdehyde dehydrogenase, NAD binding domain
  Pfam annotation: Domain name=Semialdhyde_dhC; Domain location=137 -285; Score=140.9; E_value=3.5e-39; Accession=PF02774.9; Description =Semialdehyde dehydrogenase, dimerisation domain
  Pfam module annotation: Pfam domain module=Semialdhyde_dh::Semialdhyde _dhC; Domain location=1-120::137-285
MTITALTVSAQSNDAGKLISDLHPQLKGMVDLPLQPMSDISEFTDGVDVVFLATAHEVSHDLAPQFLAAGCVVFDLSGAFRVNDGAFYEKYYGFTHQHPDLLEKAVYGLAEWSADKLKEADLIAVPGCYPTAAQLSLKPLIDAGLLDLNQWPVINATSGVSGAGRKAAISNSFCEVSLQPYGVFNHRHHPEITTHLGADVIFTPHLGSFPRGILETITCRLKPGVTSEQVKAVFTQAYADKPLVRLYDKGVPALKNVVGLPFCDIGFAVQGEHLIVVAAEDNLLKGAAAQAMQCANIRFGFPETQALI

SEQ ID NO: 109487 - protein, 59 aa, Glycine max
  Coding DNA Sequence Number=SeqID_17802
MHLPQLISDVIYCLQGLCPECLSPPARSSGPPTNQAFIKKYCAPRQAQGETPQQHWDGR

SEQ ID NO: 109488 - protein, 89 aa, Glycine max
  Coding DNA Sequence Number=SeqID_17803
HGYGALTSTVDGDEAPSTVDDDVALHGNLLNTPHGKLPFTATMVIEEEEKPLPSNLLLTATMVTNENAGEASKKKTKTAEVRKKKNKSG

SEQ ID NO: 109489 - protein, 145 aa, Glycine max
  Coding DNA Sequence Number=SeqID_17804
MPISPCRCIGWDRAHKTPSGPEEVQQGPGVSSSGHGPLESYKVPVPPARSCHRDIGKNHTHKDTQWTRRSPIGPCGFQLWLRASVVLQGAHSPRQGHIIIGIAPARHPVDSKKSNRVLELSCSNYGSLSVLWSTCHLQQGHQAPY

SEQ ID NO: 109490 - protein, 113 aa, Glycine max
  Coding DNA Sequence Number=SeqID_17805
MPISPCGRIASTRHPVDPEKSNRALGFPALVTGLYQSYRLPIPPPPAARDRARRTPGGPKEVQQGPGVSSSDYGPLSVLQSARRPNKVIRPRINRAFIKKYCAPRRAQGETPQ

SEQ ID NO: 109491 - protein, 141 aa, Glycine max
  Coding DNA Sequence Number=SeqID_17806
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
  Subcellular localization annotation: CTP_CleavageSite=35; ConfidenceScore=5.02e-01
MKHFTDTLISANIGVFGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 109492 - protein, 195 aa, Glycine max
  Coding DNA Sequence Number=SeqID_17807
ASYDSSRLVSRDAWDCYVDNILDRNILPERNVKLYITEFDEFIREVKRRNWHRELTNFFEGSIDVAVVKKFYANLYYPEDKAPKQVRVQGHLIKFDADSLNTFLKTLVVEARPLRAGLAVEALEEGSYNSVMKMDMNIGAFISGQISLIAQSNSSRLGFPALIIALCKARGVTSDSLTYESLSPAINLAYIKKNC

SEQ ID NO: 109493 - protein, 105 aa, Glycine max
  Coding DNA Sequence Number=SeqID_17808
LGRIDGDPVLRETRIWATWEYVSSVGGGLQGMSGTWGYVAGVRRPWGRQASSWQSTDKRKTRPQSKEACGGWPAEAKMVSGNRLPRGCNRLPGLKNEVRKLREPL

SEQ ID NO: 109494 - protein, 110 aa, Glycine max
  Coding DNA Sequence Number=SeqID_17809
MYKDKWAHTEPMGPKSTLRLMRTQGPSPASLAQSSWSLLSNALGGNVFQGYFDDAKESRVKKNPKIQESSFNNQDSRFKKNQDQDSRLKIQESREESIKISIKKVFQNIE

SEQ ID NO: 109495 - protein, 170 aa, Glycine max
  Coding DNA Sequence Number=SeqID_17810
  Pfam annotation: Domain name=zf-CCHC; Domain location=25-42; Score =16.9; E_value=0.0042; Accession=PF00098.14; Description=Zinc knuckle
MTDYARVKKKKKGKGIKKSKVDPKDICNYCKEPSHWKKDCSKKRKTLLLPLFRIIPHQKIICFWVLVNNYKIILKNGYSTQAVLIICVYTKVVLKKILVSTVPWIQKVFLIGLKVELCKSEGKGSICYLKALGPLTEQIDAINDVSLIKDVSMFYAEGSSTKHRCLMSLA

SEQ ID NO: 109496 - protein, 78 aa, Glycine max
  Coding DNA Sequence Number=SeqID_17811
  Subcellular localization annotation: CTP_CleavageSite=64; ConfidenceScore=5.08e-01
MVVLTSGMLRNFMDYAKMLVLRVPKGTNKVRKSIAKQPRRVTLEDYSSTSVPQYFSSVALPEVQAQNLTYPPSLIQLI

SEQ ID NO: 109497 - protein, 121 aa, Glycine max
  Coding DNA Sequence Number=SeqID_17812
MKADTKALKEQMATMMEAMINIKEIREVNAAAITATSTIAEVDLTPPYGLNQINHPTSDMVGLEGKELGGETHEMPHHNLVDFEPCLGYATEGQAVGDIPLQNTLEGPQYHPQPHLLHSTT

SEQ ID NO: 109498 - protein, 284 aa, Glycine max
  Coding DNA Sequence Number=SeqID_17813
MAKKFSEEGDDHLTASGAVQGEGFLGEHQNDAGGNQSQRPACDHLVVQQPTGHGDQRHDANQHHQQFRQMQRLEVRLGTVFLHPLAAHHKVDQGDQHADHAQRECHAPAVFRRQPRSGQHREEGADVHRHVIHGEGTVETRIVFLIAGGQQGGRVGLEQAAAHGDGRHAHVDPEDVVAGVGHHGVTGGQHQRAEHDHAFGAQHFVAQPAADGDEAVYQGAEGREQGDGVGFAHAEHLDQINRHDALQAVVAETLPQFDREDQIERFRLFERVKANALRMLVVCC

SEQ ID NO: 109499 - protein, 75 aa, Glycine max
  Coding DNA Sequence Number=SeqID_17814
MVRTRGLGRALGQVTGRGVGRGDRDDSGDAPQRRRHTASAQRQRVAVTATHDEPVIPAPDVQDDPMEAPTAAEDI

SEQ ID NO: 109500 - protein, 118 aa, Glycine max
  Coding DNA Sequence Number=SeqID_17815
MTRGNPGDLQPFDPKIDRTFHRLVRHSVHPGHSVHFEHFEHSKHFVAGYFEYFDFEHSTTNFHTENMAQPPPRERTFREMAIPNFTYESLCIQYPDEGVPYVLKTGLIHLLPKFHGLA

SEQ ID NO: 109501 - protein, 114 aa, Glycine max
  Coding DNA Sequence Number=SeqID_17816
  Homolog annotation: Hit_ID=A0PAV3; Match level="QueryCoverage=24%, HitCoverage=14%, E-value=6e-07, Identity=89%"; Hit description =Restriction endonuclease
WNSYVPINVSFSPKVGPGLPGINRDTRIYLFCEVISVTAVPPVQLLTGWCVTAKAPPDISAGKCSGRVPFAIQAAQLLGRAIGAGLFAITPAGERGMCCKAIKLGNARVFPVTT

SEQ ID NO: 109502 - protein, 124 aa, Glycine max
  Coding DNA Sequence Number=SeqID_17817
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQASYSRFKELVAQRTLRKICSAR

SEQ ID NO: 109503 - protein, 35 aa, Glycine max
  Coding DNA Sequence Number=SeqID_17818
MADQQATKSKAKGSKIPWICVYIAKIPHKNIHMFR

SEQ ID NO: 109504 - protein, 64 aa, Glycine max
  Coding DNA Sequence Number=SeqID_17819
MMAHQQTTKIWMTPLPMKEVKSGILITIFCKRLSQPILRREGDVRLTDASSKKGKCVESPPTFI

SEQ ID NO: 109505 - protein, 54 aa, Glycine max
  Coding DNA Sequence Number=SeqID_17820
MDKSLKVGEDEWREREKGGHEIYASKELWFSPLIQDQVQDSPLSVLRCHEACKT

SEQ ID NO: 109506 - protein, 249 aa, Glycine max
  Coding DNA Sequence Number=SeqID_17821
MVWYRRKTKMFVDPNKANTAALGEVVETLQYMVSPQGRNTWTVDDLMPYVDKLAIISKEQERITEPISHGPASEREFPAQEFHILQSSVETQGIGRRRDPVEAEQYSQQMMERGHGMYYTPATFSEYPSQMYQYPFTGHHTDTSETSHSFGGVAETQPHFSWPTMTPSQQHDAPMATPNALFAPQWNVPGAIPDMGDLLGVDLRQEFSVEADQAEAGRQRGDRRNPYRQARRWDRPCGTSSRHHGHHND

SEQ ID NO: 109507 - protein, 138 aa, Glycine max
  Coding DNA Sequence Number=SeqID_17822
  Homolog annotation: Hit_ID=A7UQU7; Match level="QueryCoverage=92%, HitCoverage=22%, E-value=5e-13, Identity=35%"; Hit description=IMP dehydrogenase/GMP reductase, putative
MYDHLNDVSKSTAKQLAGYITLLQCWIYEHFLSVAASVPAEDYDQRRPRACCWTSGKALQILRYWRRLDRLTLDAVCWIAYGDHRAFREFEVTSLFSGHIRWGPYMVIHRSEKVIWQFGYIQIILPHPAVPSLSYDEI

SEQ ID NO: 109508 - protein, 69 aa, Glycine max
  Coding DNA Sequence Number=SeqID_17823
MAGVGDNGGVYHQLDGSQRLLLDAMTTQMQRLLNRNNEELYRRIAKSSLFILKPLSPREVCDDQIRMRE

SEQ ID NO: 109509 - protein, 414 aa, Glycine max
  Coding DNA Sequence Number=SeqID_17824
  Homolog annotation: Hit_ID=UPI00006A2D9E; Match level="QueryCoverage =39%, HitCoverage=85%, E-value=9e-13, Identity=16%"; Hit description =UPI00006A2D9E related cluster
LHALAIRGPHVLTFVRLHALTFRGPHVLTFRGLHALAIRGLHVLTSVGLHALTFRGLHVLANRGLHALTLRGLHVLTNRGLHTLTLRGLHVLGNRRLHALTLERATRLHVLTIRGLHALTSSSEDYMATRPRLRRTTRPHHQRTASPHLQRATGPRHQRTTRPHVLTFRGLHALANRGLHVLANRGLHALTFRGLHVLANRGLHALTLERATRPLQQRTACPHLERTTRRRLERTTRPHHQRAARPHLIFRGLHVLTFRGLRALAFVGLHALTFRGLHVLTFRGLRALAFVGLHALTIRGLHVLTFRGLHPLAIRAPHVLTFVGLHALTFRGPHALTFRGLHALAIRGLHVLTSVGLHALTFRGLHVLANRGLHALTFRGLHVLANKGLHALTFRGLHILANRGLHALTFRGLH

SEQ ID NO: 109510 - protein, 64 aa, Glycine max
  Coding DNA Sequence Number=SeqID_17825
MKAIPSKPTRKGRKWQMFSKKEGMMRILKLAKYRLKAQVEKDEGPSGEGQSSRVEKDESPCGEG

SEQ ID NO: 109511 - protein, 187 aa, Glycine max
  Coding DNA Sequence Number=SeqID_17826
MAEPSKKRKGSSSRSQRHFETQETHIPSSISSSSLFSTEEQRIRYTNLFSSRSIIDPKFIDMDFFSNESFECIQAFENSNLFPFMSLKLPVYTELVKAFYSNLEIQEGTLISEVYGIKMVIDQSLFYDLTQLSSEGVPFEGTLNDDWKFDFSVHDARRLVCTNQADMTGRLLAGSLAFESRILQGIL

SEQ ID NO: 109512 - protein, 168 aa, Glycine max
  Coding DNA Sequence Number=SeqID_17827
  Subcellular localization annotation: CTP_CleavageSite=37; ConfidenceScore=5.79e-01
IIGSPPASTPPPPPPPPPPPPTSPPPPPPPDASASPSAMKRTRKASRLRSLSTIPPSAERPVVHVDPATGKADDPHKKKLRTYLGIVARDKVDVTYENWKEVPTAQKDLIWEDIQAEFDILEASDTDQDGVEDTVCEKYGISKEKWAQFCQTRRDPSWEDVRKKAHTI

SEQ ID NO: 109513 - protein, 93 aa, Glycine max
  Coding DNA Sequence Number=SeqID_17828
SRLFRFFRRFPQINVGGDSARIPFVEHASRKSRVALPPKEFIFMGQCINPRSLNISCAFMCELKCVPHLLSTHHFSLGFSIVVPVDVLPSTMV

SEQ ID NO: 109514 - protein, 89 aa, Glycine max
  Coding DNA Sequence Number=SeqID_17829
RQVQGDAPQAASAPPPPHQAGPAGSFDMEQYLRHVVRQEAANHRAHVRTNETLYQLSLSMQSQGFASFSCPTPDQFRAEVAWPGDWPKA

SEQ ID NO: 109515 - protein, 282 aa, Glycine max
  Coding DNA Sequence Number=SeqID_17830
VDSRGSPVEPSKKRKGSSSTAAMLPITATDHPEHPQHLFIHLCLLQDHPHCFLPIISVYVFQNSGLVDFMSLKLPHYPELVKVFYFNLKIQDGIITSEVLCIPMVIDQSLFFSLTHLPCQGAPFEGTIVDDWKFDYSGHDARRMALQANAPLPYPQLITLFLRHFQIPLDDEPFVQVKRSFAIGAGAVTSFGYRKDWNGQWLKKDALPPQDERTPSPPPQQDDSALMNEVLSELRGLRSYVGERFDSLDTRFADMDIRLTQLEEDVGYIRQSFDLPPPPPPS

SEQ ID NO: 109516 - protein, 116 aa, Glycine max
  Coding DNA Sequence Number=SeqID_17831
TTSIKFGTVAGEQCPKKKVSHAVAACLRPDECMTRGNPSNLQPFDPEIDRTFHRLVRHHLVPFEHPEHSVIGDFEHYSFEHSDFEHSENMAQPPPRERTLREMATPDFTYERLCVQ

SEQ ID NO: 109517 - protein, 148 aa, Glycine max
  Coding DNA Sequence Number=SeqID_17832
MAPRKLASKRSRKDKAAEGTSSAPEYDSHRFRSVVHQQRFEAIKGWSFLRERRVQLRDDEYTDFQEEIGRRRWAPLVTPMAKFDPEIVLEFYANAWPTEEGVRDMRSWVRGFCPDCCREASANHAHQYDHPDPDMDDVAPQQHPAHRS

SEQ ID NO: 109518 - protein, 20 aa, Glycine max
  Coding DNA Sequence Number=SeqID_17833
MPMVQGDIIWNCYIVELFVR

SEQ ID NO: 109519 - protein, 105 aa, Glycine max
  Coding DNA Sequence Number=SeqID_17834
  Subcellular localization annotation: CTP_CleavageSite=31; ConfidenceScore=5.01e-01
VSKISFSASSIFLFGIALGGNGRGIGGYCVKGSLTGSSAGATTDSEWRLLSLAEIAYSRWLFASLTLLRKVEEEPQLLVVFVVTVVVLEEEHKGCLGQQHSEKEG

SEQ ID NO: 109520 - protein, 137 aa, Glycine max
  Coding DNA Sequence Number=SeqID_17835
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=71%, E-value=3e-24, Identity=68%"; Hit description=LacZ protein
MILTILLPRLWKTERNGCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 109521 - protein, 139 aa, Glycine max
  Coding DNA Sequence Number=SeqID_17836
  Homolog annotation: Hit_ID=Q6UUU1; Match level="QueryCoverage=43%, HitCoverage=40%, E-value=1e-18, Identity=78%"; Hit description =Putative uncharacterized protein
MNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWPRLSHSTPDTQFP

SEQ ID NO: 109522 - protein, 125 aa, Glycine max
  Coding DNA Sequence Number=SeqID_17837
  Homolog annotation: Hit_ID=A7PD81; Match level="QueryCoverage=53%, HitCoverage=27%, E-value=5e-15, Identity=63%"; Hit description =Chromosome chr17 scaffold_12, whole genome shotgun sequence
MEEEKAAAYYNELTRKGERAARFKQGLDFSSLAPNDDVAKPSSSFLSKFVKASSESKKQAQLQSIHNKRSRKSLLSSLGFRAGKGTAIEVEDEVGAEKNVGKGAEAVIDTGKHEDEAGVERDIGI

SEQ ID NO: 109523 - protein, 52 aa, Glycine max
  Coding DNA Sequence Number=SeqID_17838
MASSNRLPRGVIDYKAKKWRQDVEVASGNRLPMLCNRLHRVTGHWFPCAEAV

SEQ ID NO: 109524 - protein, 100 aa, Glycine max
  Coding DNA Sequence Number=SeqID_17839
WSGGRLEYRATPHGDLVGYRYRIDHMESHEVKLQFGLQQDIPVDPMNLDLFHQIDMRDNHYTDWMEYHAEWINIWKNKHNNILVGQWVEGIVTHRPAYME

SEQ ID NO: 109525 - protein, 228 aa, Glycine max
  Coding DNA Sequence Number=SeqID_17840
  Gene Ontology: Biological process=transposition, DNA-mediated
  Homolog annotation: Hit_ID=Q6UUU1; Match level="QueryCoverage=26%, HitCoverage=40%, E-value=3e-18, Identity=78%"; Hit description =Putative uncharacterized protein
LAPGLPGINRDTQDLFILRSDLPSQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 109526 - protein, 83 aa, Glycine max
  Coding DNA Sequence Number=SeqID_17841
  Homolog annotation: Hit_ID=A8GK34; Match level="QueryCoverage=100%, HitCoverage=68%, E-value=1e-37, Identity=89%"; Hit description =Putative uncharacterized protein
MKLGDVLKAENAQLGISFCGSGGACAITAQTKHGYKAKYGMRSVEEGVTAINEGCNVLGFGFMDKEELGQKLVEAYIKKHGNP

SEQ ID NO: 109527 - protein, 254 aa, Glycine max
  Coding DNA Sequence Number=SeqID_17842
  Homolog annotation: Hit_ID=Q5XM22; Match level="QueryCoverage=42%, HitCoverage=76%, E-value=1e-19, Identity=43%"; Hit description =Resistance-like protein HAAS-2
RRCQAGHWTAAAHTYLLHLLGCTLFANKSATNVHVVYLEALRDLSMTERNAWGVAALVHMYDQLNDAFMSHSRQLGGYITLLQCWIYEHFPSVADSTTNQEYDEDSPRAWSAWTDSGFRMSVGSRMGSTDQSGTSTSDHAIPVSCAGDLLLFITDQRGSCGSLDTREVCVVSGQCSSDYMDWFFRILHPFMTPGHALDPLPHGHASQPRVVPQAPRTDISHEVCDDIAERLERHLSLRVITPGSSTHEVIEECL

SEQ ID NO: 109528 - protein, 71 aa, Glycine max
  Coding DNA Sequence Number=SeqID_17843
MWIGRFALTLNGSQELPRLLAKAKAMADTYSAPEEIHGLLDYWKNTITKRAPRHPYRTRSKSRTMGDQEET

SEQ ID NO: 109529 - protein, 206 aa, Glycine max
  Coding DNA Sequence Number=SeqID_17844
MASVLCIGGLVGVGVDAESGGACAGVGIGAGAEVEALEGALALALRDPGNAKLMAGLRDSKVSDSDTTPLAMHKDVISAGKPNLEEGEVGVRKDTASLHVSGQGPDEYDRNVIEDIIKLLDQGEVNAIIHLPGQVPVPLASLQLPEELTIMGAPMVERMKHVSSLRPSAPKHNKGMKLDRMLAKPYSMIERYLRLTGMPRLAHEQT

SEQ ID NO: 109530 - protein, 171 aa, Glycine max
  Coding DNA Sequence Number=SeqID_17845
MTYALYVKLNPKLHPICSSLAIKCCHCGGNSSLGLRKAQFYIIVPWLIFFTPQLQLEERILLEEGRLGGWLLQRLDQTYLREVAKEKKHRLLTMLDFKVDGEQREQESLDGEEDREKDKTTRRRRNIPRYGGEGEEAETCGDARVRRTRCSDAHRDGFARRRLEEEESAKA

SEQ ID NO: 109531 - protein, 110 aa, Glycine max
  Coding DNA Sequence Number=SeqID_17846
MEDIYKRWTKYLDSTRSRVNHPPPINCAFCGGEHFNDNCHLYSMKNSWWVQEIHPYNQYEEEKTPTLESVFAEFTAYHATSTANQNSMQNQEIQVGKSYSVENYQWEQEL

SEQ ID NO: 109532 - protein, 150 aa, Glycine max
  Coding DNA Sequence Number=SeqID_17847
MATHLTLRGLHALAFRGLHGPRLYRAARPRPSEDYTTSPFRGIHALALRPPGLHVSLIAHTLQRTTCRLSEDYMSSFIGNYMSSPSEDYTSSASEDYHVLTFRRLDILPSKDYTYLTFRGLHVLAFRGPHALAFVGPTRPHFRGLHRHPS

SEQ ID NO: 109533 - protein, 90 aa, Glycine max
  Coding DNA Sequence Number=SeqID_17848
MVTRSVKFRNVAETKRKYCYAIREFLPTWAFQILPPEGGCFWRKQPGSPGRAGRKSKPRRFRNVSVGNYAKIFNRSSTFIVRSSFSSVFN

SEQ ID NO: 109534 - protein, 85 aa, Glycine max
  Coding DNA Sequence Number=SeqID_17849
AQGDAPQDADAPPPPHQADPAGSLGIEHYLQHLVRQQAANHRGQVQIHECLYRFNLSQQGQGFALFACPTPEQFRAEVAWPGDWP

SEQ ID NO: 109535 - protein, 144 aa, Glycine max
  Coding DNA Sequence Number=SeqID_17850
  Subcellular localization annotation: CTP_CleavageSite=50; ConfidenceScore=5.15e-01
MVKVGTSYVPINVSFSPKVGARAFPINGHQDYCRSWRSGTACRARPLPFGAQLFGKPDRCGPFAINESPSGKGECCKLRLSWANAGVFITAYYVGKTETGEIRSGEPRLPDRARLRSFDCGETEMAYERGGDFLEDARKILNRE

SEQ ID NO: 109536 - protein, 228 aa, Glycine max
  Coding DNA Sequence Number=SeqID_17851
  Homolog annotation: Hit_ID=Q6UUU1; Match level="QueryCoverage=26%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLRIEAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 109537 - protein, 110 aa, Glycine max
  Coding DNA Sequence Number=SeqID_17852
MACTHIPVEAKILKNPDESLETSNNSFQNCPMCGVACQSGPHQLDFTPYASGSYSAQWNSLGHLHDMHMLCSSRILRKMEVEETKQGLWLSLNYRIDIRASLAYDTGIWG

SEQ ID NO: 109538 - protein, 166 aa, Glycine max
  Coding DNA Sequence Number=SeqID_17853
MSEIEEVQEQMKADMEPMKKQMTTMMEAMMSMRRMMEVNVATVVAVSTAIELDPTHPPGFNQVNHPASDMVGQGGKALGSMGGPHFVQVQSKHSFPPYGLPPNNTPLNTTHTPDENVDHSAPIPIENQHPQSGHAQVSQPMGETHEAPRDHNLVDFEPHVGYATEG

SEQ ID NO: 109539 - protein, 92 aa, Glycine max
  Coding DNA Sequence Number=SeqID_17854
  Pfam annotation: Domain name=zf-CCHC; Domain location=20-37; Score =28.6; E_value=2.2e-05; Accession=PF00098.14; Description=Zinc knuckle
MERRHNFDNGKRSQEGSPTLKCYKCNQPGHIKAHCPTNESWLEKNEKKFHEERRSKKAYIAWDNNDSSDASEKEINFLSKDYESDENISQEV

SEQ ID NO: 109540 - protein, 211 aa, Glycine max
  Coding DNA Sequence Number=SeqID_17855
MEKSEKKNHSEKKLKKAYITWDENDMKSSEDSENEEINLCLMAKSYESDEEDPQFILTCKDPSKKRKGSSSTATAAAHRRHGPSGAPTTPIPPSLSSPRSSTLFSSDDQRLRYLSQFSSRIILDPKYLDVEFFNDETFDCYQVFQNSGLVDFMSLKLPYYPELVKVFYCNLKIQDGIIMFEVHGTSMVIDQSLFFSLTHLPSQGAPFEGTI

SEQ ID NO: 109541 - protein, 78 aa, Glycine max
  Coding DNA Sequence Number=SeqID_17856
MSVRNCINESANARGSRRLSRIGRQLGERVCKAINVGSPGCSSHEAFVAEKATASEYVNTTHIGRIGAPPSVERHAQN

SEQ ID NO: 109542 - protein, 172 aa, Glycine max
  Coding DNA Sequence Number=SeqID_17857
MDLKEGCTYVMHNFRVSKNDGKYRVCDHPYKLTFIGVTIVRQCQLDGLPFKNYIFADFLDVIVGQLQSNLLVGSYPCSVSNSLKASKLTINEPVAPIEEFNKKLSELGIEICSVLTRRSQWSSQPSGSAQLSSRETFISKSEAKTISEINNFCEVIILYMFTCLSLLWLPPA

SEQ ID NO: 109543 - protein, 115 aa, Glycine max
  Coding DNA Sequence Number=SeqID_17858
  Subcellular localization annotation: CTP_CleavageSite=43; ConfidenceScore=5.37e-01
MEHASRKSRVALPPKGIAPTRCPMHPKKSNRSLGFPALVTGLCQSYRVPVPPARSCHRDIGIAPTRHPVDTKKSNRALGFPALVTGLCQSYRVPVPPPRSCHRDVGKYTYGSADF

SEQ ID NO: 109544 - protein, 155 aa, Glycine max
  Coding DNA Sequence Number=SeqID_17859
  Homolog annotation: Hit_ID=Q6UUU1; Match level="QueryCoverage=58%, HitCoverage=79%, E-value=3e-19, Identity=51%"; Hit description =Putative uncharacterized protein
GKPVVPAALMNRPTRGERRFAYWALAECILAYYVGTDEGVSEVLHVAGEKRLHRCVSIICDTGYIPLPRSLTRYARSFDCGERKWLTNGAEISWKMPGRYLTGNGGETRQDYKRYQAFPPGGSIVRSPVPAFRFTGVIPLLWPRLSHSTPDTQFP

SEQ ID NO: 109545 - protein, 39 aa, Glycine max
  Coding DNA Sequence Number=SeqID_17860
MVEMMGRVNLGLKVRMVVIKCLCIVGYGKGGTYWVLGIF

SEQ ID NO: 109546 - protein, 153 aa, Glycine max
  Coding DNA Sequence Number=SeqID_17861
  Pfam annotation: Domain name=Filament_head; Domain location=42-141; Score=-2.8; E_value=0.1; Accession=PF04732.5; Description =Intermediate filament head (DNA binding
MTFEFVESFRCSLSSVLMSYVRESDILVKSYDHLNFSECFRCSISSVSKYYVPESDIRVKSYDHSNFSRASVVQFRASRINMSPNRTSVLKVMTIRICRELPLFTFKRLDELCPRIGHPVKSYDHLNFSSASVVEFRASRILCPRIRHPSEKL

SEQ ID NO: 109547 - protein, 252 aa, Glycine max
  Coding DNA Sequence Number=SeqID_17862
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFRQKLAQGFPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIAVSRDRATALQPGRQRETFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 109548 - protein, 54 aa, Glycine max
  Coding DNA Sequence Number=SeqID_17863
GNTGSNKDRRKSLKVYQSHTGQGLTFSPWVKVYGKLGFWLKAYRTAGHDIGFGQ

SEQ ID NO: 109549 - protein, 232 aa, Glycine max
  Coding DNA Sequence Number=SeqID_17864
MNHERERKRKEGTGAHGQQVQEMHLIRPLSLQAAHVGIHCGQALEKLLELATLVQPPQLLGPTNVPSVNEDTWQGQPGFATRDPTELREKTRVHGQVALVQRDAEPAQDGTHLFAVLERGADHAQAREVEHHALLRAGNGRRRERVGECDSVEDGGFGFGGGGGGGKVGFLEEERTRSGGRWRSGGCCILREVKGGLVYFAFRGGLRGKRDGLGEIEMALLNEVIMVAILVL

SEQ ID NO: 109550 - protein, 1244 aa, Glycine max
  Coding DNA Sequence Number=SeqID_17865
  Gene Ontology: Mol. function=small protein activating enzyme activity; Cellular component=cytoplasm; Biological process=protein modification process
  Homolog annotation: Hit_ID=A7NYA8; Match level="QueryCoverage=89%, HitCoverage=97%, E-value=0.0, Identity=79%"; Hit description =Chromosome chr6 scaffold_3, whole genome shotgun sequence
  Pfam annotation: Domain name=ThiF; Domain location=641-785; Score =168.1; E_value=2.3e-47; Accession=PF00899.12; Description=ThiF family
  Pfam annotation: Domain name=UBACT; Domain location=1029-1097; Score =120.3; E_value=5.5e-33; Accession=PF02134.12; Description=Repeat in ubiquitin-activating (UBA) protein
  Pfam annotation: Domain name=UBACT; Domain location=928-989; Score =45.0; E_value=2.6e-10; Accession=PF02134.12; Description=Repeat in ubiquitin-activating (UBA) protein
  Pfam annotation: Domain name=UBA_e1_C; Domain location=1103-1225; Score=206.7; E_value=5.4e-59; Accession=PF09358.1; Description =Ubiquitin-activating enzyme e1 C-term
  Pfam module annotation: Pfam domain module=ThiF::UBACT::UBACT::UBA_e1_ C; Domain location=641-785::1029-1097::928-989::1103-1225
MLRELGLGFCIVVVPLLVSRFLYIASFDFDPLRDRDVNCWLFILIAFVLVLTIAFRRSSLLHYMLPTKRPCEGLVAEEETHNNNDNNNNSNNNNNNNNNNNNNNNSNNSSSSSSSLKKNRIAAARTADSTVKNYESTDQSFNNNNSNSGNASEGASDMALGESNQPDIDEDLHSRQLAVYGRETMRRLFGSNVLVSGMQGLGVEIVDPICDDALFVGKILLNVSFIGVGAFCLMLLAKECRSFDSLLFIMMHFSGNDYQQAKNLILAGVKSVTLHDEGTVELWDLSSNFVFSENDVGKNRAAASVSKLQELNNAVIVQSLTTQLTKEHLSNFQAVVFTDISLEKAFEFNDYCHSHQPPIAFIKTEVRGLFGSVFCDFGPEFTVVDVDGEEPHTGIIASISNDNPALVSCVDDERLEFQDGDLVVFSEVHGMKELNDGKPRKIKDARAYSFTLEEDTTNYGTYEKGGIVTQVKQPKVLNFKPLKEAITDPGDFLLSDFSKFDRPPLLHLAFQALDKFISELGRFPVAGSEDDAQKLISVASHINDSLRDGKLEDINPKLLRYFAFGSRAVLNPMAAMFGGIVGQEVVKACSGKFYPLFQFFYFDSVESLPSEPVDPNDFRPVNGRYDAQISVFGQKLQKKLEDSKVFVVGSGALGCEFLKNLALMGVSCGSQGKLTITDDDVIEKSNLSRQFLFRDWNIGQAKSTVAASAAAAINPSFNIEALQNRVGTETENVFNDTFWENLSVVVNALDNVNARLYVDQRCLYFQKPLLESGTLGAKCNTQMVIPHLTENYGASRDPPEKQAPMCTVHSFPHNIDHCLTWARSEFEGLLEKTPAEVNAYLSNPSEYTNAMKNAGDAQARDNLERVLECLDQEKCETFEDCITWARLKFEDYFVNRVKQLIYTFPEDAATSTGAPFWSAPKRFPRPLQFSASDLGHLNFVSSASILRAETFGIPIPDWGKNPRKMAEAVDRVIVPDFQPKKDVKIVTDEKATSLSTASIDDAAVINDLVIKLERCRANLPPVFMMKPIQFEKDDDTNYHMDVIAGLANMRARNYSIPEVDKLKAKFIAGRIIPAIATSTAMATGLVCLELYKVLDGGHKVEDYRNTFANLALPLFSMAEPVPPKIIKHQDMSWTVWDRWILGDNPTLRELLEWLKAKGLNAYSISCGSCLLYNSMFPRHKDRMDKKVADLAREVAKFEILAYRRHLDVVVACEDDEDNDIDIPQISIYFRRYVLCWPGLIPILM

SEQ ID NO: 109551 - protein, 264 aa, Glycine max
  Coding DNA Sequence Number=SeqID_17866
  Homolog annotation: Hit_ID=A7NY92; Match level="QueryCoverage=90%, HitCoverage=92%, E-value=3e-65, Identity=58%"; Hit description =Chromosome chr6 scaffold_3, whole genome shotgun sequence
MSHSVDEQLSFLRSLIQARSFCDSTLRFLESLLVSKDVKSLIEVRSSLTHLLRSESLSVIRSIAAKTVHDKLLVLDFFVRAFSLVGDQQSCLALRYEALVMREHKSASCQWLQVSPAEWLSFVENAVHNGFHAVAEKACEIALSCLGNNDDLKHGRDPVPENLKAVISEITRLRNCAMASVASRSVQVQTAEYLKRKTTEQQKPDLIYTEKRCLASTSFRNGIKRQNIRKLREHQSLQQISSELNGRHPNLSFYTLKELVAYAI

SEQ ID NO: 109552 - protein, 91 aa, Glycine max
  Coding DNA Sequence Number=SeqID_17867
MRKSLKHYIWKVKPNPPRRENDDLEDYNKPDEIFDQNNGAEKIDKEKKRNVDGERVRRIEVTRARRREDIAIQMRVKRVGAMTLNAVEGRR

SEQ ID NO: 109553 - protein, 269 aa, Glycine max
  Coding DNA Sequence Number=SeqID_17868
  Gene Ontology: Mol. function=binding
  Homolog annotation: Hit_ID=A7NY71; Match level="QueryCoverage=81%, HitCoverage=21%, E-value=2e-73, Identity=64%"; Hit description =Chromosome chr6 scaffold_3, whole genome shotgun sequence
MYTLEAALEYTNTTTVMSFNTAHLITIFSTIDVVSSFGSPDDWESFLHYLGCLLEDESIWCDETVNDPVHPPKFVNDQVSHLTDEQFDGQISIASACVQKLQADTINNLIRCPYLATIEIERRKHLRGKGNDDNLMDGVVQYFCRFGHLACFTSDVEMFVEVLTTDKKAELLEKLMKTRDSLSAPLTKTLGLSISFFKIKQLLLGDMSKSSASDLEVSCVQMFEMYCKNLPLSKDMDPQESMHGEELLSMICNILVQGVLEWEETYKEI

SEQ ID NO: 109554 - protein, 481 aa, Glycine max
  Coding DNA Sequence Number=SeqID_17869
  Gene Ontology: Mol. function=binding
  Homolog annotation: Hit_ID=A7NY71; Match level="QueryCoverage=77%, HitCoverage=41%, E-value=1e-100, Identity=48%"; Hit description =Chromosome chr6 scaffold_3, whole genome shotgun sequence
MLLPSAAMPSAICICKFLTRRHNLLSAIDNTDGGNSVRILNSEGNMVIEFVQFKDRLQHSSQYLVARVETSILQLKQNADNIEEEEGVLQSLKCGIQFLELSKETKDRETSLKRVIEKKSLLPRMIYLSIQSASASIKEHVEVNGSVTPDIISELKLLLECYAQLLGFSLTEAIEVVMGFSNGERSCVVSDSNLIDWLNFTVFLNAWSLSSHELVQPDGNGCRPRIWNILDSMLEKYILEKVRFQEPQLCSPWSGMELLMQLVTEPLAWHGLVIQSCLRSCFPSGKKKKKSGLAYQSSMNLTKAITDSVVHLSHVLEDVLTWITEWNKRPEDEHLENILLLLRKDGHNDGPGEVFHILETFISSMNDAELGDRISQSLKSWSPADVFRKMMTGKLKGLRKCASVSAVIFIFNNTLSEQSSQFVARLLLALVFVGHFPDMNGFEGCERETRREVRFESWKKMVVAMRLVVPVVVGGWVDGDP

SEQ ID NO: 109555 - protein, 819 aa, Glycine max
  Coding DNA Sequence Number=SeqID_17870
  Gene Ontology: Mol. function=solute:hydrogen antiporter activity; Cellular component=integral to membrane; Biological process =regulation of pH
  Homolog annotation: Hit_ID=A7NY61; Match level="QueryCoverage=95%, HitCoverage=97%, E-value=0.0, Identity=53%"; Hit description =Chromosome chr6 scaffold_3, whole genome shotgun sequence
  Pfam annotation: Domain name=Na_H_Exchanger; Domain location=73-461; Score=147.4; E_value=4.1e-41; Accession=PF00999.12; Description =Sodiumhydrogen exchanger family
MSHNHSHASPISMKVGQDDNLIHNAMHAGITKAETLFGGSFICHSTANQINSKGIWFGDDPLAYYLPVFLLQLCLIFIFTHFIHLILKPFGQPSFVSQIIGGVTLGPSILGRNTAFIDKVFPSKGRNVIDTMGFFGFMLFVFLTGVKIDPTITFRSGKRTFAIGILGYFVPYTFAKTVVFMLTRFATLDSDVSKVLPIVIEIQCISAFPVITRFLVELQILNSEIGRLATSSSLVCDICFLFVMTIKFVARLSSTKSIGTSIGSFLSPTLFLIFIIFVVHPAAIWAIRQSPEGKPVQEIYICGVFLTLIFCGFLGEVFGLNAIVVSFFVGLAIPDGPPLGAALVNKLDSFVSVVFVPILFIIVGLRTDVYAIQKMKNIATIQFIICIAFCGKVLGALLPLIFLRMPFRDAFALGLIMNCKGTIELYLLISLKLKKAMNDECFTILVLTLVLVAGIVSPIVKTLYDPSKRFLAYKRRTIMHHRKDEELRILACIHRHDNVLAIMNLLAASNPTKASPINLVVLQLIKLVGRSSSLLVAHVPRKMLSHHSTQTEKIFNSFNKFEDVYKGKVTLHSYKGISPYATMHNDVCYLALEKRTTFIIIPFHKQWILGGTTESSFAFKQLNKNVLEKAPCSVGVLIDRGNQKMFWCGFKKGSIYQVAMLFFGGADDREALSYARRMLDQPYVHITLFHFSSPTEIVGGTERSKMLDTQILSEFRLKAFRNERVSYKEEMVMDGKDVLSVIEYMESCYDLVMVGRKHADSKLMSEIGKWKHGELGIIGEILASLNIGAKTSILVVQQQTRFWGSRDPEESTHLRKEDI

SEQ ID NO: 109556 - protein, 380 aa, Glycine max
  Coding DNA Sequence Number=SeqID_17871
  Gene Ontology: Mol. function=methyltransferase activity; Biological process=metabolic process
  Homolog annotation: Hit_ID=A7NY60; Match level="QueryCoverage=58%, HitCoverage=53%, E-value=4e-86, Identity=59%"; Hit description =Chromosome chr6 scaffold_3, whole genome shotgun sequence
  Pfam annotation: Domain name=Methyltransf_11; Domain location=154 -218; Score=2.1; E_value=0.053; Accession=PF08241.3; Description =Methyltransferase domain
  Subcellular localization annotation: CTP_CleavageSite=41; ConfidenceScore=5.60e-01
MRLPFYPPNQTQFSNHTPLSLAKNSFFFFRGYTASIHGTTRSETRLPAEHCGLSLLLRRPQLRRAVRHHRHRPWLNLRLRRLLLLLRKPHSHRPLPHLRRRRSVFRQELAPLRRTLRRYLPGPHRRGLPLPELPRSLLRHSGEDVLALKEVGVVDSVGIFKKPSPPMILHGDARRHPFSGDAFDFEFSCNGGLEQSPRSAEFAAEICRTLRPGGFAAVHVAVRDAYSFESFLELFDCFELIRTGEINSVDSSPALIEEEPLKPWIILKKNVENIKYLTSLVDISFKNRYVYVDVGARSYGSNIGSWFRKQYPKQSRTFEVYAIEADKAFHEEYRAKRGVTLLPYAAWVRNETLFFEITRDPSKKVMMRGRGRGMGRINPV

SEQ ID NO: 109557 - protein, 231 aa, Glycine max
  Coding DNA Sequence Number=SeqID_17872
  Homolog annotation: Hit_ID=A5C0F9; Match level="QueryCoverage=70%, HitCoverage=31%, E-value=1e-08, Identity=32%"; Hit description =Putative uncharacterized protein
MAEALHVQNSPSNQGVIEGNFDASIVDGKGTGLGVIFRNEFGEVKAAATKFLPICVEVHIAEALVFRWAIESAAYLMLNPVVFESDCLRLVSAWSSRNSNSNSYFAGIIKDCAVLLSNSSFKVLTHMNRSANRAADGAKLAFLAFESYWIGDVPPQIGDFVQDGVRPDGHFSFFIYSSHHKGRRESKTEWSGVHGSPGEILAMLGQSGSGKTSLLAALGSQLGEKLKHNLQ

SEQ ID NO: 109558 - protein, 72 aa, Glycine max
  Coding DNA Sequence Number=SeqID_17873
MDKVVGKDLFTRMQSVVEKVGFVTCIEGCECRMHGQDLDDCNTTVNEAPTVASVVVVDMVVGVTAGVNASER

SEQ ID NO: 109559 - protein, 1019 aa, Glycine max
  Coding DNA Sequence Number=SeqID_17874
  Gene Ontology: Mol. function=ubiquitin-protein ligase activity; Cellular component=ubiquitin ligase complex; Biological process =protein ubiquitination
  Homolog annotation: Hit_ID=O22193; Match level="QueryCoverage=84%, HitCoverage=99%, E-value=0.0, Identity=49%"; Hit description=U-box domain-containing protein 4
  Pfam annotation: Domain name=Arm; Domain location=745-785; Score =48.6; E_value=2.2e-11; Accession=PF00514.14; Description =Armadillobeta-catenin-like repeat
  Pfam annotation: Domain name=Arm; Domain location=786-826; Score =35.4; E_value=2e-07; Accession=PF00514.14; Description=Armadillobeta- catenin-like repeat
  Pfam annotation: Domain name=Arm; Domain location=827-867; Score =35.0; E_value=2.7e-07; Accession=PF00514.14; Description =Armadillobeta-catenin-like repeat
  Pfam annotation: Domain name=Arm; Domain location=868-907; Score =26.9; E_value=7.3e-05; Accession=PF00514.14; Description =Armadillobeta-catenin-like repeat
  Pfam annotation: Domain name=Arm; Domain location=908-948; Score =25.1; E_value=0.00026; Accession=PF00514.14; Description =Armadillobeta-catenin-like repeat
  Pfam annotation: Domain name=Arm; Domain location=950-990; Score=3.4; E_value=4.1; Accession=PF00514.14; Description=Armadillobeta-catenin -like repeat
  Pfam annotation: Domain name=DUF634; Domain location=736-940; Score= -160.2; E_value=0.089; Accession=PF04826.4; Description=Protein of unknown function (DUF634)
  Pfam annotation: Domain name=U-box; Domain location=396-470; Score =97.1; E_value=5.6e-26; Accession=PF04564.6; Description=U-box domain
  Pfam module annotation: Pfam domain module=Arm::Arm::Arm::Arm::Arm::Ar m::DUF634::U-box; Domain location=745-785::786-826::827-867::868 -907::908-948::950-990::736-940::396-470
MADETRKRLGFLLGEKGVGPAPKLAHSYEHQQNHRTGEKKRSNRPKNYNEAMREKMGGRLVEEEKCWIIQSNKLARGSDHKSLHSKEEGGICLTFPTSYYSGSWYPCALGFPLDKTHIHEPFLLSFTDVMYKKSKLPPGVMEISLLKMIVNGMSSFLHLSFSGNMNSEPVSKYYQKAEEIHKLLKPIIDAIVNPELASDEVLNKILEEIGFAVNELKEHVENWHLLSSKVYFLSGFTFGKPKVQDPNDSEDMMVMQVEPLISRIRTSGLNIFQQLKDSQHCLPDELSSEYLQLCSQKLKLLGHEEISPVIKEAITEHLENVGPSSELLTKIADSLGLRSNQEVLIEAVALERLKENAEQTEKTAEAEFIDQMIAVVTRMHERLVMLKQAQSSSPVSIPADFCCPLSLELMTDPVIVASGQTYERAFIKNWIDLGLTVCPKTRQTLVHTHLIPNYTVKALIANWCESNNVQLVDPTKSTNLNQASVLHGYMESGTTRESPVFAHSRSNQPSSPESARSCSFSSPANNLTSGGTQREGTSPLHPRSTSEGSFRGMVNGQYMDLARISPEGLDDRSASSDESSVDSASHPSMSPSRRESSSAFSSEQSQTHIRAVSDSSALSNANFPQETQDDDNNAPQLSTSAGHSREASGELNPGTETGGTTAVPSVHREPEFPLRLETRSRSQAIWRRPSERHVPRIVSSPVVETRADLSAIETQVRNLVEGLRSSDVDTQREATAELRLLAKHNMDNRIAIANCGAINLLVDLLQSTDTTIQENAVTALLNLSINDNNKTAIANAGAIEPLIHVLETGSPEAKENSAATLFSLSVIEENKIFIGRSGAIGPLVELLGSGTPRGKRDAATALFNLSIFHENKNRIVQAGAVRHLVDLMDPAAGMVDKAVAVLANLATIPEGRNAIGDEGGIPVLVEVVELGSARGKENAAAALLHLCLHSPKFSSKVLQQGAVPPLVALSQSGTPRAKEKVGLRLSSINLKVKDMGVLGGADLEFPTRVVSKGFELTPV

SEQ ID NO: 109560 - protein, 629 aa, Glycine max
  Coding DNA Sequence Number=SeqID_17875
MEDRVDPRRYCQLEAVGHLTNAAKANKQPIVHRKLSIYKLFHGSLGFSEPLYQSGVNGEESEPLCKIVMDEGSEALFKNAIEDLRLVVHLWVTAKKTVKFADNVHEEDDYLVHRIIEDGVGKGWRRLAGFVDSYLAMKSFSNFNVTTKGVLRSLNVLQGVVGFARVNPAQEFGKVNLLFGSLFHLRHEVPEALVIYKNHKRMTQKRTAPMATPEASNSRVKGREKFDIARTGALIIHCLRALKARWASNCQKNWELAMQLLPESYPGLGPCCRLTRYARGSTKDENVVKEDRDKFLKKWSKKIIHSRLKCRGDITKSERHDFILKMSMELVYRRHGKFVFDRDGVQSPSIGEEKGLRLGWMRPATSIKATYLSCFDFWQYRDSKLKSRVVMTGGIEGEAGGTVGPIKCRGFGSGRRGTSMCKVIGRPRWVKDIVRKGELVALNDDGNLGACGVAGRKEVKEFSNVTLNEVMGAFAVHKNGDTMMKNMDWLCDWVVKVRMFVVVGDEKVEARLASMAYDPLLITLVAKTFFSFDCHLLRGQSFDWKFRGGVKRDLIVLSMAGHDVRNPFLDIHWGPLIIEELTNFEDPSYGILTVEAWYLKLHVREEGVTVRAASRPMMESSLASMVVWA

SEQ ID NO: 109561 - protein, 52 aa, Glycine max
  Coding DNA Sequence Number=SeqID_17876
MLSSNGAAMHFKVVQRMYIGVMFDLKKEMQKELNGDQKVELVLLFFKEIRGE

SEQ ID NO: 109562 - protein, 62 aa, Glycine max
  Coding DNA Sequence Number=SeqID_17877
MANILWNIYLYSYYSHARAERWLVSLEIDSDNLVSWGGEVYGLPINHLPVDVDDVHLWGMDP

SEQ ID NO: 109563 - protein, 867 aa, Glycine max
  Coding DNA Sequence Number=SeqID_17878
  Gene Ontology: Mol. function=metalloendopeptidase activity; Cellular component=extracellular space; Biological process=proteolysis
  Homolog annotation: Hit_ID=A7NY13; Match level="QueryCoverage=100%, HitCoverage=75%, E-value=0.0, Identity=68%"; Hit description =Chromosome chr6 scaffold_3, whole genome shotgun sequence
  Pfam annotation: Domain name=Peptidase_M16_C; Domain location=599 -761; Score=17.5; E_value=0.00028; Accession=PF05193.12; Description =Peptidase M16 inactive domain
  Pfam annotation: Domain name=Peptidase_M16_C; Domain location=60-244; Score=99.7; E_value=8.8e-27; Accession=PF05193.12; Description =Peptidase M16 inactive domain
  Pfam module annotation: Pfam domain module=Peptidase_M16_C::Peptidase_ M16_C; Domain location=599-761::60-244
MEAMEREVLAVDSEFNQVLQSDACRLQQLQCHTAAHNHPLNRFFWGNKKSLVDAMEKGINLREQILKLYKEYYHGGLMKLVVIGGESLDVLESWVVELFGAVKKGQANPVFTVEGPIWKSGKVYRLEAVKDVHILDLSWTLPCLHQEYLKKPEDYLAHLLGHEGRGSLLSFLKSRGWATSLSAGVGEEGIYRSSIAYVFVMSIHLTDSGVEKIFDIIGFVYQYLKLLSQDSPQEWIFKELQNIGNMDFRFAEEQPPDDYAAELAENMHFYPPEHVIYGDYVFKTWDKQLLKQVLGFFIPENMRVDVVSKSFLKSEDFQYEPWFGSRYVEEDIGQSFMELWRNPPEIDVSLHLPSKNEFIPSDFSIRASDTCVDDFANSTSPRCIIDEALIKLWYKPDSTFKVPRANTYFRITMKGGYADVKSCVLSELFIHLLKDELNEITYQASIAKLETSVTYVGDMLELKVYGFNEKLPVLLSKFFSVSKSFVPTDDRFKVIKEDMKRALKNTNMKPLSHSTYLRLQVLCESFYDADEKLCYLNDLFLDDLKAFIPGLLSQMSILLVIGEQHAPECVMCVVPTPEVHMDEQLLLCLELIYVEGLCHGNLSKEEAINISKIFKMSFPVNPLPIELRHAERVICLPSSANLVRDVNVKNKSEKNSVVELYFQIDQDFGLGSIKLKALIDLFDEIVEEPFFNQLRTKEQLGYVVECSPRVTYRVFGFCFCVQSSEYNPVYLQGRIENFLNGLEELLDGLDGDSFENYKSGLVAKLLEKDPSLTYESNRLWNQIVEKRYIFDLSKKEAEELKNISKHDIVEWYKTYLKPSSPKCRQLLIRLWGCNTDLKEAEALPKSVLAITDPAAFKMQSKFYPSFC

SEQ ID NO: 109564 - protein, 179 aa, Glycine max
  Coding DNA Sequence Number=SeqID_17879
MGVTVLSLGCWETTKGGVVDVGAAVGGGCAEEDGVDLGVVVGGGCAEEDKADMGFVVGGGCAEEEVLVFRCSSIAVGIVGYMEGGTVCRAVVLNKLNRRCWVLVKSITGGIKLDVYKEKVGAETEGMTPAGVITGGVLWHGQSKGKGSHGRQPWAMNAQEERRFWKLLHCYVRDGNERE

SEQ ID NO: 109565 - protein, 177 aa, Glycine max
  Coding DNA Sequence Number=SeqID_17880
  Homolog annotation: Hit_ID=O48791; Match level="QueryCoverage=84%, HitCoverage=41%, E-value=5e-39, Identity=51%"; Hit description =Putative uncharacterized protein At2g26770
MMRLTRDFGDTMQRDVVPAVSSDVEVVARETAQLLEQHNHLSVRDLASKFEKGLAAPTKFSEEARLREAASLEKHVLLKKLRDALESLKRRLAGRNKDDVEDTIAMASEDAKIVDEERAFAHAESKDARAAVQRVEVALQEHERMSQASGKQVMDMEHELRALRVQLAKKTRQYLRL

SEQ ID NO: 109566 - protein, 187 aa, Glycine max
  Coding DNA Sequence Number=SeqID_17881
  Gene Ontology: Mol. function=transferase activity; Cellular component= cytoplasm; Biological process=metabolic process
  Homolog annotation: Hit_ID=P25317; Match level="QueryCoverage=99%, HitCoverage=99%, E-value=4e-60, Identity=54%"; Hit description =Probable glutathione S-transferase parA
  Pfam annotation: Domain name=GST_N; Domain location=4-77; Score=66.4; E_value=9.6e-17; Accession=PF02798.11; Description=Glutathione S -transferase, N-terminal domain
MAEANVVPLDFWPSSYGMRVKIALAEKGISYECKQEDLEAKSSLILEMNPVHKMIPVLIHNGKSICESLNIVQYIDEAWNLKPSLLPSDLYKRSQARYGQGRTMEDELGDKPYFGGEDFGYVDVALVPFTSCFYTVETCGKLSIEEECPKLLAWPRGAWKKSVAKSLPHPHQIYAFAMQYKQRHGLE

SEQ ID NO: 109567 - protein, 408 aa, Glycine max
  Coding DNA Sequence Number=SeqID_17882
  Gene Ontology: Mol. function=protein dimerization activity; Cellular component=nucleus; Biological process=regulation of transcription, DNA-dependent
  Homolog annotation: Hit_ID=Q5MJ55; Match level="QueryCoverage=85%, HitCoverage=83%, E-value=1e-104, Identity=62%"; Hit description=AT -rich element binding factor 1
  Pfam annotation: Domain name=ATG16; Domain location=86-290; Score= -49.6; E_value=0.07; Accession=PF08614.2; Description=Autophagy protein 16 (ATG16)
  Pfam annotation: Domain name=bZIP_1; Domain location=208-269; Score =18.3; E_value=0.0039; Accession=PF00170.12; Description=bZIP transcription factor
  Pfam annotation: Domain name=bZIP_2; Domain location=206-260; Score =18.4; E_value=0.0053; Accession=PF07716.6; Description=Basic region leucine zipper
  Pfam module annotation: Pfam domain module=ATG16::bZIP_1::bZIP_2; Domain location=86-290::208-269::206-260
  Subcellular localization annotation: CTP_CleavageSite=30; ConfidenceScore=5.66e-01
MATQTQDPRSNPNPNPNAMSATPSSSFFIRAAGGNGPSAAPVAGSGESHSHHRRAHSEVSFRLPDDMIDLSPSDPFNGGSSTASFEEIGSEDDLFSTYIDVEKLGAGRGGNGSDQSGYGNGAGSSCYNDGEKSPSTAAARPRHRHSSSVDGSTSTSMFGEIMDAKKAMPPDKLAELWNIDPKRAKRIRMRWFKVDVTSFDLYLELLWDGNKIAIILANRQSAARSKERKARYIQELERKVQTLQTEATTLSAQLTLYQRDTTGLSSENTELKLRLQAMEQQAQLRDVLNDALMKEVERLKIATGEALNQSESFNLGMHQMPYAGSNFFSIPPHSGPSGHQNMQLPPFGHSHSTVPTHQLQQTNSHQMSDILQNDQLGRLQGLDISSKGTPVVKSEGPSISANESSTTF

SEQ ID NO: 109568 - protein, 158 aa, Glycine max
  Coding DNA Sequence Number=SeqID_17883
VKRVGSIEEDEEGVGIGAGVGASEKEGRFMESESVASWSVRITRSSFLRGGVVEIQGWLYGHESLVCVTHFIEEKSKEMEKGGSGRERDRDVIVIVSEVGGKEEREWREESKEREVGLKGIYGAPRGVSPLEDQGNIFLVKGGDLGNELKERERGRKE

SEQ ID NO: 109569 - protein, 231 aa, Glycine max
  Coding DNA Sequence Number=SeqID_17884
  Gene Ontology: Mol. function=small conjugating protein ligase activity; Cellular component=proteasome complex; Biological process =regulation of protein metabolic process
  Homolog annotation: Hit_ID=P35132; Match level="QueryCoverage=100%, HitCoverage=100%, E-value=3e-40, Identity=94%"; Hit description=SUMO- conjugating enzyme UBC9
  Pfam annotation: Domain name=UQ_con; Domain location=5-225; Score =238.4; E_value=1.6e-68; Accession=PF00179.17; Description=Ubiquitin -conjugating enzyme
MASKRIVKELKDLQKDPPTSCSAGPVAEDMFHWQATIMGPPDSPYTGGVFLVSIHFPPDYPFKPPKAMIYHCIVDQFLVILVYPVFQVQQLVRVSFSIAANAGILHCDSGSIFYEGGRKFALGGGASGYLRCKAKNLPHLSGSNALVVKVAFRTKVFHPNINSNGSICLDILKEQWSPALTISKVLLSICSLLTDPNPDDPLVPEIAHMYKADKAKYEATARSWTQKYAMG

SEQ ID NO: 109570 - protein, 320 aa, Glycine max
  Coding DNA Sequence Number=SeqID_17885
  Gene Ontology: Mol. function=nucleoside-triphosphatase activity; Cellular component=protein complex; Biological process=protein catabolic process
  Homolog annotation: Hit_ID=A2X465; Match level="QueryCoverage=91%, HitCoverage=63%, E-value=1e-132, Identity=82%"; Hit description =Putative uncharacterized protein
  Pfam annotation: Domain name=AAA; Domain location=62-290; Score =231.3; E_value=2.2e-66; Accession=PF00004.20; Description=ATPase family associated with various cellular activities (AAA)
  Pfam annotation: Domain name=AAA_2; Domain location=58-203; Score= -31.5; E_value=0.0028; Accession=PF07724.5; Description=ATPase family associated with various c
  Pfam annotation: Domain name=AAA_5; Domain location=62-208; Score =4.0; E_value=0.0014; Accession=PF07728.5; Description=ATPase family associated with various
  Pfam annotation: Domain name=SKI; Domain location=69-192; Score= -48.7; E_value=0.083; Accession=PF01202.13; Description=Shikimate kinase
  Pfam module annotation: Pfam domain module=AAA::AAA_2::AAA_5::SKI; Domain location=62-290::58-203::62-208::69-192
MGWLEHMVLVATVSTSVSYGMNPRRMDIGGCDIQKQEIREAVELPLTHHELYKQIGIDPPRGVLLYGPPGTGKTMLAKAVANHTTAAFIRVVGSEFVQKYLGESNIFKSSLPFIFQGPRMVRDVFRLAKENAPAIIFIDEVDAIATARFDAQTGADREVQRILMELLNQMDGFDQTVNVKVIMATNRADTLDPALLRPGRLDRKIEFPLPDRRQKRLVCTAKMNLSDEVDLEDYVSRPDKISAAEQDDIIPWGNCGTELKLLACFSLAVPNKKKRVIAAICQEAGMHAVRKNRYVILPKDFEKGYRTNVKKPDTDFEFYK

SEQ ID NO: 109571 - protein, 299 aa, Glycine max
  Coding DNA Sequence Number=SeqID_17886
  Gene Ontology: Mol. function=RNA binding; Cellular component =cytoplasm; Biological process=nicotianamine biosynthetic process
  Homolog annotation: Hit_ID=A7Q9W1; Match level="QueryCoverage=99%, HitCoverage=99%, E-value=1e-102, Identity=66%"; Hit description =Chromosome chr8 scaffold_68, whole genome shotgun sequence
MSNLYNQISLPSPQRANSPNINMRGNFDVDSQYLTELLAERQKLGPFMQVLPLCTRLINQEILRVTGKNESLQNQGFSDFDRMRFINPSHMTSPNSTSNFTGWKSLSHERLAGVQGLSMDWQTSPVVPSSPIVKKILRLDIPKDSYPNFNFVGRLLGPRGNSLKRVEATTGCRVFIRGKGSIKDLDKEELLRGRPGYEHLNDPLHILIEAELPASVVDVRLMQAQEIIQELLKPVLPLPLTRVWLMLKGNIDESQDFYKRQQLRELAMLNSNFREESPQLSGSVSPFTSNEIKRAKTDQ

SEQ ID NO: 109572 - protein, 120 aa, Glycine max
  Coding DNA Sequence Number=SeqID_17887
  Subcellular localization annotation: CTP_CleavageSite=58; ConfidenceScore=5.27e-01
MSPSPVSSMMSPTTTPLMTYISIYIMTLLLSQTPPTTIISATFETFIENLSTTQKRFKAAQGGVISMGCGGEALGQGGDGPTMWADPLVAHDGGCGQGGAAKDFVFQFEVERGLEWKVVS

SEQ ID NO: 109573 - protein, 353 aa, Glycine max
  Coding DNA Sequence Number=SeqID_17888
  Gene Ontology: Mol. function=nucleotide binding; Cellular component =cytoplasm; Biological process=response to stress
  Homolog annotation: Hit_ID=A2Q405; Match level="QueryCoverage=90%, HitCoverage=63%, E-value=1e-103, Identity=53%"; Hit description=Heat shock protein Hsp70
  Pfam annotation: Domain name=HSP70; Domain location=39-351; Score= -0.5; E_value=7.8e-14; Accession=PF00012.11; Description=Hsp70 protein
MVLAGLVRGRTLANLKLGMVHDAGGGGDVLRPIPHGAMLMGIDLGTTYSCVAVWQEHHCRVEIIHNDQGNNTTSFVAFTDDERLLKIRLLPIQRTMSLVVAGTHDKPMIILNYKDEEKHFCAEEISSIVLAKMWEIAEAFLEKRVKNAVVTVPAYFNDSQRKATIDCWRTNNCVGERKIFIFDLGGGTFDVSLLTHKGKIFQVKVTTGNGHLGGEEIDNRMVDYFVKEIKRKKKVDISGNPKALRRLKTACERSKRILSCAVATHIETYALSDGIDFCSSTTRARFEEINMDLFKECMETVDKCLTDAEMDKSSVHDVILVGGSINTDEAVAYGEVVQAALLSEGIKNVLDLC

SEQ ID NO: 109574 - protein, 316 aa, Glycine max
  Coding DNA Sequence Number=SeqID_17889
  Gene Ontology: Mol. function=catalytic activity; Cellular component =integral to membrane; Biological process=recognition or rejection of self pollen
  Homolog annotation: Hit_ID=A7Q702; Match level="QueryCoverage=70%, HitCoverage=43%, E-value=3e-84, Identity=62%"; Hit description =Chromosome chr5 scaffold_58, whole genome shotgun sequence
  Pfam annotation: Domain name=Peptidase_C12; Domain location=32-278; Score=-35.1; E_value=0.00065; Accession=PF01088.12; Description =Ubiquitin carboxyl-terminal hydrolase, family 1
MGVKFVGKQEFLTRFSMCVRSKTTSAQYLATRFRDPTFEKLMDNYKNLVKVIAIQDLILANPKNRSVSIDFLRKFPHIFHIYYDPSKLKPFCSAINASLPVVADGLVRILSMSSSRIVPLRAVFKVWKELGLPHDFEDSVISANSGVFQLCDAQEPNTHLLKLVDGACNNGFRAAVEDWRVVECCKEDCSVDRMKMWFSFKHGYPPGMRLTKNFKAKVKDWQRLPYVGPYEVVGEKKKSKAGMMASEKRAVSIEAYDRGCLIEPNPVYDARRRRLLDLVVLGRRGLPAVNSKLQDTSSCNEVGQEENQQRHDLSSS

SEQ ID NO: 109575 - protein, 78 aa, Glycine max
  Coding DNA Sequence Number=SeqID_17890
MDERDFTDHVMQVYGTLKQEREKWEKTIQVELITKIAKEAYAKVTEVPADINTALQEDVKKVVSPTPSNAEFANMTSK

SEQ ID NO: 109576 - protein, 111 aa, Glycine max
  Coding DNA Sequence Number=SeqID_17891
  Homolog annotation: Hit_ID=A9P901; Match level="QueryCoverage=86%, HitCoverage=37%, E-value=5e-31, Identity=67%"; Hit description =Putative uncharacterized protein
  Pfam annotation: Domain name=NC; Domain location=9-75; Score=13.5; E _value=0.0014; Accession=PF04970.4; Description=NC domain
  Subcellular localization annotation: CTP_CleavageSite=17; ConfidenceScore=5.01e-01
MLRKPRNWNKNNVGPFSSKARGGTCTTASSDPTEAVLCRASFLLKKGFGGYHLFKINCEDFAMYCKTGLLVVTDISVGQSGQATSLLAAVGTVVSSPFVFMSTSLCGLALV

SEQ ID NO: 109577 - protein, 932 aa, Glycine max
  Coding DNA Sequence Number=SeqID_17892
  Gene Ontology: Mol. function=protein binding; Biological process =ethylene mediated signaling pathway
  Homolog annotation: Hit_ID=A7NYB1; Match level="QueryCoverage=99%, HitCoverage=99%, E-value=0.0, Identity=66%"; Hit description =Chromosome chr6 scaffold_3, whole genome shotgun sequence
  Pfam annotation: Domain name=BTB; Domain location=219-325; Score= -14.5; E_value=0.076; Accession=PF00651.22; Description=BTBPOZ domain
  Pfam annotation: Domain name=TPR_1; Domain location=426-459; Score =15.1; E_value=0.082; Accession=PF00515.19; Description =Tetratricopeptide repeat
  Pfam annotation: Domain name=TPR_1; Domain location=555-588; Score =17.4; E_value=0.043; Accession=PF00515.19; Description =Tetratricopeptide repeat
  Pfam annotation: Domain name=TPR_1; Domain location=755-788; Score =30.1; E_value=8.3e-06; Accession=PF00515.19; Description =Tetratricopeptide repeat
  Pfam annotation: Domain name=TPR_1; Domain location=884-917; Score =24.5; E_value=0.0004; Accession=PF00515.19; Description =Tetratricopeptide repeat
  Pfam annotation: Domain name=TPR_2; Domain location=426-459; Score =17.3; E_value=0.059; Accession=PF07719.8; Description=Tetratricopepti de repeat
  Pfam annotation: Domain name=TPR_2; Domain location=555-588; Score =23.2; E_value=0.00094; Accession=PF07719.8; Description =Tetratricopeptide repeat
  Pfam annotation: Domain name=TPR_2; Domain location=681-714; Score =3.4; E_value=11; Accession=PF07719.8; Description=Tetratricopeptide repeat
  Pfam annotation: Domain name=TPR_2; Domain location=755-786; Score =13.2; E_value=0.69; Accession=PF07719.8; Description=Tetratricopeptid e repeat
  Pfam annotation: Domain name=TPR_2; Domain location=787-820; Score =11.7; E_value=1.1; Accession=PF07719.8; Description=Tetratricopeptide repeat
  Pfam annotation: Domain name=TPR_2; Domain location=851-884; Score =13.7; E_value=0.58; Accession=PF07719.8; Description=Tetratricopeptid e repeat
  Pfam annotation: Domain name=TPR_2; Domain location=885-917; Score =7.7; E_value=3.3; Accession=PF07719.8; Description=Tetratricopeptide repeat
  Pfam module annotation: Pfam domain module=BTB::TPR_1::TPR_1::TPR _1::TPR_1::TPR_2::TPR_2::TPR_2::TPR_2::TPR_2::TPR_2::TPR_2; Domain location=219-325::426-459::555-588::755-788::884-917::426-459::555 -588::681-714::...
  Pfam module annotation: Domain location=755-786::787-820::851 -884::885-917
  Subcellular localization annotation: CTP_CleavageSite=81; ConfidenceScore=5.42e-01
MRGLKLTERFKSTQVHALSSSSSETNGGNSSKASVAAATKPHNYLKRNKTMLPSWSKTKSRTTNNNSTSSLANLALLRLPSTDTIEPSIEPHLKPINLVETLSELYHRMECCTQSNKALMCAEQYSLLRGLGDQKILRRCLRTACQNAEDVLSKVVLSAWLRFERRDDELVGVCSMDCAGYVVECPKKNLEHGFSPCSVNDHCQCQKEPNQETCTDSVCLPDEESDVLFCVGSEEISCVRCRIAALSDPFNAMLYGGFAESKTNKIDFSGNGICPKGMRAVEFYSRTKRLDLFCPMTVLELLSFANRFCCVEMRSACDAHLASIVVNVEDALVLIEYGLEERATLLVGACLQVLLRELPNSLYNPKVAKIFCSFEAKERLANVGCASFLLYYFLSQVAMEESMVSKTTMMLLERMGECAAERWQKALAFHQLGCVLLERNEYKEAQHCFEAAVEEGHVYSLAGVARTKYKQGQPYSAYKLISSLIFEYKPAGWMYQERALYNMGKEKSFDLDVATELDPSLSFPYKYRALAKVEEKKIKEGIIELDRFIGFKLSPDCLELRAWLYVALEDYDSAMRDIRALLTIEPNYITSHGKIKGEYLLQLLNRGVQQKCQADCWMQLYQQWSCVDDIGSLAIIHQMLENEPGKSVLEFRQSLLLLRLNCQKAAMRSLRLARNHSSSMQERLVYEGWILYDTGYRKEALARADISIAKHRSFEAFFLKAYVLADTTLDPESSSYVIQLLKEALKCPSDGLRKGQALNNLGSIYVDCGKLELAKECYKNALAIRHTRAHQGVARIYHQKNQRKAAYDEMTKLIEKAESNASAYEKRSEYCDREMAKADLDVVTQLDPLRTYPYRYRAAVMMDEQKETEAVEELTKAIKFKPDLQMLHLRAAFYESMGDLSSALQDCQAALCLDPNHAGTLDVYRRIQRLNF

SEQ ID NO: 109578 - protein, 105 aa, Glycine max
  Coding DNA Sequence Number=SeqID_17893
MKLEVALTKVVVMTNDNVNGGCIDGGGSDNNHNNSSKSIVVMVLTTSYSSDDDNDNDEDIFTLTLTLEVALPTSRTLLSLQASLSLSYGGHCSPSLSLTVLSAIQ

SEQ ID NO: 109579 - protein, 208 aa, Glycine max
  Coding DNA Sequence Number=SeqID_17894
MAIAPTTINIRRKSCIIVFSVVPIPCHHGKLYPLTVFAQLHKCNAPVTDKKPGLETGASARYPPLRHHPAAGKHCAAGRCVYLAVSAPRPVDSTADVARAGLAAVAELSAVAAVGDFDCAGIQLFLLHHRQLDCRAVLRPAGGAAGRASDRKTPAGQWLARHDERHPAHHEARVTEARLLFAARTGPAAALFYPRLWPDRGAGVVVSV

SEQ ID NO: 109580 - protein, 626 aa, Glycine max
  Coding DNA Sequence Number=SeqID_17895
  Gene Ontology: Mol. function=transporter activity; Cellular component= membrane; Biological process=transport
  Homolog annotation: Hit_ID=A4TQ26; Match level="QueryCoverage=52%, HitCoverage=99%, E-value=1e-121, Identity=67%"; Hit description =Sugar ABC transporter, permease protein
  Pfam annotation: Domain name=BPD_transp_2; Domain location=341-618; Score=80.3; E_value=6.2e-21; Accession=PF02653.7; Description =Branched-chain amino acid transport system  permease component
  Pfam annotation: Domain name=BPD_transp_2; Domain location=39-313; Score=146.1; E_value=9.9e-41; Accession=PF02653.7; Description =Branched-chain amino acid transport system  permease component
  Pfam annotation: Domain name=Voltage_CLC; Domain location=50-450; Score=-184.6; E_value=0.092; Accession=PF00654.11; Description =Voltage gated chloride channel
  Pfam module annotation: Pfam domain module=BPD_transp_2::BPD_transp _2::Voltage_CLC; Domain location=341-618::39-313::50-450
MPDFSRLRPHSSQGWLAWVLLAFMVFFSLASDQFLTVQNLLDLAESYAVTGIFALGLFVVLVTGGIDISFAAVASVVQYLIASLFVQFQFDNALLSILLAIVCGTLFGVINALLITSLRVVSIIITISMQSLLFGLLMWVTGGKSLYSLPDWWITLRSVLPFSVQGNSFQIGLPLAIMLVIAALTALLLNKTNLGRQLYAVGGDAESARRIGIRVGLIHVFAYGWLGAMAAIGGLVQVYRMGEVVPNALVGGELDVLAATVLGGASLMGGKGTVSGTLMGVFLIAILKNGLNLIGVSNYFMNIVVGGTIMVAIAVTHYKKRKETDATFSVMLPGRFLTDSTFMSMAFQLPELGLLTLAMFIAILSGGLNLAIIATANLTALFIAWTLMSALPADAGTGQQLLWLFIAIVGAMVIAAVIGVITGVMVTRIGAHPILVTLATMMTLNGIGIWLTKGAAVSGMPPVVQSLGSDTLLGMPLPLWVFLVAAALLALFLGKTRAGKCIYMGGSNINATWFSGINTHRMVMLVYVISSLLCVLAGLIMMARFNSARMGYGDAYLLLTVLAIILGGTDPNGGFGRVTGVVLALIALQVLSTGFNLMNISQHVSPGDVGCRAGGGAGLQTTQSTL

SEQ ID NO: 109581 - protein, 174 aa, Glycine max
  Coding DNA Sequence Number=SeqID_17896
  Gene Ontology: Mol. function=transferase activity; Cellular component= intracellular; Biological process=D-ribose metabolic process
  Homolog annotation: Hit_ID=A6T959; Match level="QueryCoverage=88%, HitCoverage=51%, E-value=1e-36, Identity=53%"; Hit description =Ribokinase
  Pfam annotation: Domain name=CHP02647; Domain location=21-74; Score= -28.3; E_value=0.074; Accession=PF09653.1; Description=Protein of unknown function (CHP02647)
  Pfam annotation: Domain name=Phos_pyr_kin; Domain location=1-142; Score=-120.1; E_value=0.0007; Accession=PF08543.3; Description =Phosphomethylpyrimidine kinase
  Pfam module annotation: Pfam domain module=CHP02647::Phos_pyr_kin; Domain location=21-74::1-142
MIDNARAGGTFVILNPAPWQKVSDALLAKVDLLTPNSTEAMQLSGIKVTDFASAQRAAEVLHRKGARQVIITLGTAGALLSSAEQQLRIPLFPAQPLDTTGAGDAFNGALAARLASGDALPQAALFAAAFASLCVERSGAANSMPSYAEALARMQAHPECEVTPLNAPEITHMA

SEQ ID NO: 109582 - protein, 738 aa, Glycine max
  Coding DNA Sequence Number=SeqID_17897
  Gene Ontology: Mol. function=4 iron, 4 sulfur cluster binding; Cellular component=periplasmic space; Biological process=Mo -molybdopterin cofactor biosynthetic process
  Homolog annotation: Hit_ID=A8GHJ4; Match level="QueryCoverage=100%, HitCoverage=89%, E-value=0.0, Identity=79%"; Hit description =Periplasmic nitrate reductase precursor
  Pfam annotation: Domain name=Molybdopterin; Domain location=6-478; Score=466.5; E_value=3.4e-137; Accession=PF00384.13; Description =Molybdopterin oxidoreductase
  Pfam annotation: Domain name=Molydop_binding; Domain location=624 -732; Score=125.5; E_value=1.6e-34; Accession=PF01568.12; Description= Molydopterin dinucleotide binding domain
  Pfam module annotation: Pfam domain module=Molybdopterin::Molydop _binding; Domain location=6-478::624-732
MYGKDRLTQPLLRMTDGKFDKNGEFTPVSWDQAFDIMEAKFKAALKANGPESVGMFGSGQWTVWEGYAASKLMKAGFRTNNLDPNARHCMASAVVGFMRTFGMDEPMGCYDDIEQADAFVLWGSNMAEMHPILWSRLTARRLSNDNVKVAVLSTYRHRSFELADNAIVFTPQSDLAILNFIANYIIQNNKVDKTFLQNHVTLRKGVTDIGYGLRPTNPLQAAAKNPDNGESTPISFDEYAQFVAEYTVEKASAMSGVEQDQLIALAELYADPNVKVVSYWTMGFNQHTRGVWANNLCYNIHLLTGKISRPGTGPFSLTGQPSACGTAREVGTFAHRLPADMVVNNDKHRALAEKLWKLPQGTVPAKVGLHAVAQDRALKDGKLNAYWVMCNNNMQAGPNLTQERMPGWRDARNFVVVSDPYPTVSALSADLILPTAMWVEKEGAYGNAERRTQFWHQQVKAPGEAKSDLWQLVTFAKRFRVEDVWPEALIAQQPELKGKTLYDVLYVNGQVNQFPLSEVADDRLNDEAREFGFYIQKGLFEEYASFGRGHGHDLAPFDTYHEARGLRWPVVDGKETRWRYREGFDSYVKAGEGVRFYGKPDGKATIFALPYEPPAEAPDAEYDLWFCTGRVLEHWHTGTMTRRVPELHRAVPQALLYIHPLDAKDRGFRRGEKVRVVSRRGETLATVETRGRNQPPQGLVFMPFFDAGVLANNITLDATDPLSKQTDYKKCAVKLVKI

SEQ ID NO: 109583 - protein, 418 aa, Glycine max
  Coding DNA Sequence Number=SeqID_17898
  Homolog annotation: Hit_ID=A8GHJ7; Match level="QueryCoverage=22%, HitCoverage=16%, E-value=2e-09, Identity=43%"; Hit description =Integral membrane sensor signal transduction histidine kinase precursor
MPRGEPGNYGDESYPALTVNLGAAAPHAGIARILHANDAIMTGAHLFRFLRQLTGGVIQRTAHAAHRNGAAALQVLGLCLAQRRGGKGLRVKVSVSQCKPGCAGGKSVQYFASQTRLIQGNVNRVKRPVTRTIARALSAIVLLSLLTTGLALMTLSSSLRDAEAVNVAGSLRMQIYRLAWDSTRDPQQLAHHMQQYQQTLESPALQHLERPWVPIELAGTARDAAAGAGAGVPAARGGLPLCRAENASGGRQQPVRLSGDCRAGAVEHWLYSPQRGASARFAGHRQSIRRAGQLQFSAAFRASAQRAGRAGAGLYHYGGAAAFALSPAGVRDSHRQPAQSRAVPGPAAAGAATGSTGGAANRQRGYRLPGRRARRRSQLAAAAAAAGGAAPRRTSGQHAGACTVDLADAEAVSADAAD

SEQ ID NO: 109584 - protein, 325 aa, Glycine max
  Coding DNA Sequence Number=SeqID_17899
  Gene Ontology: Mol. function=transporter activity; Cellular component= integral to membrane; Biological process=transport
  Homolog annotation: Hit_ID=A7MKZ6; Match level="QueryCoverage=100%, HitCoverage=31%, E-value=1e-149, Identity=81%"; Hit description =Putative uncharacterized protein
MSNFFIDRPIFAWVLAILLCLCGTLAIISLPVEQYPDLAPPNVRITANYPGASAQTLENTVTQVIEQNMTGIDNLMYMSSNSSNTGQAQITLTFTAGTNPDEARQQVQNQLQSALRKLPAAVQSQGVTVNKTGDSNILMIAFVSTDGSMDKQDIADYVASNIQDPLSRIDGVGQVDAYGSQYAMRIWLDPNKLINYALTTDDVVSAIESQNTQVAVGQVGGLPSVDKQALNATVNAQSMLQTPAQFRAITLKTNTDGSVVTLGDVATIAMGAEKYDFLSRYNGQPASGLGIKLASGANEMNTDKLVRARVAELAQYFPHGLEAKV

SEQ ID NO: 109585 - protein, 276 aa, Glycine max
  Coding DNA Sequence Number=SeqID_17900
  Gene Ontology: Mol. function=succinyl-diaminopimelate desuccinylase activity; Cellular component=cytoplasm; Biological process=lysine biosynthetic process via diaminopimelate
  Homolog annotation: Hit_ID=P0AED7; Match level="QueryCoverage=100%, HitCoverage=73%, E-value=1e-139, Identity=89%"; Hit description =Succinyl-diaminopimelate desuccinylase
  Pfam annotation: Domain name=M20_dimer; Domain location=76-184; Score= 123.6; E_value=5.6e-34; Accession=PF07687.5; Description=Peptidase dimerisation domain
  Pfam annotation: Domain name=Peptidase_M20; Domain location=1-273; Score=77.4; E_value=4.7e-20; Accession=PF01546.19; Description =Peptidase family M20M25M40
  Pfam module annotation: Pfam domain module=M20_dimer::Peptidase_M20; Domain location=76-184::1-273
MKGSLAAMVVAAERFVAAHPNHAGRLAFLITSDEEASAVNGTVKVVERLMARNERMDYCLVGEPSSTEVVGDVVKNGRRGSMTANLTIHGVQGHVAYPHLADNPVHRAMPALNELVATEWDQGNEFFPPTSMQIANVQAGTGSNNVIPGEFFVQFNFRFSTELTDQMIKDRVAALLDRHQLRYTLEWNVSGQPFLTSRGKLVDAVVNAVAHYNEIKPQLLTTGGTSDGRFIARMGAQVVELGPVNATIHKINECVKASDLQLLSRMYQRIMEQLIA

SEQ ID NO: 109586 - protein, 252 aa, Glycine max
  Coding DNA Sequence Number=SeqID_17901
  Gene Ontology: Mol. function=N-acetyltransferase activity; Biological process=metabolic process
  Homolog annotation: Hit_ID=A8GHL3; Match level="QueryCoverage=89%, HitCoverage=34%, E-value=1e-55, Identity=54%"; Hit description =Putative uncharacterized protein
  Pfam annotation: Domain name=Acetyltransf_1; Domain location=22-96; Score=21.8; E_value=0.0025; Accession=PF00583.15; Description =Acetyltransferase (GNAT) family
GGLDAALAQAVWAGLRRPRGNLVAQSLAAHAGFTEAATLRSLRISRIAVQAAQRQRGIGGALVATARQQAQGADYLSVSFGYTAALWQFWRACGFTLVRIGSQREASSGCYAAMAICALTPAGEALQQRAAQRLARDWPWLQKLIAVPLTLSSTDHQSLSADDWPLLAAFAWAQRPYEASYAVLQRLAGVASPPLLCAILQQKQTLSEAARLAGVSGRKTLMLRLRAEAADALITLDAAAAQHWQQRLGILQ

SEQ ID NO: 109587 - protein, 524 aa, Glycine max
  Coding DNA Sequence Number=SeqID_17902
  Gene Ontology: Mol. function=transcription factor activity; Cellular component=intracellular; Biological process=regulation of transcription, DNA-dependent
  Homolog annotation: Hit_ID=Q3J8J6; Match level="QueryCoverage=63%, HitCoverage=92%, E-value=2e-25, Identity=41%"; Hit description =Putative uncharacterized protein precursor
  Pfam annotation: Domain name=DUF1791; Domain location=294-421; Score =24.2; E_value=3.6e-07; Accession=PF08754.2; Description=Domain of unknown function (DUF1791)
MNGQVLLTGQLATRDDSINPHDEALSFAVHPSACACRRVSMRSVVSYALIAIVGGMVGAAVIKSDDLYQRIAGHFSAEPADPDGFWSTPAVAGYGKIHYEADAAFKPAVGLSNKVVFQLTRNEGDIKRPNLGLERVARVVNLYIAAGVPAEQLQFVVSMTGDATPATLDNAHFKQFYGVDNPNLALIGALNKLGVKVSVCDQSVAFHHYPRDWIDRRSVMRPASYIVIAALAGFVGGNMLQLPELVDKVSGKFADQKTEPADFWSTPAIAGYGKIHFVNTPDYNPANTPGLSNKIVFQINRSEGDIHQPNLGLERVARVTNLYYAAGVPLNQLNFVVSINSDAVPAALNNDQFRKAYGSDNPNLKLIDELKKAGVKVTICDQSVAFHQLERDWIDTRVTHTLSSGTTVASLQNEGYAFLMLSISSALYEANMSDLLTVAKLAGVSRATAARAFSDPHLLRNDTLERVLAASEQLGFRPNHIARQLRTQHSTTFGVLLPSLLNPIFSCQLQAMERQARDAGYGLL

SEQ ID NO: 109588 - protein, 253 aa, Glycine max
  Coding DNA Sequence Number=SeqID_17903
  Gene Ontology: Mol. function=sugar:hydrogen symporter activity; Cellular component=membrane; Biological process=phosphoenolpyruvate -dependent sugar phosphotransferase system
  Homolog annotation: Hit_ID=P69784; Match level="QueryCoverage=55%, HitCoverage=83%, E-value=2e-67, Identity=90%"; Hit description =Glucose-specific phosphotransferase enzyme IIA component
  Pfam annotation: Domain name=PTS_EIIA_1; Domain location=68-200; Score=275.1; E_value=1.5e-79; Accession=PF00358.11; Description =phosphoenolpyruvate-dependent sugar phosphotransferase system, EIIA 1
MCGELAGDERATLLLLGMGLDEFSMSAISIPSIKKIIRNTNFEDAKATGRAGSGSTHSGRFDEPESASGTIDIVAPLSGEIVNIEDVPDVVFAEKIVGDGIAIKPTGNKMVAPVDGTIGKIFETNHAFSIESDNGIELFVHFGIDTVELKGEGFKRIAEEGQKVKKGDVVIEFDLPLLEEKAKSTLTPVVISNMDEIKDLVKLSGQASASGKAHRACLRAGRPGRGAKRPAPWMARAEAQGRFMPSLRSVRSS

SEQ ID NO: 109589 - protein, 622 aa, Glycine max
  Coding DNA Sequence Number=SeqID_17904
  Gene Ontology: Mol. function=peroxidase activity; Cellular component =cytoplasm; Biological process=metabolic process
  Homolog annotation: Hit_ID=Q6D8U0; Match level="QueryCoverage=47%, HitCoverage=100%, E-value=1e-115, Identity=70%"; Hit description =Putative uncharacterized protein
  Pfam annotation: Domain name=Acetyltransf_1; Domain location=46-124; Score=86.7; E_value=7.4e-23; Accession=PF00583.15; Description =Acetyltransferase (GNAT) family
  Pfam annotation: Domain name=DUF1131; Domain location=130-324; Score =195.9; E_value=9.8e-56; Accession=PF06572.3; Description=Protein of unknown function (DUF1131)
  Pfam annotation: Domain name=Dyp_perox; Domain location=328-618; Score=450.5; E_value=2.3e-132; Accession=PF04261.3; Description=Dyp -type peroxidase family
  Pfam annotation: Domain name=FR47; Domain location=43-131; Score=1.7; E_value=0.0094; Accession=PF08445.1; Description=FR47-like protein
  Pfam module annotation: Pfam domain module=Acetyltransf _1::DUF1131::Dyp_perox::FR47; Domain location=46-124::130-324::328 -618::43-131
MEIRSFRQEDFEEVITLWERCDLLRPWNDPELDIERKMNHDPELFLVAEVGGEVVGTLMGGYDGHRGSAYYLAVHPDYQGRGFANALMNRLEKKLIARGCPKIHLMVREENDQVVAFYEKLDYEPVDSLLLGKRLIEDRTPVGTKERSLHESCSSRPAGQRPGAGRLRQFRSLTVTEQGVAGLNSNTAMSESAISAALNNDYQLRQGMRTQNGQVVDFWQALDDGKVKLVINGQRSVERIEVLDSDARSADGSKIGDAFSDKFSKAFDNCKMVAGLDVRDVECRAPGSQHIAYIYSGEWHGPTGLMPSDDTLKSWKISKISIVMSQFQSGILLEHRRFAIWLEARATGDLAALRQGCHAFLQQLAALQQQFPDAGLGAVIAFGDALWRDLQGTDSAPELKAFTPLGKGAAPATQRDLLIHIQSLRHDVNFSLAQAALTAFASAVAIEEETHGFRWVEDRDLSGFVDGTENPQGEARQQVAIIADGPDAGGSYVFTQRWEHNLPQFNRLAIDKQEAIIGRTKQDNEELPGDQRPATSHLSRVDLKEAGKGLKILRQSLPYGTASGRHGLYFISYCHRLYNIEQQLLSMFGERDGKMDAMLRFTKPVSGSYFFAPSLTALQALS

SEQ ID NO: 109590 - protein, 580 aa, Glycine max
  Coding DNA Sequence Number=SeqID_17905
  Gene Ontology: Mol. function=coproporphyrinogen oxidase activity; Cellular component=cytoplasm; Biological process=porphyrin biosynthetic process
  Homolog annotation: Hit_ID=A7MKX5; Match level="QueryCoverage=51%, HitCoverage=99%, E-value=1e-150, Identity=83%"; Hit description =Coproporphyrinogen III oxidase, aerobic
  Pfam annotation: Domain name=Amidase_3; Domain location=61-277; Score= 316.6; E_value=4.6e-92; Accession=PF01520.9; Description=N -acetylmuramoyl-L-alanine amidase
  Pfam annotation: Domain name=Coprogen_oxidas; Domain location=276 -576; Score=755.0; E_value=5.1e-224; Accession=PF01218.9; Description= Coproporphyrinogen III oxidase
  Pfam module annotation: Pfam domain module=Amidase_3::Coprogen _oxidas; Domain location=61-277::276-576
MLMNKISLLRRLTNRRQLILSGLALAVLSPRAVQAQETRAAVPVSARHTPPKPATSGKRIVMIDPGHGGIDSGAVGQEGSEEKHIVLEIANTVRTLLQNHPKVEVRLTRDSDHFIPLYQRVEIAHQHGANLFMSIHADGYTSPEANGASVFALSNRGASSAMARYMSQRENDADKVGGAAVQEKDNYLNQILFDLVQTDTIRNSLTLGKHVLDQIRPVHHLHSQHTEQAAFAVLKSPSIPSVLVETSFITNPREEQLLGTTAFRQKIARAIADAMSNPDISRVKAYLLALQDDICAGLAAEDGSASFAEDTWQRPGGGGGRSRVLRNGKVFEQAGVNFSHVYGEQMPASATAHRPELAGRSFEAMGVSLVVHPENPYVPTSHANVRFFIAEKPGADPVWWFGGGFDLTPYYGFTEDARHWHQTAFDLCQPFGDDVYARYKKWCDDYFYLKHRNEQRGIGGLFFDDLNTPDFDHCFDFMQAVGNGFMQAYQPIVAKRKQVAWGERERQFQLYRRGRYVEFNLVWDRGTLFGLQTGGRTESILMSMPPLVRWEYDYQPADDSPEAALTRDFLPVQDWLGLEK

SEQ ID NO: 109591 - protein, 316 aa, Glycine max
  Coding DNA Sequence Number=SeqID_17906
  Gene Ontology: Mol. function=transaldolase activity; Cellular component=cytoplasm; Biological process=carbohydrate metabolic process
  Homolog annotation: Hit_ID=Q2NS86; Match level="QueryCoverage=100%, HitCoverage=100%, E-value=1e-150, Identity=83%"; Hit description =Transaldolase
  Pfam annotation: Domain name=Transaldolase; Domain location=12-312; Score=561.1; E_value=1.2e-165; Accession=PF00923.10; Description =Transaldolase
MNQLDALKQFTTVVADSGDIESIRHYHPEDATTNPSLILKAAGLDAYKHLIDDAIEYAKKQGGSKETQIINASDKVAINLGMEILKSVPGRVSTEVDARLSFDRGMCVTKAEKLVRLYEENGIDRSRILIKLASTWEGIKAAEELEKNGINCNLTLLFSFAQARACAEAGVFLISPFVGRIYDWYNTRKPLDPYVVDEDPGVKSVRRIYDYYKKHRYNTVIMGASFRKVEQIVALAGCDRLTISPNLLEELANSEAPVERKLEPSTEGFHQPAPLSEAEFRWEHNQDAMAVEKLSDGIRQFAVDQQKLEDVLAARL

SEQ ID NO: 109592 - protein, 154 aa, Glycine max
  Coding DNA Sequence Number=SeqID_17907
  Homolog annotation: Hit_ID=A5AK77; Match level="QueryCoverage=61%, HitCoverage=11%, E-value=7e-12, Identity=39%"; Hit description =Putative uncharacterized protein
MTRGNPGDLQPCDPEIDRTFHRLVRDSVHPGHSVHFEYYDFEHSTTNFYTENMAQPPPRERTLREMVAPDFTYESLCIQYPDEGVPYVLKTGLIHLLPKFHGLAGEDPHKHLKEFHIVCSTMKPPDVQEDHIFLKAFPHSLEGVAKDWLYYLAP

SEQ ID NO: 109593 - protein, 108 aa, Glycine max
  Coding DNA Sequence Number=SeqID_17908
MPFCGRARRGSRVHFPKEERCVESPPTFFCGKRRKNRRKPVKTKILSLGVVFTFEEGRQKQGSCSYVPSIEEEIRPTYFFLRVNHTTSFYLKGDHLKALDLKNHPFTW

SEQ ID NO: 109594 - protein, 211 aa, Glycine max
  Coding DNA Sequence Number=SeqID_17909
  Gene Ontology: Mol. function=exopolyphosphatase activity; Cellular component=plasma membrane; Biological process=SRP-dependent cotranslational protein targeting to membrane
  Homolog annotation: Hit_ID=A8GHP8; Match level="QueryCoverage=100%, HitCoverage=40%, E-value=1e-113, Identity=98%"; Hit description =Ppx/GppA phosphatase
  Pfam annotation: Domain name=Ppx-GppA; Domain location=27-210; Score =168.6; E_value=1.7e-47; Accession=PF02541.7; Description=PpxGppA phosphatase family
MPLKNTATNKPQEIAAIDLGSNSFHMVIARVVNGALQVLGRLKQRVHLADGLDSNNVLSEEAIERGLACLALFAERLQGFPADNVTIVGTHTLRQAVNAEVFLKRAAKVIPYPIEIIAGQEEARLIFMGVEHTQPEKGRKLVIDIGGGSTELVIGEDFEPLLAESRRMGCVSFAQLFFPGGEISKNNFRRARLAAAQKLETLAWQYRIQGW

SEQ ID NO: 109595 - protein, 135 aa, Glycine max
  Coding DNA Sequence Number=SeqID_17910
  Homolog annotation: Hit_ID=A5AK77; Match level="QueryCoverage=46%, HitCoverage=7%, E-value=7e-07, Identity=41%"; Hit description =Putative uncharacterized protein
MTKGNPGDLQPFDPEIDRTFHRLVRHSVNPDHYVHFEYFVVGDFEHSDFEHSTTNFHTENMAQPLPRERTLREMAAPDFTYESLCIQYPDEDVPYVLKTGLIHFLPKFHGLVGEDPHKHLKEFHIVCSTMKLPCS

SEQ ID NO: 109596 - protein, 161 aa, Glycine max
  Coding DNA Sequence Number=SeqID_17911
MAADFVDEIHSGHIHVICNSTMTRRLWWEPLRWVNRVGPFSTDPKNHFLQFTQWNNKASINNRWKFLWLALSFFVWHHRNAMIFKNHPFDPEKRRTTPGTTPSICSSCMWRSTPGCLMNDNSISHLPAVNDMVCMQRDSRNLNTLQYMFWGWSGKDIKRRR

SEQ ID NO: 109597 - protein, 173 aa, Glycine max
  Coding DNA Sequence Number=SeqID_17912
  Subcellular localization annotation: CTP_CleavageSite=10; ConfidenceScore=5.28e-01
MDMNIDTLISERARKARARPVDVPSSSTPPAPSTSATPTLAPLDPSAQDSQRFESMLQSLYQGKQFVEKVAWPENQPFLVREGGSPSAQAGGTQVRQEAATPERSTQISPDPPTPMHEMPADPSTPLLEIPEDPASLVLGLTTTPLATLVLHFTDEEGTQDQDNQQDDQSQEF

SEQ ID NO: 109598 - protein, 106 aa, Glycine max
  Coding DNA Sequence Number=SeqID_17913
MERSMIDVASGGALGDMTPTEARNLIEKMASNSQQLSARTETKKLEGKLDALVNLVTQLAMNQKSAPVTRLCGLCSSADHHIDLCLSVQQSEATEQLEAYAVNIYN

SEQ ID NO: 109599 - protein, 151 aa, Glycine max
  Coding DNA Sequence Number=SeqID_17914
MPSLNPHPLRDSFPFQKTRERSICLKKRLRAVEGLDNYPFPELADLCLVPDIIIPPTFKVPDFDKYEKLIGYMPANFANLIFAGERIESGLRKGKFEYASNIGPNSNRKAPVVGTRKKEGDTHAVTTAPTWMKTPKNAQNSYQHNHPNFSI

SEQ ID NO: 109600 - protein, 77 aa, Glycine max
  Coding DNA Sequence Number=SeqID_17915
MKQRQMMHKLFIKEIATWRREGDTFGSDPLGMTLGEIEGKMESDPPSHHKHSAIFNGDDATRVYQNSDGVKPGVCSN

SEQ ID NO: 109601 - protein, 202 aa, Glycine max
  Coding DNA Sequence Number=SeqID_17916
  Homolog annotation: Hit_ID=UPI00006A2D9E; Match level="QueryCoverage =78%, HitCoverage=100%, E-value=1e-16, Identity=19%"; Hit description= UPI00006A2D9E related cluster
TLTFRELHVLAIKGLQALSFKGLHALSFRGLHVLSFRGPHVLALRGLHALAFRGLHVLTIRGLHVLTFEGLHVLAYKGLHALTFRGLHVLAFRGLHALAFRGLHVLAFRGLHALTFRGLHVLALRTTHPHLQRATRLHLQRTTRPCLEDYTSSPSEDYTPLPSEGYTPLPSEEYMSSPSEDYTSSPSEGYTPSPLEDYMSSP

SEQ ID NO: 109602 - protein, 299 aa, Glycine max
  Coding DNA Sequence Number=SeqID_17917
  Gene Ontology: Mol. function=calcium ion binding; Cellular component =integral to membrane; Biological process=homophilic cell adhesion
  Homolog annotation: Hit_ID=B0LHN4; Match level="QueryCoverage=93%, HitCoverage=48%, E-value=1e-100, Identity=56%"; Hit description =Biofilm-associated protein
PATAVLDALAPTVALDDVLTNDSTPALTGTVNDPTATVVVNVDGVDYPATNNGDGTWTLADNSLPALTDGPHTITVTATDPAGNAGTDTAVVTIDTTAPNAPLLDPINATDPVSGTAEAGSTVTVSFPDGTTATVMAGTDGSWSVPNPGNLVDGDTVTATATDPAGNTFIARHSTPALTGTVNDPTATVVVNVDGVDYPATNNGDGTWTLADNSLPALTDGPHTITVTATDPADDVTTNDTTPALTGAINDPTATIVVNVDGTDYPAVNNGDVTVTATDPLEILQLIQQHSLLILYRQT

SEQ ID NO: 109603 - protein, 176 aa, Glycine max
  Coding DNA Sequence Number=SeqID_17918
  Subcellular localization annotation: CTP_CleavageSite=47; ConfidenceScore=5.31e-01
MIEKQKSVLDPYSFLTPPSPTFYSPFLNPPDYFFSKASQSWSLPTTSAYKKKSEPPKKESTRLNISSQESTESPTRIGETQKNDPHDFQDSQDPYSQFSIQQKLKASEGSDETGTESEESSSKTQKSYSDEEEEVGHMDISNILMARSTEEPFYDSPVEEEPVFSKSSSSKPNAGP

SEQ ID NO: 109604 - protein, 46 aa, Glycine max
  Coding DNA Sequence Number=SeqID_17919
IFNFHQNWVQAIGLFAQATCAPEFGLPRPFNQRLLVLHVGGAVVRQ

SEQ ID NO: 109605 - protein, 290 aa, Glycine max
  Coding DNA Sequence Number=SeqID_17920
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMGQGTFPSHYVPGCLLGVVVSMDTELMGLSTADATRSLDVLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 109606 - protein, 282 aa, Glycine max
  Coding DNA Sequence Number=SeqID_17921
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGPPLMFTEEYQKSLPEQYHLGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 109607 - protein, 279 aa, Glycine max
  Coding DNA Sequence Number=SeqID_17922
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIEWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 109608 - protein, 75 aa, Glycine max
  Coding DNA Sequence Number=SeqID_17923
MKVILWMNALLEPKLLNPRKTMNCWQPNPITSLESEKRLSFELQKVVVGLSSAVGLSTYPSLSATSTCLAQRRIW

SEQ ID NO: 109609 - protein, 67 aa, Glycine max
  Coding DNA Sequence Number=SeqID_17924
MGVLKGTCNSFNKDSKGGTQASHTTKKVLMGDSRSGIYFTIRENSELECWIPNMEFGGAWMATIHIN

SEQ ID NO: 109610 - protein, 131 aa, Glycine max
  Coding DNA Sequence Number=SeqID_17925
AQGFPALITGLCQSFRVPVAPSKGDAPQAADAPPPHQAGPAGSFDSEQYLRHVVHQQAANHRAHVQTHDCLYQLSLSLQSQGFTSFPCPTPDQFRAEAREAPAEAPGEADEAREDEEMTDLLDFLGGSGAT

SEQ ID NO: 109611 - protein, 68 aa, Glycine max
  Coding DNA Sequence Number=SeqID_17926
MLVPKLCSFLLGVCKRSFDDNKDDDKKFKSQDHFMITKMMTFKNEFKIESRTLQRSRGNLISRIKIQE

SEQ ID NO: 109612 - protein, 96 aa, Glycine max
  Coding DNA Sequence Number=SeqID_17927
LGGVDGDPVLRGMRRRLRTCTVVPADMSRGSGDLGDVRWGAIAQNQAWPILTQPGHSQSVRTCDVPKQASSWQSTNKRTKSTKQGGLCGGWPAIYL

SEQ ID NO: 109613 - protein, 59 aa, Glycine max
  Coding DNA Sequence Number=SeqID_17928
GPDDLAGGDRHSIELTEARNQSWKPQDPVGLLRVHWGINQLTLQQGEIGVVVTGQNVTK

SEQ ID NO: 109614 - protein, 294 aa, Glycine max
  Coding DNA Sequence Number=SeqID_17929
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDHLIGHRRHLALGQGRGPVYRVVRSDRALVRSHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 109615 - protein, 297 aa, Glycine max
  Coding DNA Sequence Number=SeqID_17930
  Gene Ontology: Mol. function=nucleoside-triphosphatase activity; Cellular component=chloroplast
  Homolog annotation: Hit_ID=Q2PMM5; Match level="QueryCoverage=56%, HitCoverage=7%, E-value=8e-64, Identity=75%"; Hit description =Protein ycf2
GTSYVPITVSFSPKVGSGLPGINRDTRILFILRSDLPSQWLLFLSAVPPVQLLAGWCVTAKAPPDISAGKCSGHAARRVPFAIQAAQLLGRAIGAGLFAITPAGERGMCCKAIKLGNARVFPVTTLNSIAERRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSL

SEQ ID NO: 109616 - protein, 152 aa, Glycine max
  Coding DNA Sequence Number=SeqID_17931
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=72%, E-value=3e-24, Identity=69%"; Hit description=LacZ protein
MYFRRCGSKSGNDLRDVLEHLMGLIFWLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 109617 - protein, 58 aa, Glycine max
  Coding DNA Sequence Number=SeqID_17932
MQQNFVLVQKMLMHGWLWKGLYIFGYGYFLADPNGQNLGGIDGDPVLRGTRIRATWEY

SEQ ID NO: 109618 - protein, 110 aa, Glycine max
  Coding DNA Sequence Number=SeqID_17933
MEWQGYQGSAWRRRWKLWPAFINVLALLVFGTTLFPNVDELVDLKAIDAFLAYHHSMESPIIAVLVDQSVPYKVIACAPKRVKQIGKNSCTLDLRPLSLMMGVWGANTFP

SEQ ID NO: 109619 - protein, 157 aa, Glycine max
  Coding DNA Sequence Number=SeqID_17934
MMVDTLPVFYYEKLVGYMPSSFADLVFAGERIKVGLKRGKFNYVSSIGTNSRRIGATGAKRKEGDTHAVTSTPAWIKPPQISHGTHQYAQHHPSFSARAVDSSNSAPVQPRVPAPIQREPLPPPPPARLSRGRPPKLWLQPRFAWLAMPTLASVPTR

SEQ ID NO: 109620 - protein, 98 aa, Glycine max
  Coding DNA Sequence Number=SeqID_17935
  Subcellular localization annotation: CTP_CleavageSite=47; ConfidenceScore=5.15e-01
GANTFPVRKYNSRTFHLKVRRSRLFRFFRCFPQINVGGDSARIPFVEHASRESRVALPPKVGCDKTFSQSQPEDADICGKGAGEDVSHFLLLGFEFYG

SEQ ID NO: 109621 - protein, 308 aa, Glycine max
  Coding DNA Sequence Number=SeqID_17936
  Gene Ontology: Mol. function=transferase activity
  Homolog annotation: Hit_ID=A8A1S0; Match level="QueryCoverage=92%, HitCoverage=99%, E-value=2e-38, Identity=34%"; Hit description =Putative uncharacterized protein
MNAGRKVDLYISEMGYSNSLRGFIMRTIMVVVLSDCSALESNTLESLKTSERCLDELLIVNNGGEISTIDQDKIQDMGLQVKKVNVKNFFDVRPLSWIYNGVLNEYYQYDRFIFFSYDSFLEGNYIGNLIDCYSEGVDLQIPNIRDSISKQIIYPRLNKVTRKIPDGMKIDSQYNLLSMNSGLVIYRSLVEKFSECNIEVFDNRFALYGVDYNFFNRLEILKKAKYKICVQVVNTIESSVPVTDKQNELSQEVERLYDRVLSGKYYSKNKLVIYLRLLKISFQQLIRFRFSNLELIFRIYFEGKHPRC

SEQ ID NO: 109622 - protein, 124 aa, Glycine max
  Coding DNA Sequence Number=SeqID_17937
  Homolog annotation: Hit_ID=A7ME49; Match level="QueryCoverage=100%, HitCoverage=44%, E-value=7e-24, Identity=43%"; Hit description =Putative uncharacterized protein
MDLATFPLNIFTTQRMFNDYGADDMRYGDICERRMKNEFGLTHISNVIDPWNMTRLHPFHNPQSRFAGAYAKPGEKLSPLECARLLFAEMQTTSLPFALVGPQRFLINKMLEHFMRSSGLPFRD

SEQ ID NO: 109623 - protein, 185 aa, Glycine max
  Coding DNA Sequence Number=SeqID_17938
MSEIEEVQEQMKTDMEAMKEQTTIMMEAMMSMKKIMKVNAATVVAASTATEVDPTHPSSLNRINHPASDMVGQGGKELGSVGSPHFVKVKNKHSFPPYGLPPNYTPPDVAHAFDENVNNSPPILIERQQTQSDHAHVSQHIGGTHEAPRDHNLVDFEPHLGYATEGQAFCGIPLPNTLEGPKFRP

SEQ ID NO: 109624 - protein, 130 aa, Glycine max
  Coding DNA Sequence Number=SeqID_17939
EWEESKEFSDCVVLNYSTREKGDTKEFRRLVLRSFGKGRRDTQKEFRRLVLGEFFLAKGEENEKMNSTSFQGLENQKTSESFWYKEEEEVQRDSSLVKDCNEMIGKVFKILKCKTKPCFYRLSCLVKKTI

SEQ ID NO: 109625 - protein, 78 aa, Glycine max
  Coding DNA Sequence Number=SeqID_17940
MLRCWTINDLFVFERRETLRCWTINDLLAWSTKAGLLLLRILNYDEEIRPAYFLQKRVNDRFDFVLTVIKRDYNKMIG

SEQ ID NO: 109626 - protein, 209 aa, Glycine max
  Coding DNA Sequence Number=SeqID_17941
MELMSKSDQRIKSLKSTVSNLVTLMSQRAHGTMPSHTKANPKEELNVLTTRNKRPIAKLKKKDKERSAMSLKKLPPKLKDPGSFSIPCVIGNLSFYRALCDFGAIGTYLPGGNNGEFFGERALIDVREGKLTSRLGDEVEVLIILGSSQSSSSSCNFVQARPHPRIVARKGHQPIQRWLIYLLFDCQAWDVKQVISKRQPVNALAFELD

SEQ ID NO: 109627 - protein, 27 aa, Glycine max
  Coding DNA Sequence Number=SeqID_17942
MAPKKLSTKRSRRDATGEGSSTASEFD

SEQ ID NO: 109628 - protein, 75 aa, Glycine max
  Coding DNA Sequence Number=SeqID_17943
  Subcellular localization annotation: CTP_CleavageSite=31; ConfidenceScore=5.18e-01
MNHLNFSTSSVVQFRDAQIKLRLNSNSHNIRCRKANNISERLLKLTMEALENSNGASCLRWSKLSMETHGKFKWP

SEQ ID NO: 109629 - protein, 149 aa, Glycine max
  Coding DNA Sequence Number=SeqID_17944
  Gene Ontology: Mol. function=helicase activity; Biological process =viral genome replication
  Homolog annotation: Hit_ID=Q2A9E0; Match level="QueryCoverage=100%, HitCoverage=10%, E-value=7e-33, Identity=51%"; Hit description =Putative uncharacterized protein
MLDDHNVHAKSFRMVMDRLSDSQLDNLKLRLIAGREKDGRTYNLPNVYEVVALIVGDLDADSIRDIIVKTQNGELQRIHELHSSYLGLQYPLLFPYGEDGYRPDILHRSTSGSKKRKRNRLTMRDWFAYRLQSRSNEAQTLLHSRKLFQ

SEQ ID NO: 109630 - protein, 143 aa, Glycine max
  Coding DNA Sequence Number=SeqID_17945
MAVQLIHDRVVMECLEGVRETLEGNERCRFRGTIRLTTTSLVHPEEPACTLQQPVEWILPTPTPYRLVEPVHVIEVSSSEEHLEEDPEELPPEPAMDALDLPEDDEDPLPDVDSLEDIMSASEADSTEESGPGGAANSDDSSS

SEQ ID NO: 109631 - protein, 119 aa, Glycine max
  Coding DNA Sequence Number=SeqID_17946
MELIENMSASDHAILHDRVHQPTKKSLPELSSQDVVLAQNKFLSRQLEILTETLSNLPTNLSNGQPLQPSILLVTSCTICGGTHESDLCIPFEEQTQEVSYLGNQQRQGYNQGGFSGFQ

SEQ ID NO: 109632 - protein, 176 aa, Glycine max
  Coding DNA Sequence Number=SeqID_17947
  Gene Ontology: Mol. function=hydrolase activity, acting on acid anhydrides, catalyzing transmembrane movement of substances; Cellular component=integral to membrane; Biological process =magnesium ion transport
  Homolog annotation: Hit_ID=P22036; Match level="QueryCoverage=100%, HitCoverage=19%, E-value=1e-64, Identity=69%"; Hit description =Magnesium-transporting ATPase, P-type 1 (EC 3.6.3.2) (Mg(2+) transport ATPase, P-type 1)
MDVLCTDKTGTLTQDNIILEHHLDVGGAESNRVLMLAWLNSSSQSGARNLMDRAVLRYGEGRLAPAEKERFVKLDELPFDFVRRRVSVSVEDSRYGDKSLICKGAVEEMLEAATHIREGDKIVELDALRRELLLTKTEDYNAQGFRVLLVATRKLDDAALNVPLTAADEQGLTVEG

SEQ ID NO: 109633 - protein, 124 aa, Glycine max
  Coding DNA Sequence Number=SeqID_17948
  Subcellular localization annotation: CTP_CleavageSite=53; ConfidenceScore=5.52e-01
PMNSLPSAVHASSTHESGALRIYCLALSPANSLPSAVRQFSTLIRRPMNSLASAVHVSAPNESGAPRIHCLALFANSPFSTLIQRPMNSLASAVHVSSTIESGASRIYCLRCLPILHSQSFGDP

SEQ ID NO: 109634 - protein, 159 aa, Glycine max
  Coding DNA Sequence Number=SeqID_17949
  Homolog annotation: Hit_ID=Q6WAY6; Match level="QueryCoverage=99%, HitCoverage=34%, E-value=4e-18, Identity=31%"; Hit description =Putative uncharacterized protein
GVLFPNVNGLVDLEAIDTFLAYHDRKESPVVAILADLYDTFDRRCEKSSTRIVCCTPDLYVWILISCGGFPNVPLIGTRGCISYNPILAIRQLGYPMRGAPLEEELAPIIARGFYKTNVEALQKVRKAWEMVQKKDKELKGSNNGPIGGYRKWLKAHMQ

SEQ ID NO: 109635 - protein, 135 aa, Glycine max
  Coding DNA Sequence Number=SeqID_17950
MAEQPQPGIEQEHPQHRRNHRRYRIGQQQQRLIELFQPDNVIHQRRQQQRECHAAYRHQRAKHEGGPERIKVVVVTEQAAEVIKANKRAGDAKRIDALQRVPQRLPGGPEKKDRGDRQLRCHQQIRQQTGAENRT

SEQ ID NO: 109636 - protein, 42 aa, Glycine max
  Coding DNA Sequence Number=SeqID_17951
MEALEKFKWQDTGKTPKWRRKIKSGKDKPFRVKEDEGPSGEG

SEQ ID NO: 109637 - protein, 66 aa, Glycine max
  Coding DNA Sequence Number=SeqID_17952
ENTRIMYEQTKSMLNAYDDAMTHAKWECDNGQMQERYVHYDAEEMFMRGSRQNPCAMHMRKAQHGN

SEQ ID NO: 109638 - protein, 138 aa, Glycine max
  Coding DNA Sequence Number=SeqID_17953
MFILNAEIHKQIIKGFGFVCRNHHGNTMVAATKMLQQCYSPKIVEALCMKWALQVAKDISLHSFILETDYLQLREFAKSNLQWLSGRKNPEEDELPGSLSALLQVIKRTASAHSLSERSALSQKLLMCTKRSIRVLST

SEQ ID NO: 109639 - protein, 90 aa, Glycine max
  Coding DNA Sequence Number=SeqID_17954
  Subcellular localization annotation: CTP_CleavageSite=64; ConfidenceScore=5.04e-01
MVFGTYFWLLSQRALRGRAKARLTGALSKGGKMRGVATDVYLVKNVGKNRRKPVKMKILSSGVVFALEEGRQKRGFCSYVPSIEEEIRPT

SEQ ID NO: 109640 - protein, 85 aa, Glycine max
  Coding DNA Sequence Number=SeqID_17955
MGFSDVTLQRIPNQEFWKKLEISPFNLLFERCNPCNVHMLPKKDGISPCSLLPVRKGQGSEEKESLGREEMTKQCYYHQDKAPED

SEQ ID NO: 109641 - protein, 107 aa, Glycine max
  Coding DNA Sequence Number=SeqID_17956
  Subcellular localization annotation: CTP_CleavageSite=60; ConfidenceScore=5.48e-01
MHTQSFTIPQIPKIGLTHKNSPQWSRQLSQPTLLRASEARLTGASSKGGKCAESPPTFICGKHRKNRRKPVMKNIPDSGVVFTFEEGRQKRGSCSYVPFIEEEIRPT

SEQ ID NO: 109642 - protein, 124 aa, Glycine max
  Coding DNA Sequence Number=SeqID_17957
  Subcellular localization annotation: CTP_CleavageSite=29; ConfidenceScore=5.61e-01
MGSPPASSSPPPPPSDASASPSTVKRTRKASHLRSLSTRPLGADRPVVHVDPATGKADGPHRKKLRTYLGIVARDKVSVTYENWKEVPTAQKDLIWEDIQAEFDIPEASNSRTKRKLLQTMGER

SEQ ID NO: 109643 - protein, 124 aa, Glycine max
  Coding DNA Sequence Number=SeqID_17958
MKREKHASYSSHDSCKSLSEELSDYYRGNHSSHTKHHSQIREKDRRPQEVNISLPYFHGKDNVEVYLDWEMKGMKDSWGSSSRVLNDLKSALRKRHIPSYYERELMDKLQRIRQGSMSVEEYRQ

SEQ ID NO: 109644 - protein, 138 aa, Glycine max
  Coding DNA Sequence Number=SeqID_17959
  Homolog annotation: Hit_ID=A9CFD4; Match level="QueryCoverage=24%, HitCoverage=5%, E-value=1e-09, Identity=85%"; Hit description =Putative uncharacterized protein
MGLTKPFNGIPTDIEIRQDDLTLPIPADATEDGFRQRQSCRTGQRLYGGVLLLRRQSRAGGAFRACRHVMKLTKDEGLMAKAIKAAHRPQNRHDRGSAASTPDGLSIGDAATADRSGGAAEASRFAGGDRVRISARAR

SEQ ID NO: 109645 - protein, 142 aa, Glycine max
  Coding DNA Sequence Number=SeqID_17960
MEPMKEQMATMMEAMMSMNKIMEANAVVVPATSAIAKVNPTPPSSLNQMNHPCRQRQTDHAHVSQTMGETHEISLHNLADFEPCLGYATEGQVVGGILLQNTLEGPQFRPQPQPLHSTTGKIPPIMEGMGKVGSSRGKPQGR

SEQ ID NO: 109646 - protein, 55 aa, Glycine max
  Coding DNA Sequence Number=SeqID_17961
  Homolog annotation: Hit_ID=A9LGX2; Match level="QueryCoverage=72%, HitCoverage=35%, E-value=2e-07, Identity=70%"; Hit description =Putative uncharacterized protein
MAHQGQRIAIPRGSDCRLQLACMKSELLVIAGQPYGGEFIPGPYTHRPSHYGSWQ

SEQ ID NO: 109647 - protein, 117 aa, Glycine max
  Coding DNA Sequence Number=SeqID_17962
  Gene Ontology: Mol. function=transporter activity; Cellular component= periplasmic space; Biological process=transport
  Homolog annotation: Hit_ID=Q6D3E3; Match level="QueryCoverage=96%, HitCoverage=21%, E-value=1e-54, Identity=81%"; Hit description =Periplasmic dipeptide transport protein
MPVQRPYNPNARRMAEMIQADWAKVGIKANIVSYEWGEYLKRVKGGEHQAALMGWTTATGDPDNFFGPLYSCTSANGGSNSSKWCYAPFEKIITEARAEQNHDKRVALYREAQADDA

SEQ ID NO: 109648 - protein, 327 aa, Glycine max
  Coding DNA Sequence Number=SeqID_17963
  Gene Ontology: Mol. function=signal transducer activity; Cellular component=membrane; Biological process=signal transduction
  Homolog annotation: Hit_ID=A8APN6; Match level="QueryCoverage=86%, HitCoverage=58%, E-value=1e-71, Identity=50%"; Hit description =Putative uncharacterized protein
  Pfam annotation: Domain name=HAMP; Domain location=6-75; Score=32.7; E_value=1.3e-06; Accession=PF00672.16; Description=HAMP domain
  Pfam annotation: Domain name=MCPsignal; Domain location=106-284; Score=78.5; E_value=2.1e-20; Accession=PF00015.12; Description =Methyl-accepting chemotaxis protein (MCP) signaling domain
  Pfam module annotation: Pfam domain module=HAMP::MCPsignal; Domain location=6-75::106-284
MTKVIIVSAVVFGLLILLFTDRYLVTMLVKPLDRIRNHFTVIAQGDLSQPVEEFGRNCVGKLVPLLRAMQDSLREAVSAIRSGTENIYRGAAEISAGNNDLSSRTEEQAAALEQTAASMEQLTCHGEIQRRQRTSGQRAGGDRHRHRAAGRPSGWRSGDHHAGHFRHEVRNLAQRSAGAAKEIATLIEDSVSRVEKGSELVSSAGSTMDDILKSVQDVNEIMKHIAAASEEQSKGISQVGTAVTEMDSVTQQNASLVEQVSAAASALERQTEELQASVAKFRLSDSAPRAQAVASAAAPATALRRPVLSAAAGAQGKPASSVEWVSF

SEQ ID NO: 109649 - protein, 113 aa, Glycine max
  Coding DNA Sequence Number=SeqID_17964
MKKSLFVAAIAAISLVACKKTEATSTEGAADSAAVAATDSAAVVADSAAQVVDSAATATVDAAKGAAAATTAAAADAAKGAAAGAADAAKGAADAAKDATKEAAKEVKDAAKK

SEQ ID NO: 109650 - protein, 123 aa, Glycine max
  Coding DNA Sequence Number=SeqID_17965
MNLPNLTLLQKKDDDKNLKSKLPNNFYAGESKEKQHIPLPFPPRTISDKKLEEELCTNKRKLKGSERISMGRNVSALIGKSVPQIPEKCKDLGPLQSTDVVIHLANRSVAYPAGFIEDVLVRV

SEQ ID NO: 109651 - protein, 236 aa, Glycine max
  Coding DNA Sequence Number=SeqID_17966
MARSRLWPSLNSFRLGFPTLIKALCRSRGVASDSPIFERLSPIINLAYIRKNCWNHADLTVTIRGARRARARPAEAPSTSAAPPPARTSAASSTPSSADFQRLEAMLRSIHQGQIFLLQSLQLVAPLDSIPSVEQFNERDESSKTSTPEPLIRRKRVVETQEVAATSEKSLEATPEPTTPVADTTSPQQAADPSTPEDHTTLAVSPNASPIATPVVHFMDEEDVQMQNTQDQSQDF

SEQ ID NO: 109652 - protein, 69 aa, Glycine max
  Coding DNA Sequence Number=SeqID_17967
MQQNFVLVQKMLMHGWLWKGLYIFGYGYFLADPNGQNLGGIDGDPVLRGTRITATWEYVSSVERGQLGM

SEQ ID NO: 109653 - protein, 91 aa, Glycine max
  Coding DNA Sequence Number=SeqID_17968
VDSRGSPVDPEKSNRALGFPALITSLCQFYEVSVAPSKVISPPTNRAFIKKYCAPRQAQGETPQQPRDGRQQAIRASPPPLEFTSAHPQKG

SEQ ID NO: 109654 - protein, 86 aa, Glycine max
  Coding DNA Sequence Number=SeqID_17969
MQWRFPNSDDAKVRLGFRSLLKSRGKLEDSASVEGFLSVWGFNREQRWFVVATMGDGERAWDFGNGFGRKKEKEMAFFLSYLDYKA

SEQ ID NO: 109655 - protein, 47 aa, Glycine max
  Coding DNA Sequence Number=SeqID_17970
SRQVDCGNQPRYIGTDASGVRVMTDRSLPLPGAKQAENVAARQPSIL

SEQ ID NO: 109656 - protein, 96 aa, Glycine max
  Coding DNA Sequence Number=SeqID_17971
  Gene Ontology: Biological process=transposition, DNA-mediated
  Homolog annotation: Hit_ID=Q1J7G7; Match level="QueryCoverage=48%, HitCoverage=68%, E-value=1e-12, Identity=70%"; Hit description =Transposase
DLPSQVLQWLLFISAVPPVQLLTGWCVTAKAPPDISAGKARPIRHSGCATVGKGHRCGPVDYYTSWGKGDVDRANWSSTAVAAALEIKDPPGGRHS

SEQ ID NO: 109657 - protein, 125 aa, Glycine max
  Coding DNA Sequence Number=SeqID_17972
  Subcellular localization annotation: CTP_CleavageSite=36; ConfidenceScore=5.52e-01
MTEPSKKKKGSSSTAAAAAHRRHGPSKAPTTPIHPSLSSPRSSTLFLSDDQRLRYLSQFSSRIILDLKYLDIDFFNDETFDCYQVFQNSGLVDFMSLKLPHYPELVKVFYCNLKIQDGIISSEVH

SEQ ID NO: 109658 - protein, 183 aa, Glycine max
  Coding DNA Sequence Number=SeqID_17973
MAKFDPDIVLEFYANAWPTEEGVRDMRSWVRGQWIPFDADALSQFLGDPLVLEEGQECKFSQRRNKADGFDEEAIAQLLCIPGQDFARTAAGRRVWIMHTSMTILTQMWMTLMLSNVLPSMPPTRHPLDPDKSNRALGFPALITGLCQSFGVLVTPSKVIWPPITWAFIEKYCTPRQVQGDAP

SEQ ID NO: 109659 - protein, 188 aa, Glycine max
  Coding DNA Sequence Number=SeqID_17974
MTTLAQTWSVLSFSNLIPTSHTSDITFDRARLIYGIIQKMDMNQGYIISAQVSLIAQHDSSRLGFPALITALCKARGVISDSLTLETLGPSINVVYVKKNCWNLDDLSITFRRPRKASGKRSEVPTTLAPPETPAPSSSTAPVPPILTPVIPLASAQIPLLVPLSTGPSDFIFTPQMFHSMLQSIHMG

SEQ ID NO: 109660 - protein, 95 aa, Glycine max
  Coding DNA Sequence Number=SeqID_17975
  Homolog annotation: Hit_ID=Q1SWJ5; Match level="QueryCoverage=77%, HitCoverage=34%, E-value=1e-08, Identity=37%"; Hit description =Putative uncharacterized protein
MAVQFLEEISNVPIQSQVKDNMIWLPEPNGQYTTRSAYSLCMNTRSVNSEDKIFKTIWQLHIPPRAVIFCWRLLKNRLPTKVWVVDCLNVLYMAA

SEQ ID NO: 109661 - protein, 77 aa, Glycine max
  Coding DNA Sequence Number=SeqID_17976
MRIKRSFKVVMGPRTRYGEIWNKWLNPKGIEEQRGITFEKQHFIQHACSELQNKERETRLKRAIKGISKFFKSKNYG

SEQ ID NO: 109662 - protein, 103 aa, Glycine max
  Coding DNA Sequence Number=SeqID_17977
IAPTRHLVGPEKSNRVLGFPALITSLRQFYGVLITPSKARDRQVITRPAQDVKEALLGGNLEVAMKKLPAKRSRKGTIEEDSNVAPQADTGFKKYQFQSVEHQ

SEQ ID NO: 109663 - protein, 59 aa, Glycine max
  Coding DNA Sequence Number=SeqID_17978
MQKGSKTESIDVEMGDQLEDMIHDLGQESFEQAHAHVDKNFTSLLQVVQDMLPDENTLP

SEQ ID NO: 109664 - protein, 79 aa, Glycine max
  Coding DNA Sequence Number=SeqID_17979
MQGRSSAGDLIPIDLEINTTCRWRNQERIRNFLQDLEAAAIPEEEPQSSEASSSFHIAEHSHLDPSEDYIMAEEPRRVT

SEQ ID NO: 109665 - protein, 296 aa, Glycine max
  Coding DNA Sequence Number=SeqID_17980
  Homolog annotation: Hit_ID=Q2HW90; Match level="QueryCoverage=59%, HitCoverage=35%, E-value=3e-20, Identity=33%"; Hit description =Putative uncharacterized protein
MVEVSIEAIASLAQYYDRLLRCFTFGDFQLSPMVEEFEEILGCPLRGRKPYLFSGFYPSLARISKIVQISAQELDHRKQVENGVVEIPRKYLEAKARILAGKCKWAPFIDILALLIFGGVLFPNVDGLVDLAAIDAFLAYHNHKESPVVAMLADLYDTFDRRCEKSNTRIVCCTPTLYVCYNPVLAIRQLGYPMRGAPLEEEFTPIIARGFNKTNVEAFQQVRKAWEMVQKKDKELRGSNNGPIGDYHKWLKAHVQGLDWLPSLRTAKRKEVEAPEEDEEVQALRAELEQAQTIKE

SEQ ID NO: 109666 - protein, 76 aa, Glycine max
  Coding DNA Sequence Number=SeqID_17981
MGAKYLEAVKQRLHAIKQWSPNEITAINLWGSGLDGGGCMNGNQFMGLRIRFDGGGCTNGARQSIRRAPDSMVEDA

SEQ ID NO: 109667 - protein, 168 aa, Glycine max
  Coding DNA Sequence Number=SeqID_17982
  Homolog annotation: Hit_ID=A5AI19; Match level="QueryCoverage=79%, HitCoverage=35%, E-value=3e-10, Identity=28%"; Hit description =Putative uncharacterized protein
MASLERQFIIEEASLKGPLGFVGEDYPYWKDGMEMYIKSTHYRIWLIITNGDIPIPKPKARIHLKVLDNFPNVWELKTTCIQEVRDMKNLAWDELLGILRVHEVHIQSKEHLQKNNFAALKFEETCFRRKENKSLCKALKVLMQESDGSNNYDGSINDEMTLMYKNFK

SEQ ID NO: 109668 - protein, 59 aa, Glycine max
  Coding DNA Sequence Number=SeqID_17983
MCAQEMAPKKLSAKRSRRDTATEGTSAAPEFDSHRFKSAEHQQCFEAIKGWSFHRETDF

SEQ ID NO: 109669 - protein, 94 aa, Glycine max
  Coding DNA Sequence Number=SeqID_17984
MFLIFNTSALKGLDDTPQPKSKAAARWNVVKCNIQKGITECGYYVMHWMSTIILGSFRNNWETYFNEVRPLEAERFKALCIQWAQYYLKVRNQT

SEQ ID NO: 109670 - protein, 53 aa, Glycine max
  Coding DNA Sequence Number=SeqID_17985
VPTNPMRIKVIPEWLTTPSVEGGSPKFQEPLDFRSNPFQGGGNDAILPPKGIG

SEQ ID NO: 109671 - protein, 67 aa, Glycine max
  Coding DNA Sequence Number=SeqID_17986
MGVKYLEEVKQRRGWAFSPWVKVYGELGFWLKACRTAGHDICQSVGLASGSGIKVMPHIISMTHMQQ

SEQ ID NO: 109672 - protein, 103 aa, Glycine max
  Coding DNA Sequence Number=SeqID_17987
MAEVDEVQEWIKADMEAMKEQMATMMEAMISMKKIMEIRAALILCKSRTNMFSRHMVCLRTILHPMRMSITPLLYSLRANNLKLIMHMSLNPWGRHMKYPIAI

SEQ ID NO: 109673 - protein, 146 aa, Glycine max
  Coding DNA Sequence Number=SeqID_17988
MSVDCHKEDCQEDIYSDVQAAPGSSQDSRCLLDAICGALTGPGVSSDYMFLRTAPVRACCCQIKTGEDDRWVHYSDHLAPAGDICIVPEACHAIAKTLEHHPSLNEVMPGTLTHEVIQKCLRIARGVTEDRNMHAGSRRRRRTDQP

SEQ ID NO: 109674 - protein, 93 aa, Glycine max
  Coding DNA Sequence Number=SeqID_17989
  Homolog annotation: Hit_ID=Q6WAY4; Match level="QueryCoverage=76%, HitCoverage=13%, E-value=3e-08, Identity=43%"; Hit description =Putative uncharacterized protein
MGLSQAFLLKKRFYQVKVKSLGVTSLKELGQLMGQLQRQAFHKAYGKIWDLAVAEVSTEAIASLAQYYDQPLRCFTFGDFQLSPTVEEFEEIL

SEQ ID NO: 109675 - protein, 91 aa, Glycine max
  Coding DNA Sequence Number=SeqID_17990
  Gene Ontology: Mol. function=peptidase activity
  Homolog annotation: Hit_ID=Q8H6W2; Match level="QueryCoverage=96%, HitCoverage=96%, E-value=3e-16, Identity=44%"; Hit description=Gag -protease polyprotein-like protein
MDSSNFLFPEGSSINRPPIFNGVGYHYWKTHMQIFIEAIDLNIREAIEIGSYIPTMVVGNTTMEKPREQWDEEERRRVQYNLKAENIITSI

SEQ ID NO: 109676 - protein, 156 aa, Glycine max
  Coding DNA Sequence Number=SeqID_17991
MGTNQIGKRFYQIKLVATDVRKECAGLREENAATAKALEQETKRARKEEHGGDKFRGAFWGSNNELKLRREEKDRSRAHSMTNMLAIITTAHEHRVADEYAQVYAEKEARGRVIDSLHQEVTMWMDRFALTLNGSQELPRLLAEAKAMADTYSAPE

SEQ ID NO: 109677 - protein, 187 aa, Glycine max
  Coding DNA Sequence Number=SeqID_17992
  Subcellular localization annotation: CTP_CleavageSite=67; ConfidenceScore=5.21e-01
YNPGWRNHPNLRWASPPQQQQPVPPYQNAAGPSKPYVPPPMQRQQQQQQRQQATEAPFQPSLEELVRQMTIQNMQFQQETRASIQSLTNQMRQMATQLNQAQSQNSNKLPSQIVQNPKNVSVITLRSGKQIEVPPPVAAPAPEPVKLHSTPEKEDEIVAQKRKLPNHEGANKKFHAGGPSSSNFDLQ

SEQ ID NO: 109678 - protein, 118 aa, Glycine max
  Coding DNA Sequence Number=SeqID_17993
MTRGNSSNLQPFDPEIDRTFHRLVRHSVHPGHSVHFEHPNHFEYSIAGDSEYSDFEHSAVNFQTENMAQPPPRERNLREMAAPDFTYESLCIQYLDEGVPYVLKTGLIHLLPKFHGLA

SEQ ID NO: 109679 - protein, 61 aa, Glycine max
  Coding DNA Sequence Number=SeqID_17994
TPDDILNLLQATMTPTQDALLYYNGRWNMSCQDDFGVTRSQEKIKKDLTFLWDVASTDSRM

SEQ ID NO: 109680 - protein, 104 aa, Glycine max
  Coding DNA Sequence Number=SeqID_17995
MGVYWKAHQIVKYLKLKRMNLSIEHCESNDFQDYFDDAKESRVKQVPKNQASRIKSLRIKIQEQSSLKDSRTIKIKIQDLREVDFKIQEKKSRSNSQDFTREMV

SEQ ID NO: 109681 - protein, 164 aa, Glycine max
  Coding DNA Sequence Number=SeqID_17996
MKIDMNVGYLISHQISLIAQHDTSRLGFPTLITTLCKARGVQSDSRSLESLSPAINLAYIKKNCWNLDDPTITFRGPRKARGKRSEAPSTSAPETGGPSSSTLPPSSSIEIPVIPPAPTQIPLPALSLQGLGLPSIMSMEEFDAQVAWTGDQPSSSGGGGASTA

SEQ ID NO: 109682 - protein, 195 aa, Glycine max
  Coding DNA Sequence Number=SeqID_17997
MSSKEELERRHWDEKLTGFSDSSIDIDIVKEFYANLYDPEYKSPKQVRVRGHLVKFDEDTLNTFLKTPIVLEEGENLCTYFRFALLRPDPQELAAKLCIPRRGFELNADGQPLKILRKNLTTLAQTWKVLRIHFLSLAHHYAKRSFSALSATEESGRASISRSCAKREINALSAAVVFRQAQRTTGAKLKSTYSR

SEQ ID NO: 109683 - protein, 417 aa, Glycine max
  Coding DNA Sequence Number=SeqID_17998
MQCSFDSTKLALLAKPLFEINCSGLNGIKEKEEHCFKATELERCNLHKRLANLQEGSIDVAVVKEFYANLYSPEDQSPKQVKVRGHLIRIDVDRLNTFLETPVVLEGATLPTYSRFTRMRIDPQEFSTRLYIPGRGFVLNAEGHPWKLLRKDLTTLAQTWSVLSYSNLTPTSHTSDLNMDRARGARKVRARLADVPSSSAPPAPPTSAMPTPAAHDSQRFEAMLQSIHQGQILLLQSLQVVVPLGSILSVEQFIEKVSWPGTVPSTVREGEGPSAQVPQQVHDASSKATIPGAFDFLGAGVKIRPDEAVFPEPIVAVIHETVEAGESQLRQEAATPERTPQTLEDPLSPGMGLSFARQVTDPPTPVHERQADPPTPIMEMLEDPTTPVLRLSSTPPATPVLHLIDEEDMQDQDTQGT

SEQ ID NO: 109684 - protein, 167 aa, Glycine max
  Coding DNA Sequence Number=SeqID_17999
MTKQQRSTKCDPSYWEYIDALHSVQNSNSSIKRSASSSEQPIQRRTMPMLDQFHPCIHDSIINIVDVKAYGIGLEDSWSLVCNHLLKELTKWSDEYINLVGGIDRFEELKRSLLVDGLSMMNITDMGYVIASRYNVILVSLSLQQSMTFILRLSNLSNLSAIAWQVS

SEQ ID NO: 109685 - protein, 204 aa, Glycine max
  Coding DNA Sequence Number=SeqID_18000
  Homolog annotation: Hit_ID=A5B5G6; Match level="QueryCoverage=33%, HitCoverage=20%, E-value=4e-08, Identity=44%"; Hit description =Putative uncharacterized protein
  Pfam annotation: Domain name=zf-CCHC; Domain location=91-108; Score =22.6; E_value=0.00058; Accession=PF00098.14; Description=Zinc knuckle
MKREKHASYSSHNSCKSLSEELRDYYEGRHRSHLRPHSHRRENERKPQEANINLPYFHGKDNVETYSDWEIRIEQKLKRKSTSMQEKTSSIKCFKCLGRGHITSQCPTKKTMIMRSQDIYSSQDEATTSPSSSEIEEAKGEESSEEIYPQGEGQPLVFKEEYKEKLVSIATPLGLEFIPQVKELLDEGLVRKSLNPCALSVPKI

SEQ ID NO: 109686 - protein, 113 aa, Glycine max
  Coding DNA Sequence Number=SeqID_18001
MKLAKYRLKAQVEKDKAPEWRRMKAQVEKDEGPEAETLSRLSITYQGNPCGVYPDLSSFTGSGVYPDLSSFTGSGVYPDLSSFTGSGVYPDLSSFTGSGVIQISVACIKRSAP

SEQ ID NO: 109687 - protein, 145 aa, Glycine max
  Coding DNA Sequence Number=SeqID_18002
  Homolog annotation: Hit_ID=Q6UUU1; Match level="QueryCoverage=37%, HitCoverage=36%, E-value=2e-17, Identity=81%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKMAYERGRRFPGKMPGRYLTGKAFPPGGSLVRSPVPAFRFTGGHSAVMAAFCLIPPPDTQSG

SEQ ID NO: 109688 - protein, 216 aa, Glycine max
  Coding DNA Sequence Number=SeqID_18003
  Homolog annotation: Hit_ID=Q2HW90; Match level="QueryCoverage=76%, HitCoverage=36%, E-value=9e-18, Identity=34%"; Hit description =Putative uncharacterized protein
VDSRGSHPNVDGLVDRAAIDAFLAFHDRKESPVVAILSDLYDTFDRRCEKNSARIICCTPALYVWLVSHLLRQEGASVNWFPRWKEGRTRILISCRGFPNVPLMGTMGCINYNPILTMKQLGYPMRGAPLEEGLTPIIARGFNSTNAGVLQKVHKAWELVQKKDKELRGSSNGPIGGYQRWLKAYTQGLDWLPNLRTTKGMEVKLQKKTKRYKPSR

SEQ ID NO: 109689 - protein, 117 aa, Glycine max
  Coding DNA Sequence Number=SeqID_18004
MEHFLEQVAWPEAQLPLVRPNEATPPEPAPARVEPMPAEPRSPVVNPPPSPELEVVPPSPSLIIISDASSDETTALLIHQLEKQLIPLIPQLEELPIFLILHLEKFLLSLIPQFRHC

SEQ ID NO: 109690 - protein, 39 aa, Glycine max
  Coding DNA Sequence Number=SeqID_18005
MSCKKDKDNLTKHFVHKELRRLSSLVTDAWGANTFPVRK

SEQ ID NO: 109691 - protein, 222 aa, Glycine max
  Coding DNA Sequence Number=SeqID_18006
  Gene Ontology: Mol. function=phosphoprotein phosphatase activity; Biological process=intracellular signaling cascade
  Homolog annotation: Hit_ID=A5AU60; Match level="QueryCoverage=88%, HitCoverage=23%, E-value=8e-27, Identity=32%"; Hit description =Putative uncharacterized protein
MRCGECTITLQDVSVLLGLSVDGAPLIGQTNLDWGELCEELLGVRPQEGELQGSVERCTTLAPKRTPPILENKPLGHRWLRRGNQHIGNDDLIVFRRKLDIMKRHEFLWEPYTTTVLLMLPLICLVCSVAWCAVVPLICFHVVEWHQPDRVLRQFGMQQPISESPSQPHNIHGLTLKGKQDENWFQLLAPMISQWNNRADFRVDIYPRQEGLLSFNSDLHGL

SEQ ID NO: 109692 - protein, 173 aa, Glycine max
  Coding DNA Sequence Number=SeqID_18007
MTGRLLSGSLAFESRILHYLIVRILLPRSSNLAQALRLNAPLPYPHLVTLFLQHFNIPLDSEPYVPIKRYFLIGAVVIASFGYRKENDGSWVKKGVQPIDDEGHLPVGEDSSLLHRILDRFDGLQTYVGERFVALELQVDMRFDEMGSRITKVEGDVTYICTCFDLPSPPPSS

SEQ ID NO: 109693 - protein, 222 aa, Glycine max
  Coding DNA Sequence Number=SeqID_18008
  Homolog annotation: Hit_ID=Q2HW90; Match level="QueryCoverage=58%, HitCoverage=31%, E-value=4e-14, Identity=34%"; Hit description =Putative uncharacterized protein
MPTGRKEAISFLWVLSLHDKSCQGSENLSTRVGPCKAKQKWSSRSTKEVFGGKGKGLGKIKATGLSFIDILALLIFGVVLFPNMEGLVDLATVDAFLAFHHGKESPVVAILAMYDTFNRGCKKSNARIVCCTPALYVWLVSHLFLQEGRPVYPLQGHRSMSKCSLDGTRGCINYNPVLAIRQLGYPMRGVPSDESITPFIAWGFSDHNARVLQGVRKAWDAA

SEQ ID NO: 109694 - protein, 167 aa, Glycine max
  Coding DNA Sequence Number=SeqID_18009
  Subcellular localization annotation: CTP_CleavageSite=28; ConfidenceScore=5.07e-01
TNVVFYAFCHPEAAGPMTCGDQLRSSTRSMSDKRAETNVFCALCHSNFANRVINAQRQNMVILRPLSFGDNKSRGGRRQIMVIPYTFSPSRGGRVWWHAETNYGHSAPSRPGSIASKDTQRQIMVIMRLVSTRRNEFDNKYRGQLSYPNFVRGPSIVGMRPSFDHFE

SEQ ID NO: 109695 - protein, 408 aa, Glycine max
  Coding DNA Sequence Number=SeqID_18010
  Homolog annotation: Hit_ID=Q6WAY6; Match level="QueryCoverage=74%, HitCoverage=51%, E-value=2e-30, Identity=30%"; Hit description =Putative uncharacterized protein
MVPTIEEFEEILGCLLGGRKPYLFFGFLPSLSKIAAVVGDSAKELDRTKQTRNDVVGLPRKYLEGKARDMASQEKWGPFADILALLIFGVVLFPNVDGLVDLAAIDAFLTYHHSKESPVVAILADLFDTFDRRCEKNSARIVCCLPALCVWLISHLFHQDTRHPCPLQSYRSCAEKGRVDWDQHLARIRGSAINWFPHWKEGKEGVLFLCGDYPNIPLIGTRGCINYNPALAIRQLGYPMRGASTEESLSPFLVRNLGAQSLKAIQRVHKAWRSPLRKDKELRGIRNGVIGGYHGWLRIHTQGLDWLSKLKVIDEEDFEAPEEDEEVRALKLELGKARLAKEKFKSAATHIQKECTELQEENAATAKALEQETKRARKEEYGQEKFRGALWGSNNELKLRRKERDRSR

SEQ ID NO: 109696 - protein, 125 aa, Glycine max
  Coding DNA Sequence Number=SeqID_18011
  Homolog annotation: Hit_ID=UPI00016621D1; Match level="QueryCoverage =98%, HitCoverage=40%, E-value=1e-09, Identity=35%"; Hit description =UPI00016621D1 related cluster
PITFRGLHVLAFRGLHVLANRGPHALTFRGLHVLAIRGLHVLTFRGLHVLAFRGLLVLAFRGLHVLAIRGLHALTFRGLHVLTFRGLHALTLRGLHVLAIRGLHALTLRGLHVLAFRGLDVLTFR

SEQ ID NO: 109697 - protein, 76 aa, Glycine max
  Coding DNA Sequence Number=SeqID_18012
MSKSCGFGMTGPLDESISCFLIRVDPWRTTCPRHQRTTSPHLERTTRPHHQRAARPYLQRTTCPRLERATRPHLGY

SEQ ID NO: 109698 - protein, 43 aa, Glycine max
  Coding DNA Sequence Number=SeqID_18013
MALDVHLIEPTQGYLAAAFSACPELGRDDDLSVVTLASICIRP

SEQ ID NO: 109699 - protein, 54 aa, Glycine max
  Coding DNA Sequence Number=SeqID_18014
MAGEEHPRRTLGDYIAHVVQRHFILECVILAIKVYVIITFYHALGWIDPEIREK

SEQ ID NO: 109700 - protein, 194 aa, Glycine max
  Coding DNA Sequence Number=SeqID_18015
  Homolog annotation: Hit_ID=A5C5V8; Match level="QueryCoverage=38%, HitCoverage=9%, E-value=3e-14, Identity=48%"; Hit description =Putative uncharacterized protein
  Pfam annotation: Domain name=zf-C2HC_plant; Domain location=82-137; Score=76.7; E_value=7.6e-20; Accession=PF07567.3; Description =Protein of unknown function, DUF1544
  Subcellular localization annotation: CTP_CleavageSite=22; ConfidenceScore=5.39e-01
MTAPWRLWQHGTNSIFFVFFPRLNQNSERNPPPTKSATPAPSRDPPHAECSQQQRPHGVLFQLAEPSSDAATASATRKNKTDPGWKYCHPLVEGETNIIVCNFCGKITNGGITRAKQHLIGKSGNIAACKKTPPNVVEELKEYMTIKKSGTTNTIRNYTFSIGYLGHSTLALKPMLKVTMLNVSSLTSIFKNRC

SEQ ID NO: 109701 - protein, 230 aa, Glycine max
  Coding DNA Sequence Number=SeqID_18016
  Gene Ontology: Mol. function=sequence-specific DNA binding; Cellular component=intracellular; Biological process=regulation of transcription, DNA-dependent
  Homolog annotation: Hit_ID=A8GCV2; Match level="QueryCoverage=92%, HitCoverage=75%, E-value=3e-98, Identity=82%"; Hit description =Transcriptional regulator, AraC family
  Pfam annotation: Domain name=HTH_AraC; Domain location=132-174; Score= 15.9; E_value=0.037; Accession=PF00165.14; Description=Bacterial regulatory helix-turn-helix proteins, araC family
  Pfam annotation: Domain name=HTH_AraC; Domain location=180-220; Score= 14.6; E_value=0.055; Accession=PF00165.14; Description=Bacterial regulatory helix-turn-helix proteins, araC family
  Pfam annotation: Domain name=PAS_4; Domain location=5-118; Score =97.7; E_value=3.5e-26; Accession=PF08448.1; Description=PAS fold
  Pfam module annotation: Pfam domain module=HTH_AraC::HTH_AraC::PAS_4; Domain location=132-174::180-220::5-118
  Subcellular localization annotation: CTP_CleavageSite=46; ConfidenceScore=5.09e-01
MPPLLNAIPNVVFFIKDRQARYLLANLTLARRCGFKSVSSLLGKTSADVFPSALGQGYTEQDLRVLREGVTLRDQLEMHLYNGRERGWCLTQKLALRDISGQVIGMAGISHDLQEAHARHPAWQRLAIVDDHIRRHYHRPIAMEELTALSGMSIAQIERYCKRIFHLTPRQMIHKVRLEKATELLAGDTPITDIALQCGYTDHSAFSRQFKAMTALDAARFSPHAARINA

SEQ ID NO: 109702 - protein, 88 aa, Glycine max
  Coding DNA Sequence Number=SeqID_18017
  Subcellular localization annotation: CTP_CleavageSite=37; ConfidenceScore=5.05e-01
MSASSDRHYEKVSFAIRKTQSTIASSGYGRPLHRSRRSSSDQHYEKVSFAIQKTQSTIASSGYGRPLHLSRDVSVFRPTQRKSLIRYA

SEQ ID NO: 109703 - protein, 68 aa, Glycine max
  Coding DNA Sequence Number=SeqID_18018
MRTRSPLKVRACNPLNGEGRVVLSRRGRVVLSTVRVTSTQVPKVHPYEKARDRLIERAGHPKSTRFGH

SEQ ID NO: 109704 - protein, 62 aa, Glycine max
  Coding DNA Sequence Number=SeqID_18019
  Subcellular localization annotation: CTP_CleavageSite=24; ConfidenceScore=5.11e-01
MFMTPRLSISAILGKKTRFSEEKSSQSASVTLPRHFREQIFEDFSPFFIVLRPFFVRSLFFN

SEQ ID NO: 109705 - protein, 156 aa, Glycine max
  Coding DNA Sequence Number=SeqID_18020
MERKDNKLRGSSNGIIGGYQKWLKSRTQEINCLPKLKGLSGKKAEVPEESEEMQALKAELEKTRVVKEKLKMTVTRDRKECDELRDVNMTMDEAIEQETKRARKEEWSRNKFRGALWGNNNELKLRKDERDESRMETMVLEDKLKAYQRVKRSLTE

SEQ ID NO: 109706 - protein, 68 aa, Glycine max
  Coding DNA Sequence Number=SeqID_18021
HGLKIYPKAHENPRAFPWISGPIYLESSIQCPCGAASPMTCGDTLWSSTPFVNREEWIRQYQDDFGRP

SEQ ID NO: 109707 - protein, 167 aa, Glycine max
  Coding DNA Sequence Number=SeqID_18022
MGEVEEVQKQMKADMEAMKEQMATMMEAMMSMKKIMKANAVAVAATSAFAKVNPMPPSGLNQMNHPTSDMVGMAGKELEGPGGPHLVRENKHAFPPYGFPPNYMPPNVAYTPNENANNFTPILIKSQQPQSDHAHVSRPMGETHEMPHHNLVDFEPRLGYATAGKAL

SEQ ID NO: 109708 - protein, 121 aa, Glycine max
  Coding DNA Sequence Number=SeqID_18023
MESGDMWAYLMVIRTFRQPGANEPVDAQRLTSSSAPFVILTYGDDVGRLILTILKIFAGFYSRRPETFKPDDAQDSSLLGGGRLSSMAWGSVVVPLGQLSYPNFVWGPLFGGMQPSLDRLE

SEQ ID NO: 109709 - protein, 89 aa, Glycine max
  Coding DNA Sequence Number=SeqID_18024
MSCQNEFVGYSFIGKNPKKFDIPSRCTMDELKDLIKKVAPAGIPPYGIHETQMVLLESNYWKKTGPIEILVVFSKPVMEMEDELSLSQN

SEQ ID NO: 109710 - protein, 132 aa, Glycine max
  Coding DNA Sequence Number=SeqID_18025
MEKSDKKTFKDKKEKKAYITCKDNDMDSSSDSENEIINLSLMAKDYESEEEVIVHQHVILERMLVTLEKCGPVTYGDNNKGKNPWSWKNRLIRQVCEVLIFICSLSQPASSTSHPLSATLLWLSMRKNLEEG

SEQ ID NO: 109711 - protein, 35 aa, Glycine max
  Coding DNA Sequence Number=SeqID_18026
ELEKRNVKICIASLQSKFERDPTVNESGIAVLVEQ

SEQ ID NO: 109712 - protein, 73 aa, Glycine max
  Coding DNA Sequence Number=SeqID_18027
MGFPLSAVIYPAENLSSQKIFYSLICILYSLSLEEILPSFSPGERMRILFTGQGSKYLKVVSQHGLFIVQARF

SEQ ID NO: 109713 - protein, 161 aa, Glycine max
  Coding DNA Sequence Number=SeqID_18028
  Subcellular localization annotation: CTP_CleavageSite=16; ConfidenceScore=5.13e-01
ISLNYATMLPFDFRTSQGPKKGRMSSSKGPRTKLGYDRLHVLAFRGLHVLDFRGLHFLASRGLHTLSFRGLQILVFRGLHLLYFRGLHLLALRGGVHVLDFRGLHVLVLSGLHVLPLRGLHVLALRGLHILAFRGLHALTFKGLHILAFRALHVLDFRGLH

SEQ ID NO: 109714 - protein, 199 aa, Glycine max
  Coding DNA Sequence Number=SeqID_18029
MARSEELLKEAFSSLRIRTPQSLPFPLKFHASFSFKSSTSTFRSFFDAEEDEEDNEEEDQDPLNVSGECRGRFRRACRSTEGGGQDRCCASWPFNRFKCRQELISKRSLRSNAEKFEFQAKVSWLAYGLCSAPKTLIESPFRASRAIMGNNNYICRVSFSSSVCGKNLQMEEMKVASNLLVGDPASLEKKIDAIRFGGP

SEQ ID NO: 109715 - protein, 51 aa, Glycine max
  Coding DNA Sequence Number=SeqID_18030
MTKKLAGYNTLLQHFLSVGFAVPAEDYDERRPCACRWTSGKALPVSTQASG

SEQ ID NO: 109716 - protein, 181 aa, Glycine max
  Coding DNA Sequence Number=SeqID_18031
MAQPPPRERTLREMTAPDFTYKSLCIQYPDEDVPYVLKTGLIHLLPKFHGLAGLSNKERSMIDATSGGALGDMTPAKARNLIEKMVSNSQGVHEVATNSSSSAETKKLEGKLDALVNLVTQPALNQKSVPVARVCGLCSSADHHTHLCPFMQHSGATEQRKAYAANIYNRPPQPQQQKQPQ

SEQ ID NO: 109717 - protein, 162 aa, Glycine max
  Coding DNA Sequence Number=SeqID_18032
  Homolog annotation: Hit_ID=A8G895; Match level="QueryCoverage=100%, HitCoverage=23%, E-value=5e-67, Identity=80%"; Hit description =Putative uncharacterized protein precursor
  Pfam annotation: Domain name=TPR_2; Domain location=59-92; Score =18.9; E_value=0.02; Accession=PF07719.8; Description=Tetratricopeptid e repeat
MADTDGNGRSAQIISQILTLLDGTVKSGFAGSDRLAALAYRSGQYPMAASLLKNAGDGGLAWWLRAKMALRDGDVKAATAAYAKAASAFPADESWGEQRNADFVAETIVPECRVAGEQAILALNRGDYLQAMDLLYRGKALYWADVADVAERVLTVDELKDF

SEQ ID NO: 109718 - protein, 144 aa, Glycine max
  Coding DNA Sequence Number=SeqID_18033
PDKSNKALDFPALITGLCQSFGVPVTPSKVIRPPITRAFIEKHCTPRQAQGGASQAPDAPPTPHQADLAGSFDTEPYLRHLSQGFAPFLGPTPAQFRAEVAWPGDWPEAQAGEAPAEAPGDGEEARMDEEMTDLLDFLGGSGTT

SEQ ID NO: 109719 - protein, 59 aa, Glycine max
  Coding DNA Sequence Number=SeqID_18034
QVQGKTPQQPRDGRQRAIDAPPPPLEFTSAHPQKGLSIAYTTWPTSRLPSPKPKISKSA

SEQ ID NO: 109720 - protein, 98 aa, Glycine max
  Coding DNA Sequence Number=SeqID_18035
MCRIWDEDSRDRAAYYRSTGSMKNKKNESQNHGKPYSTPPKHYGNRPSNQRTTAMGFSGGSDSKPTTSSIQIVCYRCDRRAIFRGIAQIPRRNEMVEV

SEQ ID NO: 109721 - protein, 44 aa, Glycine max
  Coding DNA Sequence Number=SeqID_18036
MKLIWSPESALKSYIDTVKSGSEGAWCYHLTSYLDSFEEKVSYD

SEQ ID NO: 109722 - protein, 97 aa, Glycine max
  Coding DNA Sequence Number=SeqID_18037
LGAVKVKVRSGGRRWQTRYAEGVVFVADMDEDEWMYEIMSKRADMDYENAEEACGANEPHVDCSDAFNTSQIIMCLSVEMMFCGGLDPWLMKTDLWR

SEQ ID NO: 109723 - protein, 71 aa, Glycine max
  Coding DNA Sequence Number=SeqID_18038
MVATPRIFPPLERAPVNLASHARKRACCDSWRLHWGSFSPTGLSKKGPYTRVHGNLRSGGESIIMLGLRLA

SEQ ID NO: 109724 - protein, 453 aa, Glycine max
  Coding DNA Sequence Number=SeqID_18039
  Gene Ontology: Mol. function=transporter activity; Cellular component= periplasmic space; Biological process=transport
  Homolog annotation: Hit_ID=A4W6V9; Match level="QueryCoverage=96%, HitCoverage=89%, E-value=0.0, Identity=85%"; Hit description =Extracellular solute-binding protein, family 5
  Pfam annotation: Domain name=SBP_bac_5; Domain location=69-426; Score= 307.9; E_value=1.9e-89; Accession=PF00496.13; Description=Bacterial extracellular solute-binding proteins, family 5
MTMRNSLLTVLGSVMLLGAALPAHSESVLRVGLGADPDMLDPHLARTYYGRFVFASLCDRLVDVDENLKVVPGLAKDWAWSDDGKTLTLNLREGVTFHDGEKFDAAAAKYNLDRALTLKGSLRKSEISSVESVEVTGPMQIALHLKTPDAALLMQLTDRAGAMMAPDAAKKPDFAAHPVCSGPYKFDSRVSQDRIVLTRFDNYWNKDAYHFDKIIYLPIPDASVRLANLRAGDLDLTEGIAASDVKTVEADSKLALAKVTGLGYQGITFNINNGKVPANDPFRDARVREAFSQAIDRDALNQVVFEGLYTPANQPFSTVSPYHVNLPVPPRDVDKAKALLKAAGVTTPLTVNLLVPNNPTSQQVGQVLQAMVAEAGFNLNLQMTEFATLLDRQQSGDYQLSFSGWSGRPDPDGSIYGFIHSTGTLNDGRYSNAQVDEWLTQARLSNDQAVRQP

SEQ ID NO: 109725 - protein, 99 aa, Glycine max
  Coding DNA Sequence Number=SeqID_18040
MGPVLSDLLRLLVGGSAKKAQAIQKQNIAPHVLSRGGYEYLEQKLMVEKTKKRLEEAAQSGSIEGIIDPPSPIRRHVKWKMARTKKTGQMTSEAAKEIT

SEQ ID NO: 109726 - protein, 179 aa, Glycine max
  Coding DNA Sequence Number=SeqID_18041
QPEAYAANIYNRPPQQQNQQQRNNYDLSSNRYNPGWRNHPNLRWASPPQQQQLAPPYQNDAGPSKPYVPPPMQQQQQQQQRQQATEALPQPSLEELVRQMTIQNMQFQQETTTSIQSITNQMGSGNQIQVPPLVAAPAPEPVKLHSTPEKEDEIVAQKRKLPNKNFHAGGPSSSNSDLP

SEQ ID NO: 109727 - protein, 15 aa, Glycine max
  Coding DNA Sequence Number=SeqID_18042
VNAVNIFPDAQNGLG

SEQ ID NO: 109728 - protein, 258 aa, Glycine max
  Coding DNA Sequence Number=SeqID_18043
  Gene Ontology: Mol. function=cyclopropane-fatty-acyl-phospholipid synthase activity; Cellular component=cytoplasm; Biological process =lipid biosynthetic process
  Homolog annotation: Hit_ID=A6THP5; Match level="QueryCoverage=100%, HitCoverage=63%, E-value=1e-131, Identity=87%"; Hit description =Putative cyclopropane-fatty-acyl-phospholipid synthase
  Pfam annotation: Domain name=CMAS; Domain location=48-253; Score =190.3; E_value=4.7e-54; Accession=PF02353.11; Description =Cyclopropane-fatty-acyl-phospholipid synthase
  Pfam annotation: Domain name=MTS; Domain location=64-225; Score= -89.6; E_value=0.047; Accession=PF05175.5; Description=Methyltransfera se small domain
  Pfam annotation: Domain name=Methyltransf_11; Domain location=114 -211; Score=48.8; E_value=2e-11; Accession=PF08241.3; Description =Methyltransferase domain
  Pfam annotation: Domain name=Methyltransf_12; Domain location=114 -209; Score=32.7; E_value=1.4e-06; Accession=PF08242.3; Description =Methyltransferase domain
  Pfam module annotation: Pfam domain module=CMAS::MTS::Methyltransf _11::Methyltransf_12; Domain location=48-253::64-225::114-211::114-209
MDGEWETAQLTPLLQILALNGEVLGRLEKGFRLLGRPLERLRHWTRRNSRAQARENIAAHYDLGNTFYSHFLDKELLYSSALFTADEQDLTAAQQAKMARLCEQLALSPGDHLLEIGTGWGAMAEYAARHYGCRVTTTTLSQEQYVWATERIARAGLQDRVEVLLCDYRDLTGEYDKLVSIEMIEAVGQRYLPTFFRTCQARLRPGGRMAIQAITIQDQRYRDYSKSVDFIQRYIFPGGFLPSITAMNDLMTRHTDFV

SEQ ID NO: 109729 - protein, 351 aa, Glycine max
  Coding DNA Sequence Number=SeqID_18044
  Gene Ontology: Mol. function=enzyme regulator activity; Cellular component=membrane; Biological process=capsule polysaccharide biosynthetic process
  Homolog annotation: Hit_ID=Q6D7A6; Match level="QueryCoverage=95%, HitCoverage=46%, E-value=1e-132, Identity=70%"; Hit description =Tyrosine-protein kinase
  Pfam annotation: Domain name=CbiA; Domain location=166-349; Score= -7.1; E_value=0.00016; Accession=PF01656.14; Description=Cobyrinic acid a,c-diamide synthase
MPKTQQEILRLTRDVQAGQEIYMQLLNKQQELGITKASTVGNVRIVDPAVTQPRPVKPQKTIIVLIVTLLGGLFSTGFVLLKTMLHRGIESPEQLEQQGINVYASIPLSEWQQKSDRETMLSGKRSSNRSYTLLAVGNPADLAIEAVRSLRTSLHFASLEAKNNVLMISGASPSIGKTFVSINLAAVIAQAGQRILVVDADMRKGYAHSLLNCELGLGLSDVLSGQASAQQAIKQTSIENLSFISRGKIPPNPSELLMHNRLTEFLEWAGKEYDIVLVDTPPILAVTDAAIVARNVGTTLLVARYGVNSLKEIEVSIRRFEQNGMEIKGIILNAVENKSGSAYGYYAYEYK

SEQ ID NO: 109730 - protein, 133 aa, Glycine max
  Coding DNA Sequence Number=SeqID_18045
  Homolog annotation: Hit_ID=A7ICR4; Match level="QueryCoverage=100%, HitCoverage=45%, E-value=4e-47, Identity=67%"; Hit description =Putative uncharacterized protein
IRYAELADSAVAVIVSTRGVIDYCFMSDAMKSLPKLDWIRKGTPLPSGTATAALAADPDRVVGGDRAVDEVDVRDWLGGTTRATVSEEALGLGSYGRVLTVLTSGTIGQEDESDEDADDEEALVESWTPRFRR

SEQ ID NO: 109731 - protein, 29 aa, Glycine max
  Coding DNA Sequence Number=SeqID_18046
MQKKQEECRGKVYKAQAQKSLTHREGIAK

SEQ ID NO: 109732 - protein, 711 aa, Glycine max
  Coding DNA Sequence Number=SeqID_18047
  Gene Ontology: Mol. function=hydrolase activity, acting on acid anhydrides, in phosphorus-containing anhydrides; Cellular component =intracellular; Biological process=nucleobase, nucleoside, nucleotide and nucleic acid metabolic process
  Homolog annotation: Hit_ID=Q8FJN1; Match level="QueryCoverage=100%, HitCoverage=99%, E-value=0.0, Identity=69%"; Hit description =Probable ATP-dependent helicase dinG
  Pfam annotation: Domain name=DEAD; Domain location=28-278; Score= -7.5; E_value=0.00015; Accession=PF00270.20; Description=DEADDEAH box helicase
  Pfam annotation: Domain name=ResIII; Domain location=24-115; Score= -39.5; E_value=0.099; Accession=PF04851.6; Description=Type III restriction enzyme, res subunit
  Pfam module annotation: Pfam domain module=DEAD::ResIII; Domain location=28-278::24-115
MALTAAIKSQIAQWYKALQQQVPDFIPRAPQRQMIAEVAKSLAGDDGRHLAIEAPTGVGKTLSYLIPGIAVSRAEEKRLVISTANVALQDQIFSKDLPLLKKIIPDLTFTAAFGRGRYVCPRNLTALAATDDQQGDLLLYLDEQAVTGSKEEQKFCARLEKDLSSYKWDGLRDHSDVAIDDSLWQRLSTDKANCLAHHCRWYRECPFFVARREIEQADVVVANHALVMAAMENESVLPPAKHLMLVLDEGHHLPEVARDALEMSAEITPGWSSLQLDLFVRLVETIMAQFRPKSPPPLSNPERLKGHCDEMREQLQTLCNALNPLLPRDNQPGEFRFVLGELPPELLTLCARLFKLSDALRGLSEGLLNELGEQTGKADIMRLHKAILQLNRHFGWFESISKLWRLAAMEKASNAPVSKWVTREIRDGQAHLLFHCAGIRVSDQLEKLLWRKIPHVVVTSATLRSLNSFNRLQEMSGLNQKAGDRFVALDSPFNHVDQGKLIIPQMRYEPLLANEAEHIAEMARFFRQQMQAQQHKGVLVLFASGRAMQQFVSLVPELRLSMLVQGDQPRSRLVELHRQRVTAGQSSILVGLQSFAEGLDLKGDLLSQVHIHKIAFPPVDSPVILTEGEWLKSLKRYPFEVQSLPSASFTLIQQVGRLIRSHQCFGEIVIYDRRLLSKTYGSRLLAALPVFPIEQPPVPEVDKPAKRSKKS

SEQ ID NO: 109733 - protein, 28 aa, Glycine max
  Coding DNA Sequence Number=SeqID_18048
MAINQPARQQGAHGLQGLRKVLYLNLST

SEQ ID NO: 109734 - protein, 212 aa, Glycine max
  Coding DNA Sequence Number=SeqID_18049
  Gene Ontology: Mol. function=transporter activity; Cellular component= integral to membrane; Biological process=transport
  Homolog annotation: Hit_ID=A8GCG4; Match level="QueryCoverage=71%, HitCoverage=39%, E-value=8e-53, Identity=67%"; Hit description=Major facilitator superfamily MFS_1 precursor
MGMVLLDGFYSWTLLRFTAGVGCALIWVVVESALLCSGTVRNRGQLLAAYMIIYYLGTVAGQLLVSRVSTELLHVIPWVSALIVCAVLPVVFVQVNAGAATEEASTGRIWSMLRRRSSRLGINGCIISGIVLGSLYGLMPLYLSHQGMSDATVVAGRPSCRPLWSPDGAARAGVRGDSGCDCYAERNGNGTGTVCAGAGWLYALSGGDVLGV

SEQ ID NO: 109735 - protein, 272 aa, Glycine max
  Coding DNA Sequence Number=SeqID_18050
  Gene Ontology: Mol. function=transporter activity; Cellular component= membrane; Biological process=transport
  Homolog annotation: Hit_ID=A8GCG7; Match level="QueryCoverage=99%, HitCoverage=94%, E-value=1e-119, Identity=76%"; Hit description =Formate/nitrite transporter
  Pfam annotation: Domain name=Form_Nir_trans; Domain location=1-269; Score=500.5; E_value=2e-147; Accession=PF01226.8; Description =Formatenitrite transporter
MAKVAEDAGVYKATKHPLTTFFLAITAGVFISIAFVFYITATTGSGTMPYGMAKLIGGICFSLGLMLVVVCGADLFTSTVLIVVAKASGRITWLQLGRHWLNVYVGNLCGALFFVALIWLAGEHMVANGAWGLNVLQTADHKMHHTFIEAVSLGTLANLMVCLAVWMSYSGRSLLDKMVAMILPVAMFVASGFEHSIANMFLIPMAIMIRDFASPEFWQMTGASAAQFPALGIGDFIVNNLIPVTIGNIIGGGLLVGLTYWVIYLRDGESAH

SEQ ID NO: 109736 - protein, 522 aa, Glycine max
  Coding DNA Sequence Number=SeqID_18051
  Gene Ontology: Mol. function=structural constituent of ribosome; Cellular component=ribosome; Biological process=translation
  Homolog annotation: Hit_ID=P0AG69; Match level="QueryCoverage=100%, HitCoverage=100%, E-value=0.0, Identity=82%"; Hit description=30S ribosomal protein S1
  Pfam annotation: Domain name=S1; Domain location=101-171; Score=69.3; E_value=1.3e-17; Accession=PF00575.14; Description=S1 RNA binding domain
  Pfam annotation: Domain name=S1; Domain location=17-87; Score=51.3; E_ value=3.3e-12; Accession=PF00575.14; Description=S1 RNA binding domain
  Pfam annotation: Domain name=S1; Domain location=188-260; Score =116.5; E_value=8e-32; Accession=PF00575.14; Description=S1 RNA binding domain
  Pfam annotation: Domain name=S1; Domain location=273-312; Score=1.0; E_value=0.19; Accession=PF00575.14; Description=S1 RNA binding domain
  Pfam annotation: Domain name=S1; Domain location=325-399; Score=98.8; E_value=1.7e-26; Accession=PF00575.14; Description=S1 RNA binding domain
  Pfam annotation: Domain name=S1; Domain location=412-485; Score=88.4; E_value=2.3e-23; Accession=PF00575.14; Description=S1 RNA binding domain
  Pfam module annotation: Pfam domain module=S1::S1::S1::S1::S1::S1; Domain location=101-171::17-87::188-260::273-312::325-399::412-485
MTESFAQLFEESLKEIETRPGSIVRGVVVAIDKDVVLVDAGLKSESAIPAEQFKNAAGELEIQVGDEVDVALDAVEDGFGETLLSREKAKRHEAWITLEKAYEDAETVTGVINGKVKGGFTVELNGIRAFLPGSLVDVRPVRDTLHLEGKELEFKVIKLDQKRNNVVVSRRAVIESENSAERDQLLENLQEGMEVKGIVKNLTDYGAFVDLGGVDGLLHITDMAWKRVKHPSEIVNVGDEITVKVLKFDRERTRVSLGLKQLGEDPWVAIAKRYPEGTKLTGRVTNLTDYGCFVEIEEGVEGLRRRISLGLKQCKSNPWQQFAETHNKGDRVEGKIKSITDFGIFIGLDGGIDGLVHLSDISWNATGEEAVREYKKGDEIAAVVLQVDAERERISLGVKQLAEDPFNNYITLNKKGAIVTGKVTAVDAKGATVELADGVEGYLRASEASLDRIEDATQVLSVGDDVEAKFTGVDRKNRVVSLSVRAKDQADEKEAINTVNTKQEDGNFSNAMAEAFKAAKGE

SEQ ID NO: 109737 - protein, 484 aa, Glycine max
  Coding DNA Sequence Number=SeqID_18052
  Gene Ontology: Mol. function=transporter activity; Cellular component= integral to membrane; Biological process=ion transport
  Homolog annotation: Hit_ID=A8GCJ4; Match level="QueryCoverage=76%, HitCoverage=98%, E-value=1e-131, Identity=65%"; Hit description =Porin Gram-negative type precursor
  Pfam annotation: Domain name=Porin_1; Domain location=28-376; Score =605.0; E_value=6.9e-179; Accession=PF00267.12; Description=Gram -negative porin
MMKRNILAVVIPALLAAGAANAAEIYNKDGNKLDLYGKVDARHQFSDDSSSDGDKSYVRFGFKGETQITDQLTGYGQWEYNVQANVAESQGTSGSKTRVGFAGLKFADAGSFDYGRNYGVLYDAMSYTDQLPVFGDDTLYQDNDNFMAGRSNGLATYRNSNFFGLVDGLAFAVQYQGKNEGRGPRYDNGDGWGTSLSYDTGMGISAVGAYFSSDRTNQQQLDGNGEKADAYGFGLKYDANNVYLAAFYGESRNLTQYGNNNDGTGATGPDFNFAANKAQAFEVVAQYQFDFGLRPSIAYLQSKGKDLNGATGHGSTFAGGDADLVKYIEIGTYYYFNKNMSTYVDYKINLLDDNDFTRATGTSTDDVVGVGLRLASVASDVNLIAHFAKVHPNGTDSYETGKTPVLTSVKKAEQYLLENETTKNYLSIDGLADFARCTQELLFGKENALISAGRACTAQTPGGTGALRVAADFLATQTNVKRVW

SEQ ID NO: 109738 - protein, 335 aa, Glycine max
  Coding DNA Sequence Number=SeqID_18053
  Gene Ontology: Mol. function=transcription factor activity; Cellular component=integral to membrane; Biological process=regulation of transcription, DNA-dependent
  Homolog annotation: Hit_ID=P25253; Match level="QueryCoverage=43%, HitCoverage=84%, E-value=4e-56, Identity=74%"; Hit description=Outer membrane protein X precursor
  Pfam annotation: Domain name=Ail_Lom; Domain location=2-149; Score =5.1; E_value=2.3e-06; Accession=PF06316.2; Description =Enterobacterial AilLom protein
  Pfam annotation: Domain name=Fe_dep_repress; Domain location=245-305; Score=40.3; E_value=7e-09; Accession=PF01325.10; Description=Iron dependent repressor, N-terminal DNA binding domain
  Pfam module annotation: Pfam domain module=Ail_Lom::Fe_dep_repress; Domain location=2-149::245-305
MAQSTVSAGYAQSDYQGVANKANGFNLKYRYEDGSNPLGWIGSFTYTEKDRTEDGVYNKGQYYGITGGPAYRLNDWASIYGVVGIGYGKYQQNQTAGQSKTDSSDVGFSYGAGMQFNPIQNVALDVGYEQSRIRNVDVGTWIAGVGNSAAPDQIRAGLRGDFFAGQFLKQHQAQGKRRAAKQTQQRLQLKSRFALYGLEAFAAVEAAFHRAHLYLLENGATHMPQGPLKDIEEHVEGFRQVREAHRRELIDDYVELISDLIREFGEARQVDMAARLGVSQPTVAKMLKRLSTTGLVEQVPYRGVPENPPAGNSEGLEHHVSDETLAVFQKFYENR

SEQ ID NO: 109739 - protein, 885 aa, Glycine max
  Coding DNA Sequence Number=SeqID_18054
  Gene Ontology: Mol. function=nucleoside-triphosphatase activity; Cellular component=membrane; Biological process=transport
  Homolog annotation: Hit_ID=P0A9U5; Match level="QueryCoverage=34%, HitCoverage=98%, E-value=1e-164, Identity=66%"; Hit description =Uncharacterized ABC transporter ATP-binding protein ybiT
  Pfam annotation: Domain name=ABC_tran; Domain location=597-798; Score= 145.2; E_value=1.8e-40; Accession=PF00005.18; Description=ABC transporter
  Pfam annotation: Domain name=Histone_HNS; Domain location=431-537; Score=137.6; E_value=3.5e-38; Accession=PF00816.12; Description=H-NS histone family
  Pfam annotation: Domain name=OEP; Domain location=27-213; Score =146.0; E_value=1e-40; Accession=PF02321.9; Description=Outer membrane efflux protein
  Pfam module annotation: Pfam domain module=ABC_tran::Histone _HNS::OEP; Domain location=597-798::431-537::27-213
AAGQTPGALDNELMSSKALPALPKLVAVGIPSTLARRRPDIRQAEANLHAQTANIGVSVANLFPSLSLTGQLGVRNTDASYLDDWSSHFFSVGPALSIPIFQGGRLVSSVKLARAQQASAALDYRQTVLTALQDVENALVSYRADQQQVTALDETTGALQRAFDLASDSYKQGISTFLEVLDAQRQLAQSQAQSTQARMQSALDLVALYKALGGGWEPYQQVTLPDYDVFGKELVMSRETWMTPNPASGPNSSTRTEPFVKARPRHCADCHPRWFAVWLRYRRDLRRTVIHGRRSASHPIYHRAGDQQSAVWRGVWRTGFRHFAAAGVWSVPPGLVFIGTVSYRARIAGDLAAAVRNFPDAVTRYFYGRRGICVVDRQFSYFSAVPGSAGVGGAIFVIRWVPETRHRSLEQIEHYLHDRLSDASVPQARELPLSDLEEILEKLTVVVTERRDEVEAEEAQNREKEEKLSKYREMLLADGIDPNELLGALETGKKRAKRAPRPAKYSYTDENGEEKSWTGQGRTPAAIKKALDAGVLRLASAYPGAEVAHPGRFWHNARCFFLHCVTKVNAVLVSSNITMQFGSKPLFENISVKFGGGNRYGLIGANGSGKSTFMKILGGDLVPTNGNVSLDPNERIGKLRQDQFAFEQYSVLDTVIMGHQELWAVKQERDRIYALPEMSEEEGYKVADLEVAYGEMDGYSAESRAGELLLGVGIPVEQHYGPMSEIAPGWKLRVLLAQALFANPDILLLDEPTNNLDIDTIRWLEQVLNERDSTMIIISHDRHFLNMVCTHMADLDYGELRVYPGNYDEYMTAATQARERLLTDNAKKKAQIADLQSFVSRFSANASKSRQATSRAKQIDKIKLDEVKASSRQNPYIVSSRIKAV

SEQ ID NO: 109740 - protein, 914 aa, Glycine max
  Coding DNA Sequence Number=SeqID_18055
  Gene Ontology: Mol. function=transmembrane receptor activity; Cellular component=integral to membrane; Biological process=signal transduction
  Homolog annotation: Hit_ID=A7MJ45; Match level="QueryCoverage=60%, HitCoverage=100%, E-value=1e-134, Identity=49%"; Hit description =Putative uncharacterized protein
  Pfam annotation: Domain name=CHASE3; Domain location=721-855; Score= -28.5; E_value=0.099; Accession=PF05227.4; Description=CHASE3 domain
  Pfam annotation: Domain name=HAMP; Domain location=555-624; Score =57.5; E_value=4.7e-14; Accession=PF00672.16; Description=HAMP domain
  Pfam annotation: Domain name=MCPsignal; Domain location=655-877; Score=394.2; E_value=2e-115; Accession=PF00015.12; Description =Methyl-accepting chemotaxis protein (MCP) signaling domain
  Pfam annotation: Domain name=TarH; Domain location=403-540; Score =117.8; E_value=3.2e-32; Accession=PF02203.6; Description=Tar ligand binding domain homologue
  Pfam module annotation: Pfam domain module=CHASE3::HAMP::MCPsignal::Ta rH; Domain location=721-855::555-624::655-877::403-540
LDEAKRLVEAGVKELLVISQDTSAYGVDVKHRTGFWNGSPVKTSMVSLCEQLAKLGVWVRLHYVYPYPHVDDVIPLMAEGKILPYLDIPLQHASPRILKLMKRPGAVERTLERIKRWREICPELTLRSTFIVGFPGETEEDFQMLLDFLREARLDRVGCFQYSPVEGATANQLPDQVPDDVKQARFDRFMQLQQQISAERLQEKIGREILVIIDEVDEEGAVGRSMADAPEIDGAVYLNGDRQVKVGEVVRIIVIGAQPVPARFEYGRRSGLFFFYRPRQLFAVSTVFPSALMIAVAARAGLDGAKAPVRQNFAFIRFHHQHPLLAASDLIQLRMLTEVELFKILLVIEGFHPLASYAHMFNKMKIVTAIVVILVVFTAMQAISGSLFFSSLRAGQHNFTASNQLSHQQRELGDGWQTLVKTRVTINRVAIRILKNQTDEQSLAAINKLLLAAGASLEAAQQHFNQYRSYPRIDGQSASTADLIDKKFKAFAALLQQSAVFLKANNYAAYGNLDAQQAQDELEQAYQQWRDENMQLINQRSLQNDSNYQQVLIMIAVIALVVVLMVAAVWTLVRRVLLAPMQQVQQQIERFAEGDLSASLQVAGRSEMAAIAASLNHMQQALLGTINNVRDSADAIFGSASAIANGNNDLSARTEQQAASLEETAASMEQLTATVKQNADNARQATQLAKTASDTADKGGNVVEGVVKTMRDIADSSKKIADITSVIDGIAFQTNILALNAAVEAARAGEQGRGFAVVAGEVRNLAQRSAQAAKEIKLLIENSVQRVDLGSQQVSSAGDTMQEIVSAVTRVTDIMGEIASASDEQSRGIDQIGQAVNEMDRVTQQNATLVQESASASASLEQQASRLSSAVARFNTGARAPAAVTERMVKPVVPAPARALPAAVSHGNDNWETF

SEQ ID NO: 109741 - protein, 327 aa, Glycine max
  Coding DNA Sequence Number=SeqID_18056
  Gene Ontology: Mol. function=serine-type D-Ala-D-Ala carboxypeptidase activity; Cellular component=plasma membrane; Biological process =proteolysis
  Homolog annotation: Hit_ID=Q6D3Q8; Match level="QueryCoverage=96%, HitCoverage=78%, E-value=1e-144, Identity=79%"; Hit description =Penicillin-binding protein 6
  Pfam annotation: Domain name=PBP5_C; Domain location=216-307; Score =143.6; E_value=5.4e-40; Accession=PF07943.4; Description=Penicillin -binding protein 5, C-termi
  Pfam annotation: Domain name=Peptidase_S11; Domain location=1-197; Score=338.5; E_value=1.2e-98; Accession=PF00768.11; Description=D -alanyl-D-alanine carboxypeptidase
  Pfam module annotation: Pfam domain module=PBP5_C::Peptidase_S11; Domain location=216-307::1-197
MMTSYVVGQALKSGKITSNDMVTIGQDAWATGNPKLRGSSLMFLKPGDRIPVSELNKGVVIQSGNDACIALADYVAGSQDAFIGLMNNYVKAFGLQNTHFMTVHGLDAEGQYSTARDMAIIGQRLIADVPEEYALNSEKEFTFNNIKQMNRNRLLWSSNLKVDGIKTGHTSGAGNNLVASAVDGDMRLISVVLGAQTDAIRFRESEKLLTWGFRFYETVTPIKADKPFAQQRVWFGENSQVNLGVAKDAAITIPKGQMKNLKASFTLNAPQLEAPLKKNQVVGTIDFQLDGKTIEQRPLVAMEDVPEAGFIVNLRTAGQPVANPPAG

SEQ ID NO: 109742 - protein, 760 aa, Glycine max
  Coding DNA Sequence Number=SeqID_18057
  Gene Ontology: Mol. function=transporter activity; Cellular component= outer membrane-bounded periplasmic space; Biological process=transport
  Homolog annotation: Hit_ID=Q6D3R7; Match level="QueryCoverage=46%, HitCoverage=96%, E-value=1e-161, Identity=75%"; Hit description =Putrescine-binding periplasmic protein
  Pfam annotation: Domain name=ATP-grasp_3; Domain location=18-185; Score=6.7; E_value=1.6e-06; Accession=PF02655.5; Description=ATP -grasp domain
  Pfam annotation: Domain name=CPSase_L_D2; Domain location=20-208; Score=-114.0; E_value=0.0055; Accession=PF02786.8; Description =Carbamoyl-phosphate synthase L chain, ATP binding domain
  Pfam annotation: Domain name=Dala_Dala_lig_C; Domain location=20-208; Score=-76.3; E_value=0.0001; Accession=PF07478.4; Description=D-ala D- ala ligase C-terminus
  Pfam annotation: Domain name=GSH-S_ATP; Domain location=20-198; Score= 5.1; E_value=1.6e-10; Accession=PF02955.7; Description=Prokaryotic glutathione synthetase, ATP-binding domain
  Pfam annotation: Domain name=RimK; Domain location=18-207; Score =362.6; E_value=6.6e-106; Accession=PF08443.2; Description=RimK-like ATP-grasp domain
  Pfam annotation: Domain name=SBP_bac_1; Domain location=391-682; Score=99.2; E_value=1.3e-26; Accession=PF01547.16; Description =Bacterial extracellular solute-binding protein
  Pfam module annotation: Pfam domain module=ATP-grasp_3::CPSase_L _D2::Dala_Dala_lig_C::GSH-S_ATP::RimK::SBP_bac_1; Domain location=18 -185::20-208::20-208::20-198::18-207::391-682
FEMLGSYPLNESVAITRARDKLRSLQLLAREGIDMPVTGFASSPDDTQDVIAMVGGAPLVVKLVEGTQGIGVVLAETRQAAESVIDAFRGLNAHILVQEFIKEARGRDIRCLVIGDEVVAAIEREAKEGDFRSNLHRGGSARAVTITDQEREIAVKAATTLGLAVAGVDILRANRGPLVMEVNASPGLEGIEGSTGLDIAAMMIRWIEQHACPGAYLFTPQDTTMDSLVVPDIDMLRRWLDQQNITWFECDACQALHLPHMQNFDGVFDAKIDLVDNVILFSALAEVKPTALIPLVGELSQINASSLTVKAFIDIQDDNLPKLIVCQSISVSAGITLGQFTHFMKQSEEGISMVIMEAFANHLLMMGEDEERIRGAILAGLSDTCNYGAAIGVLMAAAVGAQAEDKTLHVYNWSDYISADTVPNFEKQTGIKVVYDVFDSNEVLEGKLMAGSTGYDVVVPSSSFLARQLQSGVFQELDKSKLPNYKNLDPDLMAKVAQHDPGNKYAIPYLWGTTGIGYNIDKVKAALGADAPVNSWDLVLKPENLEKLKSCGVSFLDAPEEIFATVLNYLGKDPNSSDAKDYTGAATDLLLKLRPNIRYFHSSQYINDLANGNICVAIGWSGDILQAKDRAVKANNGVHLGYSVPKEGALAFFDMMAIPKDAKNLDAAYQWLNYIMDPKVIADVSNKMNYANGNKASLPLINADVRNNPGIFPTPEAMAKLFVLKVQDPKLDRARTRAWTKVKSAAGCAALSRLAPETCE

SEQ ID NO: 109743 - protein, 109 aa, Glycine max
  Coding DNA Sequence Number=SeqID_18058
VDSRGSHPYNAQWNAPGLLHDKHTLRSSRILGEMEVDEPWLGLWLPLNYQVGMGASDVRHWKCDRQTLWLILGMAFVDNWAVGKEKTHIDPFTGKDQIRKALKVPLKLP

SEQ ID NO: 109744 - protein, 67 aa, Glycine max
  Coding DNA Sequence Number=SeqID_18059
MGDQEEIQEQMKADMSALKEQMASMMDAMLGMRQLMEDNVATAAAKENYHYRVLNGQFTTLFEFISF

SEQ ID NO: 109745 - protein, 65 aa, Glycine max
  Coding DNA Sequence Number=SeqID_18060
MAKFDPDIVLEFYANAWPTEEGWIPFDADALSQFLGDPLVLEEGQECEFSQRRNRADGFDKEAIA

SEQ ID NO: 109746 - protein, 186 aa, Glycine max
  Coding DNA Sequence Number=SeqID_18061
  Subcellular localization annotation: CTP_CleavageSite=34; ConfidenceScore=5.20e-01
MASFNQMQSQFQSQMQSQGLALPPEPLVGPSGPRVSTKESYVDPSRNDPETGDSERCGLYIEANSDCLVALGRVYEGSTVVHNTRLLPGKVKAIHTFFAWPTHLVKPLSQQAVVPLAKPPEKPDLEVDDPLYLMTLTIPELFLRPYQVTWDAAVFKVFNPDFLLYIKHEDLFEIAHGGQCLFLSVL

SEQ ID NO: 109747 - protein, 42 aa, Glycine max
  Coding DNA Sequence Number=SeqID_18062
GQAYIPIVRLMQSYPPRALDRRLQEDWAKDAREGPKVLMSLK

SEQ ID NO: 109748 - protein, 128 aa, Glycine max
  Coding DNA Sequence Number=SeqID_18063
MASLMTRGDQYGHLHPLSKTRCLSTETTLVSLHHPETVSPMTRRDQYGNLLPLSKTRCLSTETTLVSLHHPETASLMTRRDQYGHLLLLSKTRCLSTETTLVSLRHPETASPMTRRDQYGHLFPLSKT

SEQ ID NO: 109749 - protein, 55 aa, Glycine max
  Coding DNA Sequence Number=SeqID_18064
MWIPYRRGGSLHLVVSEQGVLAGRNDRAIADALQALAQAIGNPNRGEAGGVVEYQ

SEQ ID NO: 109750 - protein, 20 aa, Glycine max
  Coding DNA Sequence Number=SeqID_18065
DWARAAKEGPRVLMNLRVDF

SEQ ID NO: 109751 - protein, 97 aa, Glycine max
  Coding DNA Sequence Number=SeqID_18066
MSDKCAGDKILAPFHFRSSELSETDSVPFIIQEQQAEWVNTQRQILHPLSFRNNKLGGKRAETDFVPFIIQEQQAEWVNAQRQILRPLSFRNSKLSG

SEQ ID NO: 109752 - protein, 139 aa, Glycine max
  Coding DNA Sequence Number=SeqID_18067
  Subcellular localization annotation: CTP_CleavageSite=41; ConfidenceScore=5.16e-01
MAEPSKKRKGSSSTAAAIAHRRHEPSGAPTAPIHPSLSSPRSSTLFSSDDQRLRQGTPFEGTIVDDWKFDYSSHDARRMVCNDQAEMIGRLLTGPLTFDNRIKHYIIVRIFLPRSSNLAQASEEDLILMWAFLTGCQID

SEQ ID NO: 109753 - protein, 42 aa, Glycine max
  Coding DNA Sequence Number=SeqID_18068
MVPARHWACRLWMTKGAEDDGQYDRDCGAADKSEALAPTYPQ

SEQ ID NO: 109754 - protein, 32 aa, Glycine max
  Coding DNA Sequence Number=SeqID_18069
MRNGLRIVIRKEKEINLLTKDYKSDENISQED

SEQ ID NO: 109755 - protein, 132 aa, Glycine max
  Coding DNA Sequence Number=SeqID_18070
STSRGSHLRANAPLPYPQLVTLFVRHFQISLDDEPFVQVKRSFAIGAGAVTSFGYRKDHNGQWLKKDALPPQDKHTPSPPPQRDDSALMTEVLSELRGLRTYVGMDIRLMQLEEDVGYIHQSFDLPPPPPPS

SEQ ID NO: 109756 - protein, 85 aa, Glycine max
  Coding DNA Sequence Number=SeqID_18071
MKIKEITEERKEGFPIKDRKEVKKEKKQFSINEGKRAKILQARLPLKIIFLLAIFHPTWTKRKRPKHPTSSPKTLPSRNSYWSVI

SEQ ID NO: 109757 - protein, 102 aa, Glycine max
  Coding DNA Sequence Number=SeqID_18072
HLTDTSMRAGNSDIYGFLEPQSIQRSGQSQFESESYIKTWMQSSKCDVYLGAYLNGPENYHKGIINSLNQRLLLGGLSSSVINKKEVLSAATMSCTGCPPSF

SEQ ID NO: 109758 - protein, 265 aa, Glycine max
  Coding DNA Sequence Number=SeqID_18073
  Gene Ontology: Mol. function=nuclease activity; Cellular component =intracellular; Biological process=DNA repair
  Homolog annotation: Hit_ID=A7QDX6; Match level="QueryCoverage=58%, HitCoverage=28%, E-value=3e-57, Identity=71%"; Hit description =Chromosome chr4 scaffold_83, whole genome shotgun sequence
  Pfam annotation: Domain name=Exo_endo_phos; Domain location=1-253; Score=-4.6; E_value=0.0068; Accession=PF03372.14; Description =EndonucleaseExonucleasephosphatase family
MKIVSYNVNGLRQRIAQFGSLRNLLNSFDADIICFQETKLRRQEVTADLVMADGYESFFSCTRTSQKGRTGYSGVITFCRVKSAFSSNEVVLPLAAEEGFTGLLGNSQTSNDKLPFLMEDLEEFSKDELLSLDSEGRCIITDHTHFGEYSLYMPFICPREEGGGGGGAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 109759 - protein, 395 aa, Glycine max
  Coding DNA Sequence Number=SeqID_18074
  Gene Ontology: Mol. function=kinase activity
  Homolog annotation: Hit_ID=Q6UC87; Match level="QueryCoverage=86%, HitCoverage=100%, E-value=1e-120, Identity=66%"; Hit description =Putative calcium-dependent protein kinase CPK1 adapter protein 2
MAADEDMSLKSNLSQSNETWKQEMERSQSQVDVLQARIMEVKAQIQGSKEDAKKELEVLWRRVKTTSTLLTYLKSKSRIMAVPHLAHTSCGIKKLDGVGLVDKDGIPLSGWSRNVDLSSFDDPDEESWIGINRQHGSLDEQDAVYIGEILKSVQMVTDVMESLVKRVLLAESETTIEKEKVILGQEEIMQKSAQLENMSMKLEEMERFALGTNGILNDMRQRVADLVEETTRQRQRAAENEEELSRVKREFESLKSYVSSLITVRETLLSSEKQFQTIEKLFERLVGKTTQLEGEKMQKEAEVQKLMEENVRLSALLDKKEAQLLALNEQCKMMALSASNMISDDKSNMASPPLSLVAGFVCKVAFAAYIFGSVSMKYGRSERNKDELSFNHLES

SEQ ID NO: 109760 - protein, 658 aa, Glycine max
  Coding DNA Sequence Number=SeqID_18075
  Gene Ontology: Mol. function=DNA binding; Cellular component=nucleus; Biological process=regulation of transcription, DNA-dependent
  Homolog annotation: Hit_ID=A7PT68; Match level="QueryCoverage=88%, HitCoverage=77%, E-value=0.0, Identity=60%"; Hit description =Chromosome chr8 scaffold_29, whole genome shotgun sequence
  Pfam annotation: Domain name=Myb_DNA-binding; Domain location=52-97; Score=30.3; E_value=7e-06; Accession=PF00249.22; Description=Myb -like DNA-binding domain
MEVEVPISLDSNNQLQPETVVSVQIGDPGVSLSVANAVNPQQQATKKPTRQWAAWTRQEEESFFTALRQVGKNFEKITSRVQSKNKDQVRHYYYRLVRRMNKLLGPGLCLDAKNSKDTNAAMLRWCGCDCTLVWSLLEKYSCKASKLHLKPRRFKIFLEALEHQLLKDRKKNVRKRPLQGGNCLPSAPTTVSNQSRASGNDAYAVKLVLVDSQNILKLGPSKPSTKRNVNMGVNRSNTKGDSNTMKPTRQRKKSGTISTAAYRKWEKAAIAGVSLVADAAEHLERAATVKGIEQDQENPGEKCSDPADYVLPSLPTCPQNQFVDNNVNNIMKLKLQLFPIDEPTRRALEMDKHNPHLELTLSTRKKISSILEHLNRKWGNSSIAAGEVMLFPYGIQRENLVNCPRWTQESTLSAADIYAMIGSPPIFRLRYGWFSNTELGLLNMQVPVASGSMLRQYKSTVDNAKDQIVNSVSFPTPLTNTHSMELSEDCRTSMNRNRTLITASTEESRDPTANTLWHGKDVRDGAVSTQLEDMDELKISSGAGLSAGEWADSLTNISVGDLLSGVSQDLDNCIDPPIAENFHDIQQIPFSSDSFDAAIAAHISRHQDRMGQSSLASHMSSIWDAEETCDAFLFKKDPILHEDHPRLSPVASLESEKK

SEQ ID NO: 109761 - protein, 644 aa, Glycine max
  Coding DNA Sequence Number=SeqID_18076
  Gene Ontology: Mol. function=binding
  Homolog annotation: Hit_ID=A7QDX4; Match level="QueryCoverage=98%, HitCoverage=99%, E-value=0.0, Identity=65%"; Hit description =Chromosome chr4 scaffold_83, whole genome shotgun sequence
  Pfam annotation: Domain name=Arm; Domain location=179-219; Score =27.6; E_value=4.6e-05; Accession=PF00514.14; Description =Armadillobeta-catenin-like repeat
  Pfam annotation: Domain name=Arm; Domain location=220-260; Score =21.3; E_value=0.0037; Accession=PF00514.14; Description =Armadillobeta-catenin-like repeat
  Pfam annotation: Domain name=Arm; Domain location=411-451; Score=2.6; E_value=5.2; Accession=PF00514.14; Description=Armadillobeta-catenin -like repeat
  Pfam annotation: Domain name=Arm; Domain location=467-502; Score=5.8; E_value=2; Accession=PF00514.14; Description=Armadillobeta-catenin -like repeat
  Pfam annotation: Domain name=Arm; Domain location=545-585; Score =11.4; E_value=0.4; Accession=PF00514.14; Description=Armadillobeta -catenin-like repeat
  Pfam module annotation: Pfam domain module=Arm::Arm::Arm::Arm::Arm; Domain location=179-219::220-260::411-451::467-502::545-585
MADIVKQLLAKPIQLADQVAKAAEEASSSFKQECLELKSKADKLAALLRLAARASSDLYERPTRRIIADTELVLDKALSLTLKCRANGLMKRVFSIIPTAAFRKMSSQLENSIGDVSWLLRVSTPAEERADTEYLGLPPIAANEPILGLIWEQVAVLHTGSLDDRSDAAASLVSLARDNDRYGKLIIEEGGVGPLLKLIKEGKKEGQENAARAIGLLGRDLESVELMIHAGVCSVFAKVLKEGPMKVQAVVAWAVSELAAKYPKCQDLFAQHNIVRLLVSHLAFETVQEHSKYAIVSNKPTSIHAVVMANSNNSNGNGARKESEDEEKQMQSRMQHPLGDRSTNQMHRVVTSTMAMHAANKKQQQVNGGNGKQSYSYSGINMKGREIEDPDNKAYMKAMAARALRQLAKGNAAICRSITESRALLCLAILLEKGTEDVMYNSALAVKEITAVAEKDAELRRSAFKPNSPACKAVVDQVLKIIEKEDRKLLIPCVKAIGNLARTFRATETRIIGPLVRLLDEREAEVSREAAISLTKLACSENYLHLDHSKAIISASGAKHLVQLVYLGEQTVQISALVLLSYIALHVPDSEELARAEVLGVLEWASKQPNLTQDQTLEALLQDSKGRLELYQSRGSRGFQKLHH

SEQ ID NO: 109762 - protein, 22 aa, Glycine max
  Coding DNA Sequence Number=SeqID_18077
MAGFAIGFCTSTFDRKKLPYLR

SEQ ID NO: 109763 - protein, 199 aa, Glycine max
  Coding DNA Sequence Number=SeqID_18078
  Homolog annotation: Hit_ID=Q5XM22; Match level="QueryCoverage=54%, HitCoverage=75%, E-value=2e-21, Identity=43%"; Hit description =Resistance-like protein HAAS-2
  Pfam annotation: Domain name=DUF1723; Domain location=30-66; Score =11.7; E_value=0.021; Accession=PF08330.1; Description=Protein of unknown function (DUF1723)
MTKFGRPAPKIEGLVAAIGLSHLIACSLDTSDRGLIFLLPVGEVTITLDDVASLLHLPIVGAFHSFEQLHVDNAVNMLVELLELRDVYQTKIEACHWIVAARAYLLHLLRFTLFANKSVTHVYMVFLDALRDLRQSRTYAWGATALVHMYDNLNEASKSTTRQLAGYITLLQCWIYKHFPSIGSALFAEDYVCKFVRTW

SEQ ID NO: 109764 - protein, 257 aa, Glycine max
  Coding DNA Sequence Number=SeqID_18079
  Gene Ontology: Mol. function=protein binding; Cellular component =cytoskeleton; Biological process=ubiquitin-dependent protein catabolic process
  Homolog annotation: Hit_ID=Q155U2; Match level="QueryCoverage=90%, HitCoverage=100%, E-value=1e-35, Identity=78%"; Hit description=SKP1- like b
  Pfam annotation: Domain name=Skp1; Domain location=165-257; Score =115.6; E_value=1.5e-31; Accession=PF01466.10; Description=Skp1 family, dimerisation domain
  Pfam annotation: Domain name=Skp1_POZ; Domain location=29-89; Score =114.1; E_value=4.3e-31; Accession=PF03931.6; Description=Skp1 family, tetramerisation domain
  Pfam module annotation: Pfam domain module=Skp1::Skp1_POZ; Domain location=165-257::29-89
GHGGVVHDADSDGGFVVDFEKQIGMASTKKITLKSSDGEAFEVEEAVAVESQTIKHMIEDNCADSGIPLPNVTSKILAKVIEYCKKHVEANCADEKPSEDELKAWDADFVKVDQATLFDLILGYVLSWPEEWSCGTARIIWDKCGPSVTLEARNFTDMDAGHGHVDTYDVQNIKRSMDVMSTSDIDTDMCRTPDMGRSWSAANYLNIKSLLDLTCQTVADMIKGKTPEEIRKTFNIKNDFTPEEEEEVRRENQWAFE

SEQ ID NO: 109765 - protein, 515 aa, Glycine max
  Coding DNA Sequence Number=SeqID_18080
  Gene Ontology: Mol. function=aspartic-type endopeptidase activity; Cellular component=anchored to membrane; Biological process =proteolysis
  Homolog annotation: Hit_ID=Q8VYV9; Match level="QueryCoverage=83%, HitCoverage=82%, E-value=1e-142, Identity=58%"; Hit description =Putative chloroplast nucleoid DNA-binding protein
  Pfam annotation: Domain name=Asp; Domain location=105-451; Score= -88.2; E_value=2.2e-08; Accession=PF00026.14; Description=Eukaryotic aspartyl protease
MACNHGHGCVMLVYLVVLSLSASQSCYGLGTFGFDIHHRFSDPVKGMLGIDDVPQKGTPQYYAVMAHRDRIFRGRKLAGADHHAPLTFTAGNVTYRIASSGFLHFANVSVGTPPLWFLVALDTGSDLFWLPCDCISCVQSGLKTRTGKILKFNTYDPDKSSTSNKVSCNNNTFCRQRQQCPSAGSTCRYQIDYLSNDTSSRGFVVEDVLHLITDDVQTKDADTRIAFGCGQVQTGVFLNGAAPNGLFGLGLDNISVPSILAKEGLISNSFSMCFGPDGAGRITFGDTGSPDQRKTPFNVRKLHPTYNITITQIVVEDSVADLEFHAIFDSGTSFTYINDPAYTRLGEMYNSKVKANRHSSQSPDSNIPFEYCYDISINQTIEVPFLNLTMKGGDDYYVMDPIVQVFSEEEGDLLCLGIQKSDSVNIIGQNFMIGYKIVFDRDNMNLGWKETNCSDDVLSNTSPINTPSPSPAVSPAIAVNPVATSNPSINPPNRSFRIKPTFTFVVVLLPLIAIF

SEQ ID NO: 109766 - protein, 453 aa, Glycine max
  Coding DNA Sequence Number=SeqID_18081
  Gene Ontology: Mol. function=ammonium transmembrane transporter activity; Cellular component=integral to membrane; Biological process=transport
  Homolog annotation: Hit_ID=A7PUI6; Match level="QueryCoverage=88%, HitCoverage=91%, E-value=1e-140, Identity=58%"; Hit description =Chromosome chr7 scaffold_31, whole genome shotgun sequence
  Pfam annotation: Domain name=Ammonium_transp; Domain location=30-414; Score=112.2; E_value=1.6e-30; Accession=PF00909.12; Description =Ammonium Transporter Family
MSSSSYDIPLPSSLLPSEASPEWNNKADNAWQLTAATLVGLQSVPGLVILYGSMVKRKWAVNSAFMALYAFACVLICWVSWAHRMAFGARLLPFVGAPNHALAEKFLLAKSTIGYFPMADFVFYQFAFAAITLVLLAGSLLGRMNFYAWMMFVPLWLTLSYTVGAFSIWDDDGFLQGKIIDYAGGICPTPWLEESSSNIDLIWHAGFNGGAPFQVGEIASLAIYNTHLCTATSLLVWLTLDMIVYTKSSVIGAVQGMITGLVCITPGAGLVDPWAAVLMGALSGSIPWYTMMVLHKKSAFFQSVDDTLGVFHTHAVAGLLGGILSGVFAKPDLLRIMYQDTNYCPGLFYTFFKGEVDHGFRQIWYQLLGAGFIIVWNVVITSLICILISRIVDLRMKEEDLEVGDDAAHGEEAYALWGDGERMRIPLRLHIGPTIPSLCRKRFSIPLTRKEGE

SEQ ID NO: 109767 - protein, 677 aa, Glycine max
  Coding DNA Sequence Number=SeqID_18082
  Gene Ontology: Mol. function=strictosidine synthase activity; Cellular component=endoplasmic reticulum; Biological process =biosynthetic process
  Homolog annotation: Hit_ID=A7R3C9; Match level="QueryCoverage=94%, HitCoverage=95%, E-value=1e-107, Identity=52%"; Hit description =Chromosome undetermined scaffold_503, whole genome shotgun sequence
  Pfam annotation: Domain name=SGL; Domain location=28-271; Score= -72.6; E_value=1.6e-05; Accession=PF08450.3; Description=SMP -30GluconolaconaseLRE-like region
  Pfam annotation: Domain name=Str_synth; Domain location=127-214; Score=143.4; E_value=6.2e-40; Accession=PF03088.7; Description =Strictosidine synthase
  Pfam annotation: Domain name=Str_synth; Domain location=467-554; Score=133.3; E_value=7e-37; Accession=PF03088.7; Description =Strictosidine synthase
  Pfam module annotation: Pfam domain module=SGL::Str_synth::Str_synth; Domain location=28-271::127-214::467-554
MVALVSVLYWLGSLGPAHEWSRPIGSEVVAVGEVSGPEDLAYDKRRRVIYTGCEDGWIKRVTVTDSVADTVVKNWVNTGGRPLGLALEKSGELMVADAFKGLLRVTRKKKVEVLADEVEGLKFNLTDGVDVAEDGTIYFTDATYKHSLDDYYNDIIEGKPHGRFMNYNPETKKVTVLARNLYFPNGVVVSHDQHFVIYCETIMKRCRKYYIEGPKKGRIGEFCRDLPGMPDNIHYVGQGQYYIAMATSLTPEWDLLLRYPFIQKVAAMVTKYVLQPKENGGVLVVDLEGKPTAHYYDSELSLISTTTTLLMSRLWFSTPFFVIILPVAVAALFFRLEPFDPGFLPVQLGRSTVAVPASNGHVRVGSEAMGEGHLEGPEDLAYDAAARVVYTGCEDGWIKRVTVNDSVLDSAVEDWVNTGGRPLGLTLKPNGELIVADAEKGLLRVSSEREIELLVDEYEGLKFKLTDGVDVADDGTIYFTDASHKYPVKDAVLDILEGKPNGRFFSYNPATKKTTLLAKDLYFANGVAVSADQQFVVFCESVLMICEKYYVQGPKKGTIEKFCDLPGMPDNIHYDGQGHYLIAMVTALTPELELAYRYPFIRKTFAIVTKYVGSLPISKNGGVLVVDLEGKPTAHYYDPKLSLTSAIKIGNHIYGGSIFYPFVTRFDIEKYPALPTV

SEQ ID NO: 109768 - protein, 438 aa, Glycine max
  Coding DNA Sequence Number=SeqID_18083
  Gene Ontology: Mol. function=pancreatic ribonuclease activity; Cellular component=mitochondrion; Biological process=mismatch repair
  Homolog annotation: Hit_ID=A7R1D0; Match level="QueryCoverage=92%, HitCoverage=100%, E-value=1e-105, Identity=53%"; Hit description =Chromosome undetermined scaffold_345, whole genome shotgun sequence
  Pfam annotation: Domain name=DUF292; Domain location=32-153; Score =239.8; E_value=6e-69; Accession=PF03398.5; Description=Eukaryotic protein of unknown function, DUF292
  Subcellular localization annotation: CTP_CleavageSite=29; ConfidenceScore=5.31e-01
MTVASTKRLFKITLSLLRLGFNSSKCKTAAKMAVARIKLLRNKREVVVRQMRRDIALLLQSGQDATARIRVEHVMREQNVLAANEFIELFCELVVARLAIISKQKECPADLKEGIASLIFAAPRCSEIPELVALKNIFEKKYGKDFVSAAVDLRPSCGVNRQLIEKLSVRTPPGEVKLKVLKEIAKEHHIDWDTTDSEKELLKPPEELIVGPSAFVSASSLPVKPSTVMSVDSNKPATRLSRGGKPDAEHYKDSKSAAEAAAEAAKQAIAAAEVAAYMAMKDYNNEAPQPYAYNDKLYNSGVNSGTFQSNNPAKCTLNMTPKSLTEEKMYRSQSLPRSDHMNNEEDALPNQYGGNDYRRHSYHPASAHSDIKFDESSCDEEIEAEEPPPVTMPPNRLPPPVPSSLAKQESHIRVHPKLPDYDELAARFDALKFKKSQS

SEQ ID NO: 109769 - protein, 262 aa, Glycine max
  Coding DNA Sequence Number=SeqID_18084
  Gene Ontology: Mol. function=oxidoreductase activity, acting on the CH-OH group of donors, NAD or NADP as acceptor; Cellular component =mitochondrion; Biological process=tricarboxylic acid cycle
  Homolog annotation: Hit_ID=A7R131; Match level="QueryCoverage=56%, HitCoverage=52%, E-value=2e-66, Identity=68%"; Hit description =Chromosome undetermined scaffold_334, whole genome shotgun sequence
  Pfam annotation: Domain name=Iso_dh; Domain location=108-262; Score= -147.7; E_value=5.3e-06; Accession=PF00180.11; Description =Isocitrateisopropylmalate dehydrogen
MAEACGNPLNFHNARKIRDIVVLQVETAAIVNKNSLVGDPPTDVVPPLVFKKKNKDKLKRKHHKHQKSFEDSSDHHRSNPMVCAKTYSPKGSERNGTKIPPSPKAPPPLAADPGPIRDVMEAMHAPVYFEKFEVHGHMKAVPPEVLDSIRKNKVCLKGGLVTPMGGGVSSLNVQLRKELDLYASLVNCFNLPGLPTRHDNVDIVVIRENTEGEYSGLEHEVVPGVVESLKVATKYPGIKYNEIIVDNCCMQLVSKPEQFDVM

SEQ ID NO: 109770 - protein, 427 aa, Glycine max
  Coding DNA Sequence Number=SeqID_18085
  Gene Ontology: Mol. function=phosphoserine transaminase activity; Cellular component=chloroplast; Biological process=amino acid biosynthetic process
  Homolog annotation: Hit_ID=Q96255; Match level="QueryCoverage=91%, HitCoverage=89%, E-value=1e-170, Identity=76%"; Hit description =Phosphoserine aminotransferase, chloroplast precursor
  Pfam annotation: Domain name=Aminotran_5; Domain location=68-415; Score=126.1; E_value=1e-34; Accession=PF00266.10; Description =Aminotransferase class-V
  Subcellular localization annotation: CTP_CleavageSite=59; ConfidenceScore=5.51e-01
MSSISTSPHSHLLLPQNQNHFLSESGTHASFTPSPRPFRPISIKCTSTPAQVQTHDPLPAQTRAQERVFNFAAGPATLPETVLRRAQSELHVWRGSGMSVMEMSHRGKEFKSIIEKAESDLRTLLQIPSEYSVLFLQGGATTQFAAVPLNLCSPADAVDYIITGSWSDKAFKEAQKFSKPTIIWSGKPEKYTKVPSFEALQQNPDAKYLHICANETIHGVEYKNYPTPKNPNAVLVADMSSNFCSKPVDVSKFGVIYAGAQKNVGPSGVTIVIIRNDLIGHAQESTPIMLDYKIHAENNSLYNTPPCYGIYMCGLVFEDLLEQGGLGEVEKKNVKKAEVLYNTIDGSNGFYKCPVEKSVRSLMNVPFTLEKPELEGEFIKEAAKENMVQLKGHRSVGGMRASIYNAMPLAGVQKLVAFMKDFQARHA

SEQ ID NO: 109771 - protein, 31 aa, Glycine max
  Coding DNA Sequence Number=SeqID_18086
MEDLATLVEESEGSDTIAKFTMRPNSNSNNY

SEQ ID NO: 109772 - protein, 99 aa, Glycine max
  Coding DNA Sequence Number=SeqID_18087
MSLLPKTEQNDVPVVDIDSDDDGGAAVAPAKNDASSHKTPSPQVELVQQETPSSSSSLSASDGLSRSFWKAGDYVVGPSSKPAPFQAIAELVDNAVDEV

SEQ ID NO: 109773 - protein, 275 aa, Glycine max
  Coding DNA Sequence Number=SeqID_18088
  Gene Ontology: Mol. function=identical protein binding; Cellular component=endoplasmic reticulum membrane; Biological process=protein modification process
  Homolog annotation: Hit_ID=Q7XCL2; Match level="QueryCoverage=56%, HitCoverage=27%, E-value=3e-52, Identity=63%"; Hit description =Ubiquitin family protein, expressed
MTENQLRWFGKAIGSNIEESLEADHTVHLVRGSALANPTGGTNTSSTDTNTNTNIPTDNARVAGANEGEGLGGLGFGASLFPGLGVNGTGGNGLFGEGFPDLEQMQQPFISNPNLVREIMNSPTMQNLINNPEIVRNLIMNNPQMQELMDRNPELAHILNDPSTLRQTLEATRNPEIMREMMRNTDRAMSNIESSPEGFNMLRRMYENIQEPFLNATTMAGNTGNNNAAVSGTHGGHARDPSTNPSTTSSEATAGSPLPNTNPLPNPWSSTGSKF

SEQ ID NO: 109774 - protein, 42 aa, Glycine max
  Coding DNA Sequence Number=SeqID_18089
MWDQHMLKGALKPGVFTPKADTPKSPSEPLPPDSVLSRRTCD

SEQ ID NO: 109775 - protein, 159 aa, Glycine max
  Coding DNA Sequence Number=SeqID_18090
MVIVVPGKFLEDSSEATNSMATCLGRAYASRASLGGVWIWWGGASGPDMELRSMSSDHGRHCAKTWRRDEEMHDMKGRGTPVSDQRLELRDSVTGGAEFGGVAMFDFNKAVHHNLDLVGVGGHNLDLVRDLGWLVVVQHEGDGEVVREGERAGWHKGGI

SEQ ID NO: 109776 - protein, 98 aa, Glycine max
  Coding DNA Sequence Number=SeqID_18091
MEGKASSCISNLLLEMSFRNVFWKLKRDAGSTIGGAGSNWLLGNLKTCLGLTQFVCKELVSLNPRFLFKSKLDLRPRLTDTLRHFGSSKGLVSQEKKG

SEQ ID NO: 109777 - protein, 302 aa, Glycine max
  Coding DNA Sequence Number=SeqID_18092
  Gene Ontology: Mol. function=oxidoreductase activity; Cellular component=endoplasmic reticulum membrane; Biological process =electron transport
  Homolog annotation: Hit_ID=A7QE52; Match level="QueryCoverage=32%, HitCoverage=20%, E-value=1e-38, Identity=73%"; Hit description =Chromosome chr4 scaffold_83, whole genome shotgun sequence
MANIVNAIWRKAVKDVDIKGYLIPKDWCVVASLTSVHMDGMNYENPFEFNPGRWENIGTGTNNNCFTPFGGGQRLCPGIELSRLELSIFLHHLVTTYRVGGRQEVNLVVNWARWGKGGRGLEEGDKYGEEGLDDGKKVFGMVDRVKGQVWVVRSSGKGPRGHGFSKAHGKSGIVHGNWPKGFQSLHAQNNEGATNGAVAYHDPQGRGHKEERPKNLATWKGIRDIINGRSAWGGIRGFQNWPGGGTMDSIRLIIRDEEQDLGLAMVDDLKEVDDDMDGPEKMKYKKHDGNSESCPRGVSGHI

SEQ ID NO: 109778 - protein, 389 aa, Glycine max
  Coding DNA Sequence Number=SeqID_18093
  Homolog annotation: Hit_ID=Q8H767; Match level="QueryCoverage=86%, HitCoverage=93%, E-value=1e-122, Identity=63%"; Hit description =Lysine ketoglutarate reductase trans-splicing related 1
  Pfam annotation: Domain name=DUF707; Domain location=44-367; Score =422.7; E_value=5.2e-124; Accession=PF05212.3; Description=Protein of unknown function (DUF707)
MSIMHALLNDMYSCAGWSNLFPHAFVYICNYQIDKKSSSWGEPKVYPTTSGNLKGLPQGIVHANSDLELKPSWSTSSSRSKAVFSNRNLLAVPVGIKQKHNVDVMVQKFLQENFTIILFHYDGEVDGWWNLDWSSNVIQIVARNQTKWWFAKRFLHPNIVSIYDFIFLWDEDLGVEHFSPSRYIEIIKQEGLEISQPALDPHSTEIHHRITIRSITKKFHRRVYERRKRRARCSDSSEEPPCTGFVEGMAPVFSRSAWYCTWHLIQNDLVHGWGLDLKLGYCAQGRRTKKVGVVDSEYVFHKGIQTLGGSGHRMTKVSKLQKTTMKQGGVGIDVRTEIRRQSTREFEIFQERWNQAISEDKTWVDPFKSDQRRIRKQRDTQRLSKHFIS

SEQ ID NO: 109779 - protein, 29 aa, Glycine max
  Coding DNA Sequence Number=SeqID_18094
MVMCKNLKRVRVANELGAGNGKGAKFATM

SEQ ID NO: 109780 - protein, 42 aa, Glycine max
  Coding DNA Sequence Number=SeqID_18095
FGKLDIEELKKVSAYMAVTTKTVVAAEWQAFVLFGGNRDSML

SEQ ID NO: 109781 - protein, 230 aa, Glycine max
  Coding DNA Sequence Number=SeqID_18096
  Gene Ontology: Mol. function=protein binding; Cellular component =cytoplasm; Biological process=regulation of intermediate filament polymerization and/or depolymerization
  Homolog annotation: Hit_ID=A7PCS2; Match level="QueryCoverage=91%, HitCoverage=61%, E-value=2e-38, Identity=46%"; Hit description =Chromosome chr17 scaffold_12, whole genome shotgun sequence
  Pfam annotation: Domain name=LRR_1; Domain location=121-139; Score =9.3; E_value=5.8; Accession=PF00560.24; Description=Leucine Rich Repeat
  Pfam annotation: Domain name=LRR_1; Domain location=52-73; Score =14.5; E_value=0.41; Accession=PF00560.24; Description=Leucine Rich Repeat
  Pfam annotation: Domain name=LRR_1; Domain location=75-96; Score =14.1; E_value=0.53; Accession=PF00560.24; Description=Leucine Rich Repeat
  Pfam annotation: Domain name=LRR_1; Domain location=98-119; Score =6.5; E_value=20; Accession=PF00560.24; Description=Leucine Rich Repeat
  Pfam module annotation: Pfam domain module=LRR_1::LRR_1::LRR_1::LRR _1; Domain location=121-139::52-73::75-96::98-119
MATSIKVMKGFFCTPIRHGNPETAVSSRNHQNVDLSGSHSRILPQAFGKIRALVVLDLSQNQLGVIPDSIAGLKKLVELDVSSNVLESLPDSIGLLVNLKILNVSASKLIALPESIALCRSLVELDASFNNLVCLPTNMGFGPVNLEKLLIHLNKPGAEAVKDFMAKWWLDLIDEAQQKSMAETQNHQAQTGWLAWGASLLNNVAEVSESVAEYFGAKKAPRDPSLDQQL

SEQ ID NO: 109782 - protein, 226 aa, Glycine max
  Coding DNA Sequence Number=SeqID_18097
  Gene Ontology: Mol. function=serine-type endopeptidase activity; Cellular component=chloroplast; Biological process=proteolysis
  Homolog annotation: Hit_ID=P56772; Match level="QueryCoverage=28%, HitCoverage=32%, E-value=1e-23, Identity=85%"; Hit description=ATP -dependent Clp protease proteolytic subunit 1
  Pfam annotation: Domain name=CLP_protease; Domain location=2-87; Score=-56.8; E_value=0.00019; Accession=PF00574.14; Description=Clp protease
MAGSTCIAIATGKVMIHQPASSFYEAQTGEFILEAEELLKMSETITRVYVQRTGKPLWVISEDMEMDVFMITEHEFSAQEFNILQSSVETQGIARQRETLEAGPYLYPQMVECGHGMYYTPPAFSQYSAQMYQYSFKGQSDTSASEHSLGGAAETYPNFPWPTMSPSQHHDDRIPTPNAPLGTQWNVPGAIPDMDELLGVDLRHQFSAEADQVELGRHRDKRNPDG

SEQ ID NO: 109783 - protein, 134 aa, Glycine max
  Coding DNA Sequence Number=SeqID_18098
MCIGEGRTEENRMVAVASASDLNMLGAVCFTTNNTCHQPQVIHYCNKNVFRGMSENFLLTLLSRSFFLTYQEFDDMLVEFLQGTKLLASKCHKQHTESRDEEEACKLNTWWSCPLSLLKAVFVSVVGNYTPQTE

SEQ ID NO: 109784 - protein, 89 aa, Glycine max
  Coding DNA Sequence Number=SeqID_18099
  Homolog annotation: Hit_ID=A7QE52; Match level="QueryCoverage=80%, HitCoverage=13%, E-value=2e-08, Identity=41%"; Hit description =Chromosome chr4 scaffold_83, whole genome shotgun sequence
MEWIIGLWTLMGFLLCWWFLCVRKENQNSKVKKKKGKVPKGNTGWPLLGETLEFIACGYTSNPVSFMEKRKSLPLLMISPTRTVGALHH

SEQ ID NO: 109785 - protein, 398 aa, Glycine max
  Coding DNA Sequence Number=SeqID_18100
  Gene Ontology: Mol. function=drug transporter activity; Cellular component=membrane; Biological process=multidrug transport
  Homolog annotation: Hit_ID=A7QXZ0; Match level="QueryCoverage=34%, HitCoverage=27%, E-value=1e-40, Identity=64%"; Hit description =Chromosome undetermined scaffold_235, whole genome shotgun sequence
  Pfam annotation: Domain name=MatE; Domain location=221-369; Score =12.3; E_value=0.00043; Accession=PF01554.9; Description=MatE
MPRSRRSNPRLAEREVEGFEAEREFVGDVAEDVVLHDVENLKAREVRHLRKKLCDFLTRFFVIFSSRFASFFWFFMSISFFSVFSATKTGRYELVEECVDDYDAKPGICELRKAVLEECVDDYDAKPGICELRKAVLEGSSRGAEDAQLAGTGETIFHELDPGKSTLLAAILREPHQIQPQLGSTAVFIAGTPDIAPITSTGDFYREFMVESKKLGYLAGPAIFSFVSKYSLGAFTQIFAGHVGTIDLAAVSVENSLIAGFSYGIMLGMGSALETLCGQAVGAGKLDMLGVYMQRARHPNFGGCGNLRHLDDSAAVCVRAEFSGGEVPAGAGAELAAHGEARVGAGGRRRRAQWLVVVAQLVYVFGGWCWPAWNGFSGEAFRNLCGFFRLSLASAVML

SEQ ID NO: 109786 - protein, 378 aa, Glycine max
  Coding DNA Sequence Number=SeqID_18101
  Gene Ontology: Mol. function=oxidoreductase activity; Cellular component=extracellular region; Biological process=response to oxidative stress
  Homolog annotation: Hit_ID=A7QY04; Match level="QueryCoverage=86%, HitCoverage=91%, E-value=2e-54, Identity=37%"; Hit description =Chromosome undetermined scaffold_235, whole genome shotgun sequence
  Pfam annotation: Domain name=peroxidase; Domain location=90-342; Score=270.0; E_value=5.1e-78; Accession=PF00141.14; Description =Peroxidase
MTRIFLSTLSLCLLLLQLNLSKAQPGSPQKLPFTFHSLFPFFGRPEDANIPLKGPQDDLQNVPQQAADQKPQKLSPDFYIKTCPNAQKIVADALADIVKKNPGALGNLLRLQFHDCFVNGCDASILLDYSPSGDTVEKSSMVNGLLLKGADMIDDIKLKLEEQCPQTVSCADTLAFTANEVMTMAGLPPRKPLGGRRDALVSLSSAADADNLPLPDWTMDQMVKLFTKKGFNIEEMVILLGAHSIGMAHCDLFIQRAYNFQNTGKPDPTLTVEAVEEFKKACPNVNTPKYRNPPVNFDATPTVLDNLFYMEMVERNRTFLITDSHLLTDQRTLPLVQQFAHDPSLFPRRFPEVMLKLGSLNVLTGNEGEIRKICRSTN

SEQ ID NO: 109787 - protein, 264 aa, Glycine max
  Coding DNA Sequence Number=SeqID_18102
  Gene Ontology: Mol. function=carbon-sulfur lyase activity; Cellular component=vacuole
  Homolog annotation: Hit_ID=A7PCU3; Match level="QueryCoverage=95%, HitCoverage=55%, E-value=1e-77, Identity=53%"; Hit description =Chromosome chr17 scaffold_12, whole genome shotgun sequence
  Pfam annotation: Domain name=Alliinase_C; Domain location=1-260; Score=300.7; E_value=2.7e-87; Accession=PF04864.4; Description =Allinase, C-terminal domain
MGNMEYQDEVDILRSGLYQWAGDAASYEKNEPYIEVVTSPNNPDGTMRGPVVKSEAEGKLIHDLAYYWPHYTPITHQADHDIMIFTFSKCTGHAGSRLGWAIVKDIEVAKKMTRYVQMSSIGVSKESQTRVAKIMGVICDGYQNFGSMKSELFFEYSKRILKQRWEKLWEVIEESKVFSVAKYPKAYCNFTNESSESFPGFIWLKCKEGIEDCGSYLLEKLKIRAREGERFGVSPKYARISMIGTDDEFNEFLKRVSNAKKECD

SEQ ID NO: 109788 - protein, 383 aa, Glycine max
  Coding DNA Sequence Number=SeqID_18103
  Gene Ontology: Mol. function=ribose phosphate diphosphokinase activity; Cellular component=mitochondrion; Biological process =nucleotide biosynthetic process
  Homolog annotation: Hit_ID=A7QY01; Match level="QueryCoverage=84%, HitCoverage=79%, E-value=1e-138, Identity=75%"; Hit description =Chromosome undetermined scaffold_235, whole genome shotgun sequence
  Pfam annotation: Domain name=Pribosyltran; Domain location=241-368; Score=21.7; E_value=2.6e-05; Accession=PF00156.18; Description =Phosphoribosyl transferase domain
  Subcellular localization annotation: CTP_CleavageSite=60; ConfidenceScore=5.52e-01
MAATPPPPSFSLHSNKPSHSHSLLRLSSNENRTFFSFNSNLRCEIKGFESHRGWTIERVSDMSKDSANSHITNPSSPFLSVSSVTSASQFPTKNAKRVVLFYCPETKVLAEKIAAQTDSIELRNISWGKFPDGFPNIFIPNAQGIRGMHVAFLASFSSPAVIFEQIPVIYALPKLFIASFTLVLPFFPTGTSERMEDEGDIATAFTLARLLSNIPISRGGPTSLVTFDIHALQERFYFGDNILPCFESGIPLLKRRLQDLPDSDNISIAFPDDGAWKRFHKQLQHFPTIVCAKVREGDQRMVRIKEGDPRGRHIVIVDDLVQSGGTLIECQKVLAAHGATKISAYVTHGIFPNKSWARFGHDNGGNACFILFIKPKFIACSLL

SEQ ID NO: 109789 - protein, 867 aa, Glycine max
  Coding DNA Sequence Number=SeqID_18104
  Gene Ontology: Mol. function=nucleic acid binding; Cellular component= ribonucleoprotein complex; Biological process=mRNA processing
  Homolog annotation: Hit_ID=A5C6Y3; Match level="QueryCoverage=64%, HitCoverage=68%, E-value=1e-165, Identity=54%"; Hit description =Putative uncharacterized protein
  Pfam annotation: Domain name=RRM_1; Domain location=410-481; Score =92.3; E_value=1.6e-24; Accession=PF00076.13; Description=RNA recognition motif. (a.k.a. RRM, RB
  Pfam annotation: Domain name=RRM_1; Domain location=490-562; Score =7.7; E_value=0.029; Accession=PF00076.13; Description=RNA recognition motif. (a.k.a. RRM, RB
  Pfam annotation: Domain name=RRM_1; Domain location=585-656; Score =63.4; E_value=7.7e-16; Accession=PF00076.13; Description=RNA recognition motif. (a.k.a. RRM, RB
  Pfam module annotation: Pfam domain module=RRM_1::RRM_1::RRM_1; Domain location=410-481::490-562::585-656
  Subcellular localization annotation: CTP_CleavageSite=54; ConfidenceScore=5.11e-01
KFDVFKELETGNFTFIRSIMRTRNADSASKSATPKKTPPKKSPAAKRTTATKTRATKKNELSPAPDSNPDQSPLEQKSLGSASSAKSVKKKTPGRSRSKAINTPNSEEQCEAVADETPIEDDTEVAEKVEDVGVVDADNVEGEKEGGKGVGSVGLSDETDRKSMEVDELVQKVCESVGKENDVMEVEVAACWDASVSFRRPGRPIVDLNISADNEDCTGEKEGEKWKEELKDQEGDKGKEELKKQEGDNGKEELKELEGEKGEEELKELEGEKGEEELTELEGEKGNVELKEQKGDKGKEKLKEQEPEKAKGEETNLFGHEENSESFGVEGEAQMQKEDANPIKDGGEGPKIGENSDLGEQGKVELVEDPEENPEEDPEEPPEETSALEEEHRELEAIANQRKIKKEHEIFVGGLDRDATEEDLRKVFQRIGEIVEVRLHKNSSTNKNKGYAFVKFSDKEHAKKALSEMKNPVIHGKRCGTAPSEDNDTLFLGNICNTWTKEAKLKDYGIEGVENIMLVPDVQHEGLSWGFAFLEFSCHADAMLAYKRLQKPDVMFGHAERTAKVAFAEPIREPDPEIMAQVKSVFINGLPPHWDEDHVRELFKSYGEVVRIVLARNMSSAKRKDYGFVDFSTHEAAVACVDGVNKSELGDGASKIKVRARLSNPLPKTQAVKGGMCGGFQISHARSGAFSRPGGLGGEDSPSTTGGISTGAGVSIVDDHDFSMHPDFRQRQFGPQGAVRGGHYAGSRGAAFAGPSRPYHDRAWYGIPDGGPIEPIPPRRPYSPGGQFDMPSMGRHFDDPYLYDDNMHGMKRPFYMTDPEPDYMGPNRLRPRLDYADPPIFHGTHHHDSFGAGSRQYPPDYYGSDVS

SEQ ID NO: 109790 - protein, 351 aa, Glycine max
  Coding DNA Sequence Number=SeqID_18105
  Gene Ontology: Mol. function=DNA binding; Cellular component=nucleus; Biological process=regulation of transcription
  Homolog annotation: Hit_ID=A7QE08; Match level="QueryCoverage=100%, HitCoverage=99%, E-value=1e-113, Identity=64%"; Hit description =Chromosome chr4 scaffold_83, whole genome shotgun sequence
  Pfam annotation: Domain name=NAM; Domain location=5-134; Score=311.7; E_value=1.4e-90; Accession=PF02365.6; Description=No apical meristem (NAM) protein
MESCVPPGFRFHPTDEELVGYYLRKKVASQKIDLDVIKEIDLYRIEPWDLQEICRIGYEEQNEWYFFSHKDKKYPTGTRTNRATMAGFWKATGRDKSVYESIKLIGMRKTLVFYKGRAPNGQKTDWIMHEYRLETVENGPPQEEGWVVCRAFKKRTTNGQTKTIERWDRNYLYDEQACGSVSSTVVDHNIDLMVRQQQPQRFSAAQNFLYKQEEIIEEEQHLVQLPQLESPSLPLAKKQSSVMSLISENIINNEDIDNISQKGLSHNTAKKVTTDWRALDKFVASQLSQEERHEFIGVSSFATHHTTTSSDMALLLLQNNSRENERNYKFNPFLNTSSTSDCDIGICVFEK

SEQ ID NO: 109791 - protein, 177 aa, Glycine max
  Coding DNA Sequence Number=SeqID_18106
TCKRNLQVSGTLKRVAWGLDVGTRISEATCLTAASTGTKVDPTHPFGLNQVNHLASDVSKNSFPPYGLPPNYTPPNVAHALDENVDNSAPILVERPQPQFGQAYVPQPIGETYEVPRDHTLADFEPSLGYATKGEAFGGIALPNTLGALSIAHNHNPVILRWGESLLLWWKGRNLII

SEQ ID NO: 109792 - protein, 271 aa, Glycine max
  Coding DNA Sequence Number=SeqID_18107
MAGKIGWVSLNNMSKNLFEFNSSLFCCFKVLATDVVADDDDAGVSGHKKSRAPLSLRAPRHVARLTPSLSHPSSLEDGPLALTTVEVPGSTIVIVATPAPPPPPTIHAAAVGVLATSAGFIMASSSTVATPLLSVGVATMNALVMLPPPSSAPPIPPSVVLVVASLSLSFHPHVSLDHLYTSSNADSLCGANYKLEQKTLGAKHYGLCQSLPPQKFGDSGGEWTTTPKGSTQGVVLVDRPKGGLLLAQFGNRSALRLDGDEFYARCKGLQV

SEQ ID NO: 109793 - protein, 145 aa, Glycine max
  Coding DNA Sequence Number=SeqID_18108
LYQVRQVRREFDTRFLPFYTTCTIRCTCQTIEQVFGAIAGKLLSIWRVSSVLVFYMHRSPTGNLVPLDLEIEATLRRNRAERRRKLLQDKAVASILEEGAHSFDSSSSDSPSSRESATYLTEAVSMADEHQQRVTLEDYSSSSVP

SEQ ID NO: 109794 - protein, 105 aa, Glycine max
  Coding DNA Sequence Number=SeqID_18109
MKLCFYSVVHKKKTADKKSTDGKKNEVRGESNKEKEEQIMVKNKELKDQEKEKEIENEKEEKNNKNAKKSRSEKAVDEGVTVPYPVETGNHHVLRRSFPANATLL

SEQ ID NO: 109795 - protein, 112 aa, Glycine max
  Coding DNA Sequence Number=SeqID_18110
MRLKNQGSHSVHYVSHQGNQGAGKKFIKKHDKGKGSLKINDDSLQIQKKALMGNNYQFCGKYRHSQKDFLKLKSWFEKKGELNALVCFESNLTEVPHNNVGSSGLGIIKKGD

SEQ ID NO: 109796 - protein, 162 aa, Glycine max
  Coding DNA Sequence Number=SeqID_18111
  Gene Ontology: Mol. function=aspartic-type endopeptidase activity; Cellular component=small subunit processome; Biological process=DNA integration
  Homolog annotation: Hit_ID=A5B3G7; Match level="QueryCoverage=98%, HitCoverage=9%, E-value=1e-16, Identity=27%"; Hit description =Putative uncharacterized protein
ELWFLGQGHHDHLEKGVEAVPIDKRPEWEKLDYQLCAVLWQSAEPDAREIFVNDIQSLFDATMKVTTLKQTSHDMIAHIGKVRAAIEELRDQVPSMDSLITRLLRVPHALKEQNPVDTVETSAMVAPRGRGRGRNSRRGRSGRGGRPQCTYCPRMGHTQENY

SEQ ID NO: 109797 - protein, 178 aa, Glycine max
  Coding DNA Sequence Number=SeqID_18112
MAPTRHPLDPDKSNRALGFPALITGLCQSFGVPVTPSKVIRPPITQAFIEKYCTQRQVQGDAPQATDAPPPHQAGLAGSFDTEQYLRHLVRQQAANHRAHVQTHDCLYQMSLSLQSQGFTSFPCPTPDQFRVEVAWPGDWPEAQPGEAPAEAPDEADEAHEDEEMTDLLDFLGGSGAT

SEQ ID NO: 109798 - protein, 61 aa, Glycine max
  Coding DNA Sequence Number=SeqID_18113
MARACSPLKVKTCGPLMVRACSPTKVRTCSPLKIDCPFEKGDNSCNLILSFCKSLRELPQS

SEQ ID NO: 109799 - protein, 81 aa, Glycine max
  Coding DNA Sequence Number=SeqID_18114
MTLTILELFLRPYPVTWDATVFRVFNPDFPLYIKHEDHFEIAHGGQCLSISVLQLWILMRAGNSDIHGFLEPQSIQRSGQS

SEQ ID NO: 109800 - protein, 102 aa, Glycine max
  Coding DNA Sequence Number=SeqID_18115
NENAIHRAPKKGREWRIALNNNYAWLRLVGEGCMNENAIHGAPKKSREWRIALSNNYAWLETRGWRMHERKRNSWGSEKVLRMENCNKESLRMTPILWVEDA

SEQ ID NO: 109801 - protein, 91 aa, Glycine max
  Coding DNA Sequence Number=SeqID_18116
MYMYGKSSIDECRNVPFCGRARRGSRVHFSKEERCAESPPTFICGKRRKNRRKPVKMKILSSGVVFTFEEGRQKRGFCSYVPSIEEEIRPT

SEQ ID NO: 109802 - protein, 117 aa, Glycine max
  Coding DNA Sequence Number=SeqID_18117
KEKWAQFCQSRRDPSWEDVRKKAQAIQKQNTAPTCCLVGAVIDPPSPIRRHVKWKIGRTKKIGQMTSEAANEIAEKIANLLEEQASQGSFVPHGCQDVLIAAIGRPKHPGCVRVVGA

SEQ ID NO: 109803 - protein, 68 aa, Glycine max
  Coding DNA Sequence Number=SeqID_18118
  Homolog annotation: Hit_ID=UPI0000ECBAF8; Match level="QueryCoverage =60%, HitCoverage=48%, E-value=1e-16, Identity=100%"; Hit description= UPI0000ECBAF8 related cluster
ALKGLDDTPQPKSKAGMQAWHWPSFYNVVTGKTLALPNLIALQHIPLSPAGVIAKRPAPIALPNSCAA

SEQ ID NO: 109804 - protein, 124 aa, Glycine max
  Coding DNA Sequence Number=SeqID_18119
VVPSMVRLMKHANVFPLKKTLKKFIIWEINRDKDILKEDSHASIRVLIINKDIGDHTLAINSTKTRVTMSNHKSTESALKNLEVQVGQLAKSKRFVEARDEDSVVSKKKVAEKKGTDEKKDDVR

SEQ ID NO: 109805 - protein, 73 aa, Glycine max
  Coding DNA Sequence Number=SeqID_18120
MSEIHDTYYFFSRILCTKRSKLVCISIAFARQNNKEEVKQKLRRMKPETSLKIKEEVKKQFDVDFLAVARYPE

SEQ ID NO: 109806 - protein, 116 aa, Glycine max
  Coding DNA Sequence Number=SeqID_18121
MIMRGQDIYSSQDEATTSPSSSESEEAKGEESSEEIYPQEDGQPLVVKEKCKEVNVSSKSDQGVPMNPKRIKVIPEWPTPPSVEGRSPEYEEPRDLRSNHFQGGGNDAILLRKGIG

SEQ ID NO: 109807 - protein, 46 aa, Glycine max
  Coding DNA Sequence Number=SeqID_18122
MDEDQWMYDSIMSEEVDMDDQNEQECGMNEHVDCSDAFNTSQVFGT

SEQ ID NO: 109808 - protein, 490 aa, Glycine max
  Coding DNA Sequence Number=SeqID_18123
  Homolog annotation: Hit_ID=A7UQU7; Match level="QueryCoverage=61%, HitCoverage=63%, E-value=3e-27, Identity=29%"; Hit description=IMP dehydrogenase/GMP reductase, putative
  Pfam annotation: Domain name=DUF1723; Domain location=142-191; Score =39.8; E_value=9.5e-09; Accession=PF08330.1; Description=Protein of unknown function (DUF1723)
MVRTRGLGRALGRVIGRALGRKDHHDSYDVPQRPRPTASARRQREVAPIAEDDPMLTEDIHAYGEEVVDDAEGFLGRPHDPSVLTDYGDLVAVIVWNGEECPELKLSSHGRKVQKFGRSALEIERLVAATGLSPLIACSVDTGHQGLISAFVERWHKETSSFHLPVRELTITLDDVASLLHPPIIGAFHSFEPLHVDKASPERKLKLRQHNVMGHTYAYRGYEIFIRVDVRPDIGLLQLSGSYAWGAAALVHIYDHLNDVCKSGDRQLADYDEIPPCACQWIAMKASLKSLPASTYRKCLDGLMSPNVCWMPYGEHHGVWDFDLISCFSGHLQSGPVVVRHRPERVVRQFGYVQTIPPQTTTSMLSFEDIDDRWMHYSDYLAVAGQICIVPGQCASDYMEWFFMISHPFMTPAEPADLPRHPPAMQDDTYVEPYIPEVPVAPAAAPAHAPSYVEQPHTVEACQAIAERLDRLLNLRIVTAGTKIHEVVED

SEQ ID NO: 109809 - protein, 177 aa, Glycine max
  Coding DNA Sequence Number=SeqID_18124
MEVCNFAWKGATFMENTRERRWRALTQATINVSPNYSLLSIYVTRLNAWRAYTIWDGYLGTSNLVKGATCPQAFMPQCSMLGGLYTVQDKYPGKTNFDKGNNSPLSICTTRFNAWRVVFFGIDIPRILTHPKSVRSYNQVREMPQCEMSDGHNRTPRILYEGDMIESAEWHGKKWNQ

SEQ ID NO: 109810 - protein, 99 aa, Glycine max
  Coding DNA Sequence Number=SeqID_18125
  Homolog annotation: Hit_ID=A6X5K5; Match level="QueryCoverage=100%, HitCoverage=31%, E-value=1e-44, Identity=92%"; Hit description =Binding-protein-dependent transport systems inner membrane component
MSGLQKHFGGALVAGFLIKRILQALFVLVAKTLLVAFAVRLTGDPALMLTQGAGSITEADLARIREGLGLNQPFFVQCWQFLKGLFPMDLGRSFLGGAP

SEQ ID NO: 109811 - protein, 48 aa, Glycine max
  Coding DNA Sequence Number=SeqID_18126
MAASDHAILRDRTHIPTKRSVLELSSQDALLAQNKLLSKHLETLTKTL

SEQ ID NO: 109812 - protein, 104 aa, Glycine max
  Coding DNA Sequence Number=SeqID_18127
ERSLPPSSPRRAQLAQANQVASSRSNRLLEEHPGRPKWAWLLFISHMAVATYPFAGERSEVHGCVFQRRKMRGVATNVYLWKTSEKPKEPGHEEYSRFGSCIYV

SEQ ID NO: 109813 - protein, 105 aa, Glycine max
  Coding DNA Sequence Number=SeqID_18128
MTGSNRRPPACKAGALPAELIPRDPRQPDIGILVGLVGLEPTTPALSRRCSNQLSYRPSPRTLLPGHMASVFQKGGDPAAPSDTATLLRLHPSHEPRRGKRPPCG

SEQ ID NO: 109814 - protein, 79 aa, Glycine max
  Coding DNA Sequence Number=SeqID_18129
  Homolog annotation: Hit_ID=A5BAH3; Match level="QueryCoverage=98%, HitCoverage=21%, E-value=3e-08, Identity=42%"; Hit description =Putative uncharacterized protein
SRDLANMTLATLFGKLQEHEMEHMRLNQQEENDKKKKGISLKASSSIQEESVKEDLNEIEEDDDFRLFVKRLNKFLRNK

SEQ ID NO: 109815 - protein, 261 aa, Glycine max
  Coding DNA Sequence Number=SeqID_18130
MPRETLRPSNSSCVGRSITLPICFQCTRTGRSRARRWDRHGSRPGQDCGSGRPAAALQTPGHCRGTRTSRSTPGEHPAARWPGWLRPTAGTTPPAGGAPSTSGRPCRGPEGTAWTTSSSSGLGFGNGKFERAGRRPAAVAQRAHRAIGPAVAHMRCARGQRAAQQDPARIQSGIGVLAVARMAPGLAQFKADRTQCAGRGERALDILERNGDARGRPHGGDRSRARRCYALLAVHHMARHARQAAPELLLVRRMEVLGVAD

SEQ ID NO: 109816 - protein, 48 aa, Glycine max
  Coding DNA Sequence Number=SeqID_18131
MKNWMQNSKWDVYLGAYLNGALKGLDDTPQPKSKAGARWIIVKLTLNI

SEQ ID NO: 109817 - protein, 67 aa, Glycine max
  Coding DNA Sequence Number=SeqID_18132
WLRRGNQHIDNDDLIVFRRKLDIMKRHEFLWESYTTTVMSVLPPIWQARRWDRPCGTSSRHHAHHNE

SEQ ID NO: 109818 - protein, 82 aa, Glycine max
  Coding DNA Sequence Number=SeqID_18133
MLVRMIRTRHFAAGVAQELIKGNYWPLNRECKSRRGRAALCMMAKTYSPLKVIGTSTQGSTFMRKQEIDSLRGPVIQKDWTR

SEQ ID NO: 109819 - protein, 100 aa, Glycine max
  Coding DNA Sequence Number=SeqID_18134
MGVFIVGARSRYRGQNKFGCQGVGLGPNFHIIPQGTRDNDDLKTTCKISHGYILVDTQAFHLWPYDTTVGNLHKQTQCFQIMFSHQFNEFIHSYFGYFGK

SEQ ID NO: 109820 - protein, 193 aa, Glycine max
  Coding DNA Sequence Number=SeqID_18135
  Gene Ontology: Mol. function=rhamnose transmembrane transporter activity; Cellular component=1-2nm peptidoglycan-based cell wall; Biological process=carbohydrate transport
  Homolog annotation: Hit_ID=A7ML63; Match level="QueryCoverage=100%, HitCoverage=55%, E-value=7e-76, Identity=74%"; Hit description=L -rhamnose-proton symporter (L-rhamnose-H(+) transport protein)
  Pfam annotation: Domain name=RhaT; Domain location=1-193; Score =263.2; E_value=5.7e-76; Accession=PF06379.3; Description=L-rhamnose -proton symport protein (RhaT)
MWSVGGVMSWLILPWAVSAALLPNFWAYYSSFSLSQLLPVFLFGAMWGIGNINYGLTMRYLGMSMGIGIAIGITLVVGTLMTPLLQGRFVELFSSAGGRMTLLGVLVALLGVAIVSRAGLLKERALGINAEDFNLKKGLVLAVLCGIFSAGMSFAMDAAKPMHEAAASLGINPLYVALPSYVVIMGGGALINL

SEQ ID NO: 109821 - protein, 93 aa, Glycine max
  Coding DNA Sequence Number=SeqID_18136
MKNWIQNSKHNVYLGAYLNGVLKGLDDTPQPKSKASARWIVVKCNRQKGSTECGYYVMHWMSTIILGSFKNNWETYFNDVRPLETEILKALHI

SEQ ID NO: 109822 - protein, 117 aa, Glycine max
  Coding DNA Sequence Number=SeqID_18137
MTRGNPSDLQPFDPKIDRTFHRLVRHHFVSFEHPEHFVIGESEHSVVGNFEHPDFGHYSFEHSENMAQPPPRERTLREMVAPDFTYESLCIQYPDEDVPYVLKTGLIHLLPKFHGLA

SEQ ID NO: 109823 - protein, 79 aa, Glycine max
  Coding DNA Sequence Number=SeqID_18138
MAMQLSYPNFVRGPLLDDVRPFFGPREHPGPLGPSRIFLQKAVASGGSNPARLGELGGNHLPYFAINRGGRQEGRGSAP

SEQ ID NO: 109824 - protein, 79 aa, Glycine max
  Coding DNA Sequence Number=SeqID_18139
MKGILGLQAPMELTSCEASFMQKSRLIQRSFDDNKGDDKKLKDQEHFMITKMMISRIKIQVPRIKIKIQDSRFKNQEKT

SEQ ID NO: 109825 - protein, 274 aa, Glycine max
  Coding DNA Sequence Number=SeqID_18140
  Homolog annotation: Hit_ID=Q6WAY4; Match level="QueryCoverage=90%, HitCoverage=44%, E-value=7e-17, Identity=29%"; Hit description =Putative uncharacterized protein
MGTNQTGKKFYQVKVKSLGITSLKELGQFMGQLQRQAFRKAYGKIWDLAMVEVSTEAIASLTQYYDQPLRCFTFGDFQLSPMVEEFEEILGCPLWGRRPYLFYGFYPSLGRISKIVQISAQELDHRKQVKNGVVGIPRKYLEAKAIILAGKGEWAPFIDILTLLIFGGFLFPNVDGLVDLAAIDAFLAYHDHKESPVAAMLADLYDTFDRSFTPFSPRGKACLPAREPPFMHRERRGKLGPTLSKQRMSICQLLQSRSCYKTNWLPYERGATRR

SEQ ID NO: 109826 - protein, 165 aa, Glycine max
  Coding DNA Sequence Number=SeqID_18141
MRDRDIYSSQDEAITSPSSSESEEAKGEESSEEIYPQEEGQPLMFKEECKEVSVSSKRLAKKESHFEIKTNIKETSPLRQLSHLLLCKKTLVSTATPLGLDIIPQVKKLLEEGLVRKSLNPCALLVPKIGIIRHQIPKIGDMMNVLSGTTLFCKPLMRPTTSRFM

SEQ ID NO: 109827 - protein, 258 aa, Glycine max
  Coding DNA Sequence Number=SeqID_18142
ERGRAEHGSGRAADLHRDAPPIRERQQRLDGLLGQEREVDDLSRERSAVGAAEQQERLGQIDGPGVDLLQAGDQVVDVTIRIGGGDFEQGLRDRQRRAQFVRSVRGEPLLLGDVRFELLQHRVEHVGQVAELVARAGERDPVRQRPLRGEAGGVPDALERSEHPTGEQPSPAETEGEQHHHHRRGDRDERLAQVAAVGEEVDRVRHVAQQEQPDGREQQHTGHDDDARITERELEAGAHPAASTHRSPSRSGSRHRAP

SEQ ID NO: 109828 - protein, 137 aa, Glycine max
  Coding DNA Sequence Number=SeqID_18143
  Gene Ontology: Mol. function=protein serine/threonine kinase activity; Cellular component=nucleus; Biological process=regulation of transcription, DNA-dependent
  Homolog annotation: Hit_ID=Q1EP20; Match level="QueryCoverage=80%, HitCoverage=8%, E-value=5e-25, Identity=52%"; Hit description =Transcriptional repressor protein-related
  Pfam annotation: Domain name=PAH; Domain location=18-64; Score=53.7; E_value=6.6e-13; Accession=PF02671.12; Description=Paired amphipathic helix repeat
MDALQYIKEVQCAFHDSGEKFDKFMDVMKDYKFHRIDVGIVVEKMEEILKDHGDLILGFNKFLPKVYEILLLDEGEDGFGNASKYLKKIQDRFENKDHVYKSFLNILLKYKNNGVTLNPFSEIRRREEEISLKRDGL

SEQ ID NO: 109829 - protein, 147 aa, Glycine max
  Coding DNA Sequence Number=SeqID_18144
MSRGSGDLGDVRRAPGSQQIKGTKTTKLENEVRKLGELLVIDYQGRNGSLVIDYQIMMAAQLIHDRVEMECLEGAWETLEVQVIEVTSSEEDPEEDLEELPPEPAVDALDFLEGDEDPLPEVDSPEEVMSASKADSTKDSGPGEMAI

SEQ ID NO: 109830 - protein, 67 aa, Glycine max
  Coding DNA Sequence Number=SeqID_18145
MAALEREGSNGLGSTEAQLTTSKGWKAVSNDSFAASTYGAEERQLTNISSSPATITKSPPKANFNFW

SEQ ID NO: 109831 - protein, 165 aa, Glycine max
  Coding DNA Sequence Number=SeqID_18146
  Subcellular localization annotation: CTP_CleavageSite=73; ConfidenceScore=5.49e-01
MASKHCWCSALLKQWLSNSGGGTGPFSRGVPPRSLCGKLFRSHFLRGQTFGKHFYATNPTYTDFSKLSSTKSCANAIEAFHRTLGGRMFKHENQGNRDNVACPIISECTLGLGPSPTTPQFIKNKEQSKDKSLTFLSKYMQFRAPKYINGKLESPRMRYLLVGDE

SEQ ID NO: 109832 - protein, 146 aa, Glycine max
  Coding DNA Sequence Number=SeqID_18147
  Homolog annotation: Hit_ID=A7QAU0; Match level="QueryCoverage=90%, HitCoverage=33%, E-value=3e-15, Identity=30%"; Hit description =Chromosome chr5 scaffold_72, whole genome shotgun sequence
  Pfam annotation: Domain name=zf-CCHC; Domain location=85-102; Score =22.3; E_value=0.00063; Accession=PF00098.14; Description=Zinc knuckle
MALEEGKEKIEKFTRLESVQIKFEDEVKALILLSSLPDSWVATVTAVSSSTRENTLKRKDYLEGQNGQGRLKSRGKGSTKFRSDIICWNCDKRGHFTNQCKAPKKNKTHKNKKRDDDESANAATDEFDDALICSLDNLVDSWIMDS

SEQ ID NO: 109833 - protein, 139 aa, Glycine max
  Coding DNA Sequence Number=SeqID_18148
MVLAAAFPLKIQHMKEQWRTHPGNQFNKDQGRPSNRPSQQGPSLYDRTTKLEETLAQFMQVSMSNQKSTEKAIKNLEVQVGQLAKQLANRPSSSFGANTEKNPKEECKAVMTRSKMLVTEPAIDLMVEPLSETEEEVEV

SEQ ID NO: 109834 - protein, 154 aa, Glycine max
  Coding DNA Sequence Number=SeqID_18149
MKGLYICVSDFKKQERYSKNTSLSNVLSTTLGQTLANLLRVHPGTSNCIIHSKGEKSFYSSQKVNCNQEIGCLLNCEFPEHKGKGFLGCSEVVERIFINIVENLKWVAWGLDVGTGCGRTSINRVYISLFPYLIYVIAINFSLHVLLDKWPQIS

SEQ ID NO: 109835 - protein, 227 aa, Glycine max
  Coding DNA Sequence Number=SeqID_18150
MERSMIDAASGGALGDMTPAEARNLIEKMASNSQQFSAKNDAIVIRGVHEVATNSAASSETKKLEGKLDALVNLVTQLALNQKSVPVARQQQQQPAPSFQNAAGPSRPYIPPPIQQQLQPQKQPTVEAPPQPSLEELVRQMTMQNMQFQQETRASIQSLTNQMGQLATQLNQQQSQNSDKLPSQAVQNPKNVSAISLRSGKQCQGPQPVTPSSSANEPVKLHSTPEK

SEQ ID NO: 109836 - protein, 77 aa, Glycine max
  Coding DNA Sequence Number=SeqID_18151
MQLSTRSMSDKRAGTNFAPFIIQEQRVEWNNKLGGKRAETDSAPFIIQEQKAEWINAHRRILRPLSFRNNKLGDKRA

SEQ ID NO: 109837 - protein, 90 aa, Glycine max
  Coding DNA Sequence Number=SeqID_18152
MTGPLDGPIACFLIKVDPWVLVPITFRGPYVLAIRGLHILACRGLHALAFKGLRVLIFSVLHTHTLEEYKGSRPQDAQWARRSPTGPWGF

SEQ ID NO: 109838 - protein, 133 aa, Glycine max
  Coding DNA Sequence Number=SeqID_18153
MSLINVVGNNPLNSGHSCTYYGKHNHTIDRCYRKNGFPQNYASKEGKGTQSNPGRGNSGAKGNKVCKYCGFSNHTVDDCYKKHEYSPGHKLYKVQNPNINNDSVVREEGDGSPLDRNQETQNEDVILTTQQYK

SEQ ID NO: 109839 - protein, 61 aa, Glycine max
  Coding DNA Sequence Number=SeqID_18154
GWDLLPRLDLSRDSSGISGWTVIEHVIPDFAILTGERSISREGAPCPLPFPPLKGPRPLPQ

SEQ ID NO: 109840 - protein, 152 aa, Glycine max
  Coding DNA Sequence Number=SeqID_18155
MIGERVSFYVGPILLKCQPFGVYQMLDLVFKGQAFFGGVARGFPMVRASRIRIIQLWERILVDLPRSYYDHLVGDEGQQEVFVRHWDRGEFWNWLQGKVPHRIGTDTKVGIVGRASRGWSWSLGASVWMGVGTLGCAGVELEEFPARAEKLR

SEQ ID NO: 109841 - protein, 51 aa, Glycine max
  Coding DNA Sequence Number=SeqID_18156
MGRNVSALIGKFVPHIPEKCKDPDVVIHLANRSVAYLASCIEDVLVQTWGV

SEQ ID NO: 109842 - protein, 134 aa, Glycine max
  Coding DNA Sequence Number=SeqID_18157
MVGYTPSSFSDLVFAGEIIKVGLERGKSNHPTLMNAKTGANEEGENEGETHAATAIPIRPSFPPTQQCHYSANNNPSPYSPPIYPQKPSLNQPQNPPTTQPMLNTTFSTNQNTNQGRNFAAKSCRIHPNFGVLC

SEQ ID NO: 109843 - protein, 188 aa, Glycine max
  Coding DNA Sequence Number=SeqID_18158
  Subcellular localization annotation: CTP_CleavageSite=50; ConfidenceScore=5.06e-01
MSFSEETSSQTITISRLAFILPNGSISYNQTSVYFQSLIPTPMRVPNNCSFDTLKRRMDNTLQLTNDQLLDEIYYRQPFIDAELLCTIIRTPDAMLNLLQSTITPTHDAIMYYNGKWNIPRQGEFFGYSFTGTNPIRFGILSECGMEKLKDLIKQVAPTGVPLMEFTDHNWLDDCSFDNQVILSIPKI

SEQ ID NO: 109844 - protein, 235 aa, Glycine max
  Coding DNA Sequence Number=SeqID_18159
  Gene Ontology: Mol. function=hydrolase activity, hydrolyzing O -glycosyl compounds; Biological process=carbohydrate metabolic process
  Homolog annotation: Hit_ID=A7LZZ4; Match level="QueryCoverage=99%, HitCoverage=38%, E-value=5e-91, Identity=66%"; Hit description =Putative uncharacterized protein
MQLSGNTKLKKAEVAALLSISNLSAQTFSDFNYHGNDKIYNNNPLKPDEFYSPILQGCYPDPSITKKGDDYYLVNSSFSMFPGVPIFTSKDLVNWKQVGHVLDRSSQLKVEKGGVSHGIYAPDIKYNKHNDTFYMITTQIAGGIGNMVVKTKDPAKGWSEVQKLNFDGIDPAIFFDDDGKAYIVHNDAPPQGTEQYQGHRVIKMWDYDLEKDQVVAGSDRIIVNGGVDLSQKPIG

SEQ ID NO: 109845 - protein, 100 aa, Glycine max
  Coding DNA Sequence Number=SeqID_18160
  Pfam annotation: Domain name=zf-CCHC; Domain location=63-80; Score =14.8; E_value=0.0086; Accession=PF00098.14; Description=Zinc knuckle
  Subcellular localization annotation: CTP_CleavageSite=67; ConfidenceScore=5.49e-01
MNKGKSDHSHLLSVQKPTTNKIGLGYNKQTTFSKKTKFASSKKMNPNKVSKKKNLVHSKPKTKTCHYCMKIGHISYKCYVRRFYIPRGVTKSKRLAIVLG

SEQ ID NO: 109846 - protein, 335 aa, Glycine max
  Coding DNA Sequence Number=SeqID_18161
MVLKEELIACSRSKRSLSQRLCETETNMLAIIAKYQEELGLAAAHEHRIADEYAQVYMEKEARGRVIDSLHQEATMWMDRFALTLNGSQELPRLLAKAKAMADTYSTPEEIHGLLGYWKNTITKRAARDPYRTRSKSRTMGDQEETQEQMKADMSALKEQMASMMEAMLSMKQLIEKNAATAAAVSSAAEADPTLLATTHHPPSNIVGRGRDTLGHDGNPHLGYNRAAYPYGLPPNYSPPVLQEDAGHIASPIHEREPPQQPDEVHKDPQDYARRDVEFYPPIPEGPAPGTLPQPNIAASPIVLSTEGPPPATEERRKLDLLEERLRAMEGFGDY

SEQ ID NO: 109847 - protein, 75 aa, Glycine max
  Coding DNA Sequence Number=SeqID_18162
MAYTHIPVEAKMIHKRFSSNFNQPESIRLCTLHFKVIQCLMECPRTPPCCVRFVSSEKWRLRNLGRGYGYHCIIK

SEQ ID NO: 109848 - protein, 217 aa, Glycine max
  Coding DNA Sequence Number=SeqID_18163
MKKEKRSSHNSCKSLSEELRDYYEGRHRSHLRPHSNRREHERKPQEANINLPYFHGKDNVEAYLDWEIRVEQKLKRKSTLKSYGSHSYPKKDQGLGILGAAPSKPKDDKGKTIEKRGRKATKNEATTSPSSSESEEAKGKESSEEIYPQEEGQPLMVKEECKEVSFSSKRLAKKERHFEIKTNIKEISPLRQPPHILLCKKKLVSITTPRGLEVILK

SEQ ID NO: 109849 - protein, 82 aa, Glycine max
  Coding DNA Sequence Number=SeqID_18164
  Subcellular localization annotation: CTP_CleavageSite=47; ConfidenceScore=5.33e-01
MSLPSAVHVSSTFEFGAMLHDCLSVDPQVQSSILPTYFGVPSMSLPSAVNVSSTFEFGSMLHDSLSLETQVQSSFLLFFGAP

SEQ ID NO: 109850 - protein, 299 aa, Glycine max
  Coding DNA Sequence Number=SeqID_18165
  Gene Ontology: Mol. function=transporter activity; Cellular component= integral to membrane; Biological process=transport
  Homolog annotation: Hit_ID=Q1LR28; Match level="QueryCoverage=88%, HitCoverage=24%, E-value=1e-71, Identity=52%"; Hit description =Acriflavin resistance protein precursor
MKIVSEDPDIKTYYEYTGGAGGGQTNTGTMFASLRPLPERETTAADVVARLRPQLMKVPGVSLMLTSQQELSIGARQGGAQFQYTLLADDLPTLEKITPKLRGMMNRSPELTDVNTDFQTQGLQLQLQVDRNAAAQLGITAAQLDATLNNAFSQRLISTIYEPLNQYYVVLTLSPEFTKGPQALEQLYLNGLNNTRVPLSAISRWQLKSTPFALNHQGQFVAATISFNVAEGYSLEQATSAIEQAFERSGAPDNVNATFSGAAKMFKASLASHPWLILAGLLTVYIVLGILYERLSPFR

SEQ ID NO: 109851 - protein, 172 aa, Glycine max
  Coding DNA Sequence Number=SeqID_18166
MPSSFANLVFAGERIKVGLKRGKFDYVSSTSANARRIGTTGAKRKEGDTHAVTSAPAWVKPPQTSHGTHQYAQHHPSFSAHVGNSSNSAPVQPRVPAPIQREAPQAPAPTTTHPTGNAHFGTGSNLMRNFPPRPIPEFTPIPMTYKDLLSSLIANQMAVITPGKIYQHPFPK

SEQ ID NO: 109852 - protein, 318 aa, Glycine max
  Coding DNA Sequence Number=SeqID_18167
  Homolog annotation: Hit_ID=A6EHT8; Match level="QueryCoverage=83%, HitCoverage=49%, E-value=2e-13, Identity=30%"; Hit description =Putative uncharacterized protein
MIPPPPPTFFEKFGILIGGFIVFIGLIFYYYSTWRKYGVDPEKPIVYPQFNVPENLSPASLGYLRNENFKNKYLTAAIVNLAIKGYFQIIEGEDAGILGLFSSKIFTLKKLKEADESLPKEEINLMNTLFSDNIDTVKFDGKYDSRIERVVTNFKETLKFQHDKFLNEGNNTGKLILPTLLITIVYMLGLYISYTIYPEAEKVVIGIAVPSEEKLQKKSLIEGFKMYMGAAENEQLKFHNPPQLTPQVFETLLPFAMVLGVDEIWGKKFDTLLKNMANGTEYVHSWYIGNSINHYKFGTTLNSSLTKSIKSASTRGIL

SEQ ID NO: 109853 - protein, 59 aa, Glycine max
  Coding DNA Sequence Number=SeqID_18168
  Subcellular localization annotation: CTP_CleavageSite=18; ConfidenceScore=5.10e-01
MAGSRQQTRRPSGRVHLSSSTKSHSRTHLVAHDPRNLNKTSTSSEDSHTSQKIYICMFR

SEQ ID NO: 109854 - protein, 54 aa, Glycine max
  Coding DNA Sequence Number=SeqID_18169
MTNQSRYLNLKYKWQQRSPIIIRIHGKSCPILFCATPPELSQETHIPLTMRSGK

SEQ ID NO: 109855 - protein, 359 aa, Glycine max
  Coding DNA Sequence Number=SeqID_18170
  Gene Ontology: Mol. function=hydrolase activity; Biological process =lipid metabolic process
  Homolog annotation: Hit_ID=A7P389; Match level="QueryCoverage=99%, HitCoverage=96%, E-value=1e-129, Identity=58%"; Hit description =Chromosome chr1 scaffold_5, whole genome shotgun sequence
  Pfam annotation: Domain name=AXE1; Domain location=83-348; Score= -201.4; E_value=0.0031; Accession=PF05448.3; Description=Acetyl xylan esterase (AXE1)
  Pfam annotation: Domain name=Abhydrolase_1; Domain location=172-346; Score=-3.6; E_value=0.01; Accession=PF00561.11; Description =alphabeta hydrolase fold
  Pfam annotation: Domain name=Abhydrolase_3; Domain location=146-334; Score=-91.0; E_value=0.088; Accession=PF07859.4; Description =alphabeta hydrolase fold
  Pfam annotation: Domain name=Peptidase_S9; Domain location=158-359; Score=-58.7; E_value=0.0035; Accession=PF00326.12; Description =Prolyl oligopeptidase family
  Pfam module annotation: Pfam domain module=AXE1::Abhydrolase _1::Abhydrolase_3::Peptidase_S9; Domain location=83-348::172-346::146- 334::158-359
  Subcellular localization annotation: CTP_CleavageSite=22; ConfidenceScore=5.10e-01
MELSVPFRFRSRNLLSPSTHIPITYPSKHQPPFLTKFVNKPKISKLTVRAQRRAPIEGLSDELNAIARCNLDFAYTRRRVRAAFADMQQQLDHCLFKNAPAGIRTEEVRFSALPYYLGWYERNSRGLEIFCKSWMPKPGIPIKASVCFCHGYGDTCTFFFEGIARIIAASGYSVFAMDYPGFGLSEGLHGYIPKFDYLVDDVIEHYTKIKARPDLSGLPRFILGQSMGGAVSLKVHLREPNNWDGMILVAPMCKAVYNVICYDDNPRLRTGMELLRTTKEIESQVHKVSAPLLILHGAEDKVTDPLVSKFLYERASSKDKTLKLYEGGYHCILEGEPDDRIFAVHDDIVSWLDFRCSIK

SEQ ID NO: 109856 - protein, 128 aa, Glycine max
  Coding DNA Sequence Number=SeqID_18171
QALITGLCQSTECLSPPARSSGPLLIELHQEVLRPQAGAGRNTTAAWGWPAAGNRRTAITSRVHLSSSTKSRTHLVAHDPRNLNKTSISSEGHPLYPRTAGQTLTYIITSRSTSLEPKSQLIINLDPG

SEQ ID NO: 109857 - protein, 96 aa, Glycine max
  Coding DNA Sequence Number=SeqID_18172
MPARRKKAISFFWVLPLHVKDSQGGQNLGAKALAEQGEGASFIDVLALLLFGVILFPNANGLVDLATIDAFLAYHQSKESLVVAILADAYDTFDRD

SEQ ID NO: 109858 - protein, 73 aa, Glycine max
  Coding DNA Sequence Number=SeqID_18173
MAGAGDNSGVYHQLDGSQRLLLDAMTTQMQRLLNRNNEELYKRIEGLEHQMNLNAGRPYGGNRRVNDGSNRIE

SEQ ID NO: 109859 - protein, 54 aa, Glycine max
  Coding DNA Sequence Number=SeqID_18174
MKYDRGDKYYGRYDETGQHPGPFAKLVQKRAFVCNTQFPVHHNKMVYQKGVTEL

SEQ ID NO: 109860 - protein, 83 aa, Glycine max
  Coding DNA Sequence Number=SeqID_18175
MGEVLDSCSKLFQAPPLGLIWEPIQSLCSDSQPLMIAADDPITASPKLSVLSSCRIPCLANSLEYPRVVVTETPCDERRDAFV

SEQ ID NO: 109861 - protein, 94 aa, Glycine max
  Coding DNA Sequence Number=SeqID_18176
  Subcellular localization annotation: CTP_CleavageSite=64; ConfidenceScore=5.12e-01
MYVNLAKEVCDYPTGKTNFPNVCLRRKWPRGSLPQRGPGRTRQQKELVPLRSMIVTALGARYTSSASKPSRGGRFSGSDASSSGTTSILISRRK

SEQ ID NO: 109862 - protein, 87 aa, Glycine max
  Coding DNA Sequence Number=SeqID_18177
  Gene Ontology: Mol. function=aspartic-type endopeptidase activity; Biological process=RNA-dependent DNA replication
  Homolog annotation: Hit_ID=Q6WAY3; Match level="QueryCoverage=41%, HitCoverage=1%, E-value=1e-08, Identity=72%"; Hit description =Gag/pol polyprotein
MVVSFFLTHLLLELVLQSSFFSIPLPFIFKKPRTPLMKKIQGLQAPHGATLERVVYYLSKKFTTCEMNYFLLERTCCALVWAAHRLR

SEQ ID NO: 109863 - protein, 169 aa, Glycine max
  Coding DNA Sequence Number=SeqID_18178
MSVHVTQVIADAIYLFVCMPPSRHPLDPDKPNRALGFLALITSLCQSFGVQVTPGKVIRQPITRAFIEKYCTPRQAQGDAPQGADAPPPPRQADPAEPLGMERYLQHLVRQQAANHHRQQFAAEVAWPGDWPDAQAGEEPTRSPGRMDEPCMDEDMTDLFDFLGGSGAT

SEQ ID NO: 109864 - protein, 201 aa, Glycine max
  Coding DNA Sequence Number=SeqID_18179
  Pfam annotation: Domain name=G-patch; Domain location=85-129; Score =21.9; E_value=0.00043; Accession=PF01585.14; Description=G-patch domain
MVVRAFDGTRREVMGEIDIPIQIGPHTCNVVFQCRVKRICLVSCPSSAPYVEAAEESLETAFQSFEVVSCASVEPSPSLPSLSKAAIMVARVMLRNGFEPGMGLGKDCLGNADVVDIKGNPYKYGLGYEPGMPGRRNVPSRFWADRVWPGRISQCFTSAGMVSEEEVAVIEEEFPQDPPCFVQPCHPDSQVGNWHVISQSE

SEQ ID NO: 109865 - protein, 252 aa, Glycine max
  Coding DNA Sequence Number=SeqID_18180
  Gene Ontology: Mol. function=hydrolase activity, acting on carbon -nitrogen (but not peptide) bonds, in linear amidines; Cellular component=nucleus; Biological process=metabolic process
  Homolog annotation: Hit_ID=A8AKN2; Match level="QueryCoverage=81%, HitCoverage=57%, E-value=2e-80, Identity=67%"; Hit description =Putative uncharacterized protein
  Pfam annotation: Domain name=Peptidase_M20; Domain location=62-203; Score=24.7; E_value=4.4e-05; Accession=PF01546.19; Description =Peptidase family M20M25M40
  Pfam annotation: Domain name=Peptidase_M28; Domain location=59-243; Score=-61.2; E_value=0.086; Accession=PF04389.8; Description =Peptidase family M28
  Pfam module annotation: Pfam domain module=Peptidase_M20::Peptidase _M28; Domain location=62-203::59-243
MAQIGGTPAGGVTRLALSEEDRIARNLLRDWALDAGFTCDVDSMGNMFIRRAGKNPQLAPVMTGSHVDTQPLGGNYDGVYGVLAGLELLRTLNDHNVETERDVVLVNWTNEEGARFAPAMLSSGVWTGQFSEAYAHARADNDGITVGEALDSIGYRGETPARAPRGNGPALVYPDAGGFAAHAGTTPMHSRRGAAAFAELALKGRDWLPACAGRTAPARSVWRSRHSGRALGEAALSFGILCQAGNQDHGAA

SEQ ID NO: 109866 - protein, 557 aa, Glycine max
  Coding DNA Sequence Number=SeqID_18181
  Gene Ontology: Mol. function=transporter activity; Cellular component= integral to membrane; Biological process=sodium ion transport
  Homolog annotation: Hit_ID=P75763; Match level="QueryCoverage=79%, HitCoverage=92%, E-value=1e-155, Identity=60%"; Hit description =Inner membrane protein ybhI
  Pfam annotation: Domain name=Na_sulph_symp; Domain location=94-552; Score=568.4; E_value=7.1e-168; Accession=PF00939.10; Description =Sodium:sulfate symporter transmembrane region
MDAQQLSREGYFNQFIQSGARIEPAGCSLCMGNQARVREGSHVVSTSTRNFPHRLGTNAKVFLASAELSTVAAILGKMPTVDEYFRYTDKLHDAHENIYRYLSFDTLAEYQTTKGIYLSAIVGLVIKPYPEPVIMLVAVALTCFTVTKFPDSPVKSMDVLSGYASGTTWLVFSAFTLSAAFVTTGLGKRLAYWFILKFGSTTLRLGYVTALLDLVLAPATPSNTARAGGVVFPIINSIATVLGSTPQESPCKAGRYLMVNVYMVTKTTSYMFLTGFAGNALALQLISDIFHIHISWIGWMLAGAPLGLLMLCIIPYICYRVASPEIKKIDNVAIATDGLKSLGAMSLKEKGLVVIFIAALLGWIFSRHLGLNESAVAIIAMGAALLFNIIGWSDVQKNKGGWNTLMWYGGIIGLSATLSKEGFFRWLADFLSAHLDFLSAGNMTIVIIVFLSVLVRYFFASGGAYVAAMVPVFATVGLVTGTAPVLLALAILFSNSYGGCITHYGGAAGPIIFASGYNDIKSWWTIGTIVALGTFLVHMFLGIPWWGFLMQHGMLQY

SEQ ID NO: 109867 - protein, 78 aa, Glycine max
  Coding DNA Sequence Number=SeqID_18182
MSVKNLVGRLGVHDKTNHTLGDQSGSCYFMRMLQLCGISTCLKEHSNRVYLPPRPKIRRVRQGLSLLIQVQPRKHFNT

SEQ ID NO: 109868 - protein, 127 aa, Glycine max
  Coding DNA Sequence Number=SeqID_18183
MGGTKRLLVIIPKVVISLLMFSRGIIPFEKHIAAVGTTNNNMLSKRKTLDEGSLLSSKSETQHDHRFTSTPYDPMDSGIRPLFNSPCVQKVESLTVATYPSAEVATHGSRVRLPREEDARSRQQHLF

SEQ ID NO: 109869 - protein, 167 aa, Glycine max
  Coding DNA Sequence Number=SeqID_18184
STLEDPRPKLVILHPRYAEIPYGYPHPFARQTQLCPMASRDQRPSLVILHPRYAEIPYGYLHPFARQTQLCPMASRDQRPSLVILHPRYAEIPYGYPHPFAIRQTQLCPMASRDQRPSLVILHPRYAEIPYGYPHPFARQTQLCPMASRDQRPSLVILHPRYAEIPY

SEQ ID NO: 109870 - protein, 103 aa, Glycine max
  Coding DNA Sequence Number=SeqID_18185
  Homolog annotation: Hit_ID=UPI0000ECBAF8; Match level="QueryCoverage =39%, HitCoverage=48%, E-value=1e-16, Identity=100%"; Hit description= UPI0000ECBAF8 related cluster
MDEAIITMKRALAMMKDCHWRPPHGLVLAIAEYLEKDGNLKYANKYITDLRMQAWHWPSFYNVVTGKTLALPNLIALQHIPLSPAGVIAKRPAPIALPNSCAA

SEQ ID NO: 109871 - protein, 193 aa, Glycine max
  Coding DNA Sequence Number=SeqID_18186
MGVQIATRPTWALQKIPPEGGCFWRKSPCSPGRAGLPSLVTDAWGANTFPMHKYNSRTFHYKVRRSRLFPVFPTFSSNKRWWRLHAYSFLRTRTRESRVALPPKVLAIEIAIPCVTGLNQAHAFKKSTSTMHHSHRGRERESMCEVKELQEQIKADIEAVKEKMATMMEAMISMKKIMEVNAVVVAATSAIQR

SEQ ID NO: 109872 - protein, 71 aa, Glycine max
  Coding DNA Sequence Number=SeqID_18187
  Homolog annotation: Hit_ID=UPI0000ECBAF8; Match level="QueryCoverage =57%, HitCoverage=48%, E-value=1e-16, Identity=100%"; Hit description= UPI0000ECBAF8 related cluster
MAKDEEGHFVMAQKVWMEGMQAWHWPSFYNVVTGKTLALPNLIALQHIPLSPAGVIAKRPAPIALPNSCAA

SEQ ID NO: 109873 - protein, 196 aa, Glycine max
  Coding DNA Sequence Number=SeqID_18188
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTHMFQKFNYLSDPMFKGSFGMQAWHWPSFYNVVTGKTLALPNLIALQHIPLSPAGVIAKRPAPIALPNSCAA

SEQ ID NO: 109874 - protein, 171 aa, Glycine max
  Coding DNA Sequence Number=SeqID_18189
  Gene Ontology: Mol. function=DNA photolyase activity; Biological process=DNA repair
  Homolog annotation: Hit_ID=Q6EAN1; Match level="QueryCoverage=61%, HitCoverage=15%, E-value=3e-42, Identity=79%"; Hit description =Mutant cryptochrome 1-1 protein
  Pfam annotation: Domain name=DNA_photolyase; Domain location=19-166; Score=100.8; E_value=4.2e-27; Accession=PF00875.9; Description=DNA photolyase
MTMITNSSSVPAEMSGGGCSSIVWFRRDLRIEDNPALTAGVRAGAVVAVFIWAPEEEGQYYPGRVSRWWLKNSLAHLDSSLRNLGTPLITKRSTDTLSSLFEVVKSTGATQLFFNHLYGMQAWHWPSFYNVVTGKTLALPNLIALQHIPLSPAGVIAKRPAPIALPNSCAA

SEQ ID NO: 109875 - protein, 58 aa, Glycine max
  Coding DNA Sequence Number=SeqID_18190
  Subcellular localization annotation: CTP_CleavageSite=36; ConfidenceScore=5.15e-01
MEESSKKRKGSSSTPIVAGHRRQGTSRDPSTPVPPSLSSPRSSILVILDPKYLDLEFL

SEQ ID NO: 109876 - protein, 202 aa, Glycine max
  Coding DNA Sequence Number=SeqID_18191
  Homolog annotation: Hit_ID=Q84VI1; Match level="QueryCoverage=98%, HitCoverage=29%, E-value=2e-66, Identity=69%"; Hit description =Envelope-like protein
MATSPKETSASGSPAVPSSPHQEQPEFNIQPIQIIPGQASVPEKLIPRRQQGVKIAENPSPATSPRKVDTEMDKKIRGIVSSILKDASVPDAEKDVPTSSNPNDSVPDVKKDVPTSSAPNAEALPSPSEEESSKEEDQASEETPAPRAPEPALGDLIDLEEVESDEEPIANKLAPGIAERLQSRKGKTPIKRSGRIKTMGIL

SEQ ID NO: 109877 - protein, 69 aa, Glycine max
  Coding DNA Sequence Number=SeqID_18192
MDDIERRRHHIGHLILLKEVMMAMKKGFVTFRKKMCQILKKRAKGSILGHFSALESPRQLHDEVTSSPG

SEQ ID NO: 109878 - protein, 137 aa, Glycine max
  Coding DNA Sequence Number=SeqID_18193
MTVKTSDTCSSRRRSQLVCKRYAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLAMPAGRL

SEQ ID NO: 109879 - protein, 38 aa, Glycine max
  Coding DNA Sequence Number=SeqID_18194
MDHQQQGAQHPRGANHLTVTTHPKGVNHPIVTIHLKGA

SEQ ID NO: 109880 - protein, 122 aa, Glycine max
  Coding DNA Sequence Number=SeqID_18195
MASRKISTKRSRKDATTEGTSAAPEFDSRHFRSAEHQQCFEAIKGWSFHRERRVQLRDDEYTDFQEEIARRRWTSLVTPMAKFDPDIVLEFYANAWPTEEGVRDLRSWVRDQWIPFDADALS

SEQ ID NO: 109881 - protein, 258 aa, Glycine max
  Coding DNA Sequence Number=SeqID_18196
  Homolog annotation: Hit_ID=Q1EPC3; Match level="QueryCoverage=54%, HitCoverage=35%, E-value=1e-06, Identity=27%"; Hit description =Putative uncharacterized protein
  Subcellular localization annotation: CTP_CleavageSite=31; ConfidenceScore=5.02e-01
MAEPSKKRKGSSSRSQRNSESHDTPIPPSISSSTLFSSEEQRIWYTTLFSSCSIIDPKFMDMEFFFYETFECVQAFQNFGLIPFMSLKIPIHPELVKVFYSNLEIQEGSLISKVYGIKMVIDQSLFFELTQLSSDGVLFEGTLDDDWKFDFSVSDARRLVCTNQADMIGRLLAGSLAFDCRILHYLIVRILLPRSSNLAQVPLDFEPSVQIKKSFSIGAAVVASFGYRKERDDSWVKKDAQPHDAEECSPAREDSSLL

SEQ ID NO: 109882 - protein, 73 aa, Glycine max
  Coding DNA Sequence Number=SeqID_18197
  Subcellular localization annotation: CTP_CleavageSite=44; ConfidenceScore=5.39e-01
MATQLNQAQSQNSNKLPSQTVQNSKNVNAITLRYGNQIQVPPPVAAPAPEPVELHSKPEKEDEIVAQKRKLPD

SEQ ID NO: 109883 - protein, 135 aa, Glycine max
  Coding DNA Sequence Number=SeqID_18198
  Homolog annotation: Hit_ID=A0ST23; Match level="QueryCoverage=33%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARAETLVGTELEFVIMVIAVSFGKPVVPAALMNRPTRGERRFAYWALFRFLAH

SEQ ID NO: 109884 - protein, 121 aa, Glycine max
  Coding DNA Sequence Number=SeqID_18199
MAKFGRSTLEIEGLVAASGRSREVTITLDDVASLLHLPIVGAFHNFEQLHVDNAINMLVELLECWIYEHFPSVGFALAAEDYDERRPRACRWTSGKALPVSMYHRRLDRLTPNVVCWVPYD

SEQ ID NO: 109885 - protein, 27 aa, Glycine max
  Coding DNA Sequence Number=SeqID_18200
DSVEFFIVLRRSSPFFIRSSFVLRSST

SEQ ID NO: 109886 - protein, 101 aa, Glycine max
  Coding DNA Sequence Number=SeqID_18201
CSCMRGNSSAGDLAPLDLEIEATCRRNNTERKRKILQERTAQPNLEESQSSKSSSIFPELRESEVGASEVSIMAEDQPQRVTLEDYSSSIVLQFFTSIVRP

SEQ ID NO: 109887 - protein, 54 aa, Glycine max
  Coding DNA Sequence Number=SeqID_18202
MCTCAIFGSQDALSMHKMAPRKLASKRSRKDKAAEGTSSAPEYDSHRFRSAVHQ

SEQ ID NO: 109888 - protein, 26 aa, Glycine max
  Coding DNA Sequence Number=SeqID_18203
VATLANMDDEELPLPVNSDVVKRYYA

SEQ ID NO: 109889 - protein, 115 aa, Glycine max
  Coding DNA Sequence Number=SeqID_18204
  Homolog annotation: Hit_ID=O69421; Match level="QueryCoverage=24%, HitCoverage=29%, E-value=4e-08, Identity=100%"; Hit description=InsA protein
  Pfam annotation: Domain name=Ins_element1; Domain location=8-64; Score=-15.4; E_value=0.004; Accession=PF03811.4; Description =Insertion element protein
  Subcellular localization annotation: CTP_CleavageSite=77; ConfidenceScore=5.79e-01
MVFLSAPVASVSISCPSCSATDGVVRNGKSTAGTSALASVAVTLRVTTTPAALNAPLQGASHSPFRLRNCWEGRSVRASSLLRQLAKGGCAARRLSWVTPGFSQSRRCKTTASEL

SEQ ID NO: 109890 - protein, 611 aa, Glycine max
  Coding DNA Sequence Number=SeqID_18205
  Gene Ontology: Mol. function=kinase activity; Cellular component =membrane; Biological process=signal transduction
  Homolog annotation: Hit_ID=A5BPP1; Match level="QueryCoverage=76%, HitCoverage=36%, E-value=1e-149, Identity=46%"; Hit description =Putative uncharacterized protein
  Pfam annotation: Domain name=KIP1; Domain location=1-52; Score=78.7; E_value=1.8e-20; Accession=PF07765.3; Description=KIP1-like protein
MDAKVKQMIKLIEEDADSFARRVEMYYKKRPELMKMVEEFSRAYRALAERYDHATGVICHAHKTMAEAFPNQVPMMLRDDLPAVSPSETEPHTPEMRHPDASAHFHAIKRNGGYIGEPDSPLNKTGLKQLNDLYIPGEQENLPKFARRGLNFFEMQEESNQQNRGSNNTLSESERVTKDETEILALKKAIAKLEDEKEAGLLQYQQSLEKISNLELEVSTAQENSRKLDERASKAEAEVQALKEAQIKLQAESEASLLQYHECWEKISNLEKNISSLQKEAGELNERATKAETKSESLKQELARVEAEKEATLVQYNQCLETISKLEERIKEVEENARRIKEHANIAEKEIEALELQVTKLNEEKEDAALHYQQCMEIISSLEYKLSCAEEDVHRLNSKIVDGVEKLQSSKQKCLLLETSNHTLQSELQSLAQKVGSQSEELNEKQQELGRLWGCIQEERLRFIEAELLSKLFSSCILSLRNSLDLLLLNLTVKWKYWGMWNLVTLLVFIIVVAFAVVIWIGIGKNPIDSEVAAQPTQKCNSFFINKSSMTCEGASMEEGVGLQCKIAEVNVKESEGSNEGASRKRGFKRRSKHKVLGFKAISKASRNSRE

SEQ ID NO: 109891 - protein, 220 aa, Glycine max
  Coding DNA Sequence Number=SeqID_18206
  Homolog annotation: Hit_ID=A7PFQ1; Match level="QueryCoverage=78%, HitCoverage=38%, E-value=2e-21, Identity=40%"; Hit description =Chromosome chr11 scaffold_14, whole genome shotgun sequence
MVKSKGHHHLCGTLFLPTPRSPIAHYKLEKEKIWRELEKEGIRREIIACEMAFAQRRELEDEVRKELELERTFRISMQRSDGITFREPISVSFNHSMGPLNNITMSGGLPFHLLSQASKQINKDKVIILNKPDDHCGEKRKAMTLAIDDNESLQKKSKKEWSCELCQISATSLKGLNDIQGKKHKANKESTRTQKIGLDSRPESETLHPCLTPPHMQTGI

SEQ ID NO: 109892 - protein, 56 aa, Glycine max
  Coding DNA Sequence Number=SeqID_18207
  Homolog annotation: Hit_ID=A5BKB9; Match level="QueryCoverage=100%, HitCoverage=4%, E-value=1e-10, Identity=48%"; Hit description =Putative uncharacterized protein
MDALEIYLNEEERQLDRKVKVVRSDRSDEYYKRYDEIGQHPGFLVRYFQRHLLKCE

SEQ ID NO: 109893 - protein, 95 aa, Glycine max
  Coding DNA Sequence Number=SeqID_18208
  Homolog annotation: Hit_ID=A0PAV3; Match level="QueryCoverage=40%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVAAQLLGRAIGAGLFAITPAGERGMCCKAIKLGNARVFPVTTL

SEQ ID NO: 109894 - protein, 94 aa, Glycine max
  Coding DNA Sequence Number=SeqID_18209
MTKLGLCVPTDTTVSEWQRGADNRKVSPRIIMTKLGLCVPTDTTVSEWQRGADNRKVSPRIMVSMTKIYGAADKSKALAPTYPPMRNSDLRSSG

SEQ ID NO: 109895 - protein, 217 aa, Glycine max
  Coding DNA Sequence Number=SeqID_18210
  Gene Ontology: Biological process=transposition, DNA-mediated
  Homolog annotation: Hit_ID=Q1J7G7; Match level="QueryCoverage=21%, HitCoverage=78%, E-value=2e-14, Identity=74%"; Hit description =Transposase
YDGVCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMFKTRGARYQLLFPLVRVNFELGVIMVIAVSFGKPVVPAALMNRPTRGERRFAYWALAECILAYYVGTDEGVSEVLHVAEKKGCTGASAEYVIQDIFRFLAH

SEQ ID NO: 109896 - protein, 89 aa, Glycine max
  Coding DNA Sequence Number=SeqID_18211
YLHYNTIATVSKPFCIAIYYLPAPHELVEGLARRTRPVCYQRATHRGTTMDDELPDNPNPNYYDIAAGSRGWSSEDAVEAGQWSIYSFH

SEQ ID NO: 109897 - protein, 74 aa, Glycine max
  Coding DNA Sequence Number=SeqID_18212
MTETVCMDKRLGISIRHLTSRVKMTESTEENIITCVSPHVVGLTGHDSKRWGGRQKRGFCSYVSSICDEELIPT

SEQ ID NO: 109898 - protein, 109 aa, Glycine max
  Coding DNA Sequence Number=SeqID_18213
  Homolog annotation: Hit_ID=A4WA34; Match level="QueryCoverage=85%, HitCoverage=90%, E-value=6e-29, Identity=70%"; Hit description=YebG family protein
  Pfam annotation: Domain name=YebG; Domain location=1-75; Score=125.3; E_value=1.8e-34; Accession=PF07130.3; Description=YebG protein
MAVETKYVVVRKGEEKMTFANKKDADAWDKMLDMADAFTDWLQQHQPAMDEAQAEALGMLLAEQKDAVQHILRTSKLPDAVKDSGETAADDSDTAVPEKEKKVRAVKAA

SEQ ID NO: 109899 - protein, 84 aa, Glycine max
  Coding DNA Sequence Number=SeqID_18214
MGAKYLEVVKRGSHPNNGWSPDEIRNEHNLSLRVVGHDRAWAARHGMTIICLCVTPGTIASGWRKGARNDYNLSPPTSRLTVPE

SEQ ID NO: 109900 - protein, 69 aa, Glycine max
  Coding DNA Sequence Number=SeqID_18215
MSRNFTDYLMMGVKYLEAVKRRLHATKQWSPDEIREDSEDSALIKVFLLVWGSNSKQQQLTVATGGLGW

SEQ ID NO: 109901 - protein, 70 aa, Glycine max
  Coding DNA Sequence Number=SeqID_18216
MGSKIYPKVHENPWAFFSSSSLSLLESSIQYPWGHTPLSKPLELVHKLSFIVGGNMPLPKGTPKITPILY

SEQ ID NO: 109902 - protein, 271 aa, Glycine max
  Coding DNA Sequence Number=SeqID_18217
  Gene Ontology: Mol. function=methyltransferase activity; Biological process=methylation
  Homolog annotation: Hit_ID=A6GXK9; Match level="QueryCoverage=95%, HitCoverage=66%, E-value=4e-75, Identity=50%"; Hit description =Probable modification methyltransferase
  Pfam annotation: Domain name=THUMP; Domain location=60-158; Score =58.1; E_value=3.1e-14; Accession=PF02926.8; Description=THUMP domain
  Pfam annotation: Domain name=UPF0020; Domain location=166-269; Score=- 9.7; E_value=4.5e-06; Accession=PF01170.9; Description=Putative RNA methylase family UPF0020
  Pfam module annotation: Pfam domain module=THUMP::UPF0020; Domain location=60-158::166-269
MDIENIKIQIKTFFGLEQILAEEIKKLGGRNVEVKNRAVNCEGDLGFLYKINYSARTALKILVPVFEFKAFNQHQFYDKLFKLEWEQFMDVDQSFAIDATVNSETFKHSQFVTLKMKDAIVDYFQEKFKKRPNVEPKSPDIKFHLHIDRELVTISLDSSGDPLFKRGYRKEQGEAPINEVLASGMLQLAGWDGKGNFLDPMCGSGTLLIEAAMIAMDLPAQIFRKRFAFQNWNNYDNDLFTKIKEFRINRVKEFQGKIVGYDIDGRMLNAA

SEQ ID NO: 109903 - protein, 70 aa, Glycine max
  Coding DNA Sequence Number=SeqID_18218
MAGGNLPTTKWVCHQMLAPLWHIRGEVRMRLKCGLGVLYVSPPWVEGPVHDQSGDVSSQWVWEQSYRHSH

SEQ ID NO: 109904 - protein, 138 aa, Glycine max
  Coding DNA Sequence Number=SeqID_18219
  Homolog annotation: Hit_ID=A0ST23; Match level="QueryCoverage=23%, HitCoverage=65%, E-value=1e-11, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPLIQDVFYLRVGKPVVPAALMNRPTRGERRFAYWALFRFLAH

SEQ ID NO: 109905 - protein, 92 aa, Glycine max
  Coding DNA Sequence Number=SeqID_18220
  Gene Ontology: Mol. function=5-formyltetrahydrofolate transporter activity; Cellular component=membrane
  Homolog annotation: Hit_ID=A7P0T7; Match level="QueryCoverage=84%, HitCoverage=15%, E-value=7e-33, Identity=84%"; Hit description =Chromosome chr19 scaffold_4, whole genome shotgun sequence
FMPFLILSGQLCPPGIEGTLFALFMSINNLGSTVGSFVGAGLASILNIDSGSFDNLLLGIIVHALCNFIPIAFLFLIPGTELEFVIMVIAVS

SEQ ID NO: 109906 - protein, 135 aa, Glycine max
  Coding DNA Sequence Number=SeqID_18221
AVHVSSTFEFGAVFHDCLSEDPQDNPPFSPFFGAHECHCLALFICPPLSSAKPLVTGKHKKKEGVETRVIITERAGRTKSVSYLCFPLISDERLARSVKFRNVAEIEKRPTWALQKIPPEGRCFWRKQPCSPGRA

SEQ ID NO: 109907 - protein, 135 aa, Glycine max
  Coding DNA Sequence Number=SeqID_18222
MECVKINTLWSGDIDCDGHGFEAKLLCHKDKPGIVDVNIGSTSIVMGFCLVSCFLLSNVNQALWPSGFFLQKAVASGGSNLAHLGELGGKLLPYFAINRGRNEEGKGSTFLALRIFLKLLRKIVSVKKIQAEALP

SEQ ID NO: 109908 - protein, 98 aa, Glycine max
  Coding DNA Sequence Number=SeqID_18223
  Subcellular localization annotation: CTP_CleavageSite=41; ConfidenceScore=5.01e-01
MYCTPSPAHQTFCQTGKLVNATSHEWMTNLFGVNLNTPNFMTSYLASLQQFDAPYSFGEQGKSSLATTTHTEYTDIEQQHHHHEGEPVIHERRNPRHN

SEQ ID NO: 109909 - protein, 149 aa, Glycine max
  Coding DNA Sequence Number=SeqID_18224
MTIEESRHVTFDETNITSPRKEFVDDIADTLEDSQNEERNLKRKRDEEDKDDQDDTAQENDNLPKEWKTSRNHPLDNIIGDISKGQSVASGGSNLARLGELGGKLLPYFAINRGRSEEEKGSAFLAFRILLNLLRKIVSVKKIQAEALP

SEQ ID NO: 109910 - protein, 122 aa, Glycine max
  Coding DNA Sequence Number=SeqID_18225
  Homolog annotation: Hit_ID=A6FJQ2; Match level="QueryCoverage=31%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRYTVIHRIRDNAGKN

SEQ ID NO: 109911 - protein, 231 aa, Glycine max
  Coding DNA Sequence Number=SeqID_18226
  Homolog annotation: Hit_ID=UPI00006A2D9E; Match level="QueryCoverage =57%, HitCoverage=85%, E-value=1e-11, Identity=18%"; Hit description =UPI00006A2D9E related cluster
MSSPSEDYTSSPSEGCTPSPLEDYTSSPSEDYMSSPLEDYTSSPSEGCLPSPSEDYTSSPSEGCTPSPSENYTSSSSEDYIGLCILAIRGLRALTFRGLHVLTFRGLHALTFRGLHVLAFRGLHALTFRGLRVLAFRGLHVLAFRGLHVLTFRGLHALTIRGLHAFAFRGLHVLTFKGLHALAFRGLHALAFRLHTLSFRGRHVLAFRGLHTPSPLEGYASSLSVGSISMP

SEQ ID NO: 109912 - protein, 310 aa, Glycine max
  Coding DNA Sequence Number=SeqID_18227
  Gene Ontology: Mol. function=motor activity; Cellular component=cell projection
  Homolog annotation: Hit_ID=UPI00006A2D9E; Match level="QueryCoverage =92%, HitCoverage=86%, E-value=1e-18, Identity=17%"; Hit description =UPI00006A2D9E related cluster
MTVSLDESISSFLIRVDPWVLVPIAFRGLHVLTFRGLHALAFRELHVLTFRGLHALAFRGLHVLAFRGLRVLTFRGLHVLAIRGLDVLAFKGQHVLAIRGLHALTFRGLRILAIRGLHALTFRGLHVLAIRGLHALTFRGLHVLTIRGLHALTFSGLHVFAIRGMHTFTFSGLHVFAIRGMHTLTFRGLHVLAFRELHAVTFRRLHALAFRGLHALAFRGLHILTFRGLHVLASIRLHVLAFRGLHVLFFNGLHALAFNGLHALAFRGLHILAIKGLHVLAFRGFHVLTFRGLLTLIFRGLYVLPLRGLH

SEQ ID NO: 109913 - protein, 118 aa, Glycine max
  Coding DNA Sequence Number=SeqID_18228
MKAQVEKDEGPEAETLSRLLIAAEGPSNPCGVYPDLSSLTGSGVYPDLSSFIGSGVYPDLSSLTGSGVYPDLSSFTGSGVYPDLSSFTGSGVIQTFVTCIKRSAPTHVHIIWYQSFGS

SEQ ID NO: 109914 - protein, 82 aa, Glycine max
  Coding DNA Sequence Number=SeqID_18229
  Subcellular localization annotation: CTP_CleavageSite=41; ConfidenceScore=5.53e-01
MAEPSKKRKGSSSTAAAAAHRRHGPSEASTAPTHPSLSSPRSSTLFSSDDQRLRYLSQFSSRIILDPKYLDVEFFNDGGSSR

SEQ ID NO: 109915 - protein, 283 aa, Glycine max
  Coding DNA Sequence Number=SeqID_18230
  Gene Ontology: Mol. function=nucleoside-triphosphatase activity; Cellular component=cytoplasm; Biological process=response to DNA damage stimulus
  Homolog annotation: Hit_ID=Q6D1S8; Match level="QueryCoverage=90%, HitCoverage=75%, E-value=1e-122, Identity=83%"; Hit description =Protein recA
  Pfam annotation: Domain name=RecA; Domain location=1-257; Score =563.7; E_value=1.8e-166; Accession=PF00154.12; Description=recA bacterial DNA recombination prot
MGRIVEIYGPESSGKTTLTLQVIAAAQREGKTCAFIDAEHALDPVYARKLGVDIDNLLCSQPDTGEQALEICDALARSGAVDVIVVDSVAALTPKAEIEGEIGDSHMGLAARMMSQAMRKLAGNLKQSNTLLIFINQIRMKIGVMFGNPETTTGGNALKFYASVRLDIRRIGAVKEGDERAPFKQAEFQIIYGEGINTFGELVDLGVKHKLVEKAGAWYSYNGDKIGQGKANATNFLKENPAIANELDVKLRDMLLTGATAEAATADSAADKYEEASETNEDF

SEQ ID NO: 109916 - protein, 91 aa, Glycine max
  Coding DNA Sequence Number=SeqID_18231
MIFHLRLVMSFKTKNGEHRLKRAIKGFNLQPFDPKIDRTFHRLVRHSVHPDHFEHFVHFVHSEHSVAGDSEHSDFEHSAANFHTENMAQPP

SEQ ID NO: 109917 - protein, 20 aa, Glycine max
  Coding DNA Sequence Number=SeqID_18232
TCKGLLQDSGTLKRVAWGLD

SEQ ID NO: 109918 - protein, 191 aa, Glycine max
  Coding DNA Sequence Number=SeqID_18233
AEHQQRFEAIKGWSFHKERRVQLREDEYPDFQGEIARRHRAQLVTSMAKFDPEIVIEFYANAWPTEEEVRDMRSWVRGHWIPFDADAISQRSQADGFDEEAIAQLLCIPGQDFARTAAGRWVRIMRTSMTTLTQIWMTLLLSNVLSSNHNFDLPLPKCQLVYVILTQMSVHVAQVIADAIYLFAGMAPTRL

SEQ ID NO: 109919 - protein, 128 aa, Glycine max
  Coding DNA Sequence Number=SeqID_18234
MMNESGAPAIEWSYGGRGDDISSSLSLDTVEEQPQGFLMTVDRPVQIFKDALSPMMAFVTLLRPLYAKTSEGFQYVPVNAGLFFHGAKPTHYKDRDGQMKPIDGGTLLQHITVLHQVAQPLGPGEGAV

SEQ ID NO: 109920 - protein, 119 aa, Glycine max
  Coding DNA Sequence Number=SeqID_18235
  Homolog annotation: Hit_ID=A5ASG5; Match level="QueryCoverage=84%, HitCoverage=8%, E-value=6e-10, Identity=35%"; Hit description =Putative uncharacterized protein
MELDFIQRHVKGNDICDDPFVFASQAKKVFYVENKTQNGWLVVVHAKIRDVYDMGDEQSNDTDQGNEQVLQEINHNDLIRPEADDSDDIIEVTIPMENILPHNKDDNYIDDDESDADFF

SEQ ID NO: 109921 - protein, 80 aa, Glycine max
  Coding DNA Sequence Number=SeqID_18236
MNLFPETDIMKQRVHLTSLEFPQFQGNLRIEKGLGECQQLKGIAHFHFILRIGVEGQRKNMEKNNVSKDRRAYKQKEKER

SEQ ID NO: 109922 - protein, 159 aa, Glycine max
  Coding DNA Sequence Number=SeqID_18237
MGSSQKPSLKKRFYQVKIKSLEVTSLRKLGQLMGQLQRQAFHKAYGKIWDLARDFQLVPTVKEFEEILGCPLGGRKPYLFSRFYPSTTRVAKYQGSVWRKGQRPWKIKANGLSFIDILALLIFGVVLFPNMEGLVDLAVIDAFLAFHHGEESPVIAILA

SEQ ID NO: 109923 - protein, 237 aa, Glycine max
  Coding DNA Sequence Number=SeqID_18238
  Gene Ontology: Mol. function=oxidoreductase activity; Cellular component=mitochondrion; Biological process=ATP biosynthetic process
  Homolog annotation: Hit_ID=A9IQN6; Match level="QueryCoverage=97%, HitCoverage=49%, E-value=1e-123, Identity=96%"; Hit description =Putative oxidoreductase
  Pfam annotation: Domain name=FAD-oxidase_C; Domain location=73-235; Score=25.6; E_value=8.6e-09; Accession=PF02913.10; Description=FAD linked oxidases, C-terminal domain
MAATRASGTNAVRYGTMRENVMSLTVVTADGRIVRTAGRARKSSAGYDLTRIFVGSEGTLGIITEVTVRLYPQPEAVSAAVCNFPTLDAAVQSVIEIIQMGVPVARVEFMDAASVRAVNLHSKLTLRETPLLVFEFHGSPAGVQEQAETVQAITAEHGGMDFEWAERPEDRSRLWTARHNAYFAGLQLRPGCRASTTDVCVPISRLADCVRDTVEELDRASFPYTIVGHVATAISTC

SEQ ID NO: 109924 - protein, 130 aa, Glycine max
  Coding DNA Sequence Number=SeqID_18239
MQSIWAHEIQLSCLQKKNEKSDKRNFKEKKEKKGYITWEDNVINYSSDSEKKIISLGIMMKDYVNGEEQSRYIDSNFSKHMACIKVYSHFFPRKLEVGNGSYWKLKVENGSLKLKVGRGSYWKLKLEVGS

SEQ ID NO: 109925 - protein, 200 aa, Glycine max
  Coding DNA Sequence Number=SeqID_18240
  Gene Ontology: Mol. function=kinase activity
  Homolog annotation: Hit_ID=P0ACY5; Match level="QueryCoverage=92%, HitCoverage=28%, E-value=2e-96, Identity=95%"; Hit description =Uncharacterized protein yeaG
  Pfam annotation: Domain name=AAA_PrkA; Domain location=19-199; Score =116.2; E_value=1e-31; Accession=PF08298.2; Description=PrkA AAA domain
MNIFDHYRQRYEAAKDEEFTLQEFLTICRQDRSAYANAAERLLTAIGEPVMVDTALEPRLSRLFSNRVVARYPAFEEFYGMEDAIEQIVSYLKHAAQGLEEKKQILYLLGPVGGGKSSLAERLKSLMQRVPIYVLSANGERSPVNDHPLCLFNPQEDAQILNKEYGIPNRYLGTIMSPWAAKRLHEFGGHFGAGGESGYP

SEQ ID NO: 109926 - protein, 107 aa, Glycine max
  Coding DNA Sequence Number=SeqID_18241
MGEVEGGTREDEGRHGGHERANGRNDGGHDDHEEDNGSQCAMVGKDLGSTGGPHDVQIQNEHAFPPYGLPLNYTPPNVAYTPNKNVNNSTPIPIESQQPQTDHAHVS

SEQ ID NO: 109927 - protein, 169 aa, Glycine max
  Coding DNA Sequence Number=SeqID_18242
MAKFDPEIVLEFYANAWPTEEGVRDMRSWVRGQWIPFDADAISQLLGYPLVLEEGQECEYGQRRNRSDGFDEEAIAQLLCIPGRDFARTAAGRRVRIMRTNMTTLTQIWMTLLLSNILPSDHNSDLPLPKCMAPTRHPLDPDKSNRALGFPALITGLCQSFGVPVAPTK

SEQ ID NO: 109928 - protein, 166 aa, Glycine max
  Coding DNA Sequence Number=SeqID_18243
MNALSIAVALSAFIFFVELSVELAKYGSSFMKMNQAILMMPKAQVIDSRLQDQASRIQSKIQDSREEIKKQQVKTSYRIIGSNRLPVVATYLSAGGRRGACGCVFQGRKMCGAATNIYLRKTSEKPEKVWSTNFNRERFGSCFYARGRVFPSLLRILNYDEEIRPM

SEQ ID NO: 109929 - protein, 278 aa, Glycine max
  Coding DNA Sequence Number=SeqID_18244
  Homolog annotation: Hit_ID=A5AZ88; Match level="QueryCoverage=56%, HitCoverage=17%, E-value=2e-09, Identity=28%"; Hit description =Putative uncharacterized protein
MGKGKLELSVEDQKISFNLFEAMKHPDDSEACFEEDTLEQEMELTASAMVLQSPLEEESNNVIECLVSENEGEELACIEELDGPEDKSAGHVMFEAFENNRPMEKPKVELKTLPVHLNQLHARETTSKKAESNNERRSKEGVLKLLEAGLIYPISDGSWAIFLLFLRWIFGLQSNCSGPSGPRKDSFHMPLWCIFLSSHAHFGCGETERELSLTRKPSCGAFDEIFRDYEEASLLWRAKPSVGSSYGVLDYSILVCLCLDHVTACLVRVTHIGKWFNP

SEQ ID NO: 109930 - protein, 80 aa, Glycine max
  Coding DNA Sequence Number=SeqID_18245
MSLPSAVHVFSIIKREASGDWETRSSVVFGIGSFAKYVYMYIIFVVLKKEEVEARVVITERAGRTKSVSYLCFPLISDER

SEQ ID NO: 109931 - protein, 150 aa, Glycine max
  Coding DNA Sequence Number=SeqID_18246
  Homolog annotation: Hit_ID=Q51617; Match level="QueryCoverage=27%, HitCoverage=59%, E-value=1e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPECVAVEKEKCKSERRRGKCGGGG

SEQ ID NO: 109932 - protein, 120 aa, Glycine max
  Coding DNA Sequence Number=SeqID_18247
  Homolog annotation: Hit_ID=A4W701; Match level="QueryCoverage=96%, HitCoverage=64%, E-value=3e-20, Identity=44%"; Hit description =Putative uncharacterized protein precursor
AFQFQRANEISNAVTQYGINTDAATQGKEIEYRTILKKQPTCDLAVPAAIAGGLLDYTYRLRSRAMSANTGDADATGTGATASSTLTYCQAVLWIAPLLAALDKANNQMLEIRKLDMMLR

SEQ ID NO: 109933 - protein, 96 aa, Glycine max
  Coding DNA Sequence Number=SeqID_18248
  Homolog annotation: Hit_ID=A6FJQ2; Match level="QueryCoverage=39%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLDGSSQSISFLNLVDFGRPFARIVIGSGISVHGSSEGEIAASFPRGHHCAK

SEQ ID NO: 109934 - protein, 270 aa, Glycine max
  Coding DNA Sequence Number=SeqID_18249
MPISPCGSINWSVSFRRRDRAQKTPSRPGEVQQGPGVSSYGYGPLSVLQGARPPQQGIAPTRHPVDPEKSNRALGGSAHKTPSGPEGAQQGPGVSSMGLCQSYRAPIPPPSSCHRDIGIVPVRHPVDPEKSNRALGGSAHKTPSGPEGAQQGPGVSSMGLCQSYRAPIPPPSSCHRDIGIVPARHPVDPKKANRVLELPALITGLFQFCGVHVAPSKVIRLPTNRAFIKKYCAPRQAQRETPQQPRDDRQWATNTLRPPLEFTSAHPQKG

SEQ ID NO: 109935 - protein, 25 aa, Glycine max
  Coding DNA Sequence Number=SeqID_18250
MDEINGDVEKEEKVVLDFPVHDSNV

SEQ ID NO: 109936 - protein, 83 aa, Glycine max
  Coding DNA Sequence Number=SeqID_18251
MLLEYLVFCLCPVLLGLLERIDGDPALRGTRIRATWEYVSSIGGGQQGMVGLYVICGCGELSCTIARPPPSTTCDGYPIILQA

SEQ ID NO: 109937 - protein, 106 aa, Glycine max
  Coding DNA Sequence Number=SeqID_18252
DAGSRQARQGASAGVGGCRGWLNYAASEQIVLRVHHMRAIGAGLFAITPAGERGMCCKAIKLGNARVFPVDSRGSPPAFPAFSSGEESDPEGIRNDHVQGSFHGQP

SEQ ID NO: 109938 - protein, 87 aa, Glycine max
  Coding DNA Sequence Number=SeqID_18253
MGILRLFIPLVIDYTNLELACLGTSQVLTDRPCPGWVGIGQAWFWAIAPHLTSPRSPDPCDISPGTTLWSTNKSRKFHPSTLPHLKL

SEQ ID NO: 109939 - protein, 108 aa, Glycine max
  Coding DNA Sequence Number=SeqID_18254
MPSSFTDLVFAGERIEEGLKRGKFDYVSSTSTHAKRIGATGAKRKEGDTHAVTSAPAWVKPPQTSHGTHQYAQHHPAFQFAPGTPPIQHPCSLRHPSRGRPPKFRLQP

SEQ ID NO: 109940 - protein, 148 aa, Glycine max
  Coding DNA Sequence Number=SeqID_18255
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSHENAMHGAPKKRARMEDCTRGSSLVNHEA

SEQ ID NO: 109941 - protein, 70 aa, Glycine max
  Coding DNA Sequence Number=SeqID_18256
MRLSMIDGKYECAYNNKGDPKAPLELVGLGSSSSMDSFASWKMNDSGMEKEEREEMPLQGEDESRRRSPP

SEQ ID NO: 109942 - protein, 131 aa, Glycine max
  Coding DNA Sequence Number=SeqID_18257
MESKPIESATAGTLKLHFKVRVNLLADSISPESAQGPNQKRSFFLRYTGIGSILSGKKAYRRNRALEFIPPGDSSPGPVVELDPRPTPIEIFPCAVQVNFALEGIPGSSELQPEEVGSGSWYRYKKASRAK

SEQ ID NO: 109943 - protein, 169 aa, Glycine max
  Coding DNA Sequence Number=SeqID_18258
  Gene Ontology: Mol. function=nucleoside-triphosphatase activity; Cellular component=plasma membrane; Biological process=carbohydrate transport
  Homolog annotation: Hit_ID=A6T627; Match level="QueryCoverage=96%, HitCoverage=81%, E-value=7e-41, Identity=39%"; Hit description =Putative ABC transporter
  Pfam annotation: Domain name=ABC_tran; Domain location=1-145; Score =31.2; E_value=2e-09; Accession=PF00005.18; Description=ABC transporter
MALGMALVPEDRQAEGLVQMMSIKANMTLASLGRNALRPLASAGECALVDGMIEKLAIKVSDRELPITSLSGGNQQKVVLGKALLTGPQVVFLDEPTRGIDVGAKTDVYHLIGAMARQGLAVMFSSSELDEVVSLADRVMVMADGKLTADLPRERADRETLIRASTPHA

SEQ ID NO: 109944 - protein, 294 aa, Glycine max
  Coding DNA Sequence Number=SeqID_18259
  Homolog annotation: Hit_ID=UPI00016621D1; Match level="QueryCoverage =82%, HitCoverage=39%, E-value=8e-16, Identity=31%"; Hit description =UPI00016621D1 related cluster
MSSPSEDFTSSALEDYTSSPSDDYTSSPSEDSKGLHILPFRGLSVLTFRGLQVLGFRGLHVLTFKGHHVLDFRGQHVLTFRRLHILALRGPHALAFVGLRVLSFRGLHVLDFRGLHILTFRGLHVLTFRGLHTLAFKRLHALAFRGLHDLAFRRLDILAFRVLDVLALTTTHPHLQRATLPRLGGLRALAFRGLRALAFRGLRALAFNGQQVLTFRGLHIPPFRGLHALTFGGLHVLAFKGLHALAFRGLHVLAFRVLQALAFIGLHVLAFVGLHALAFRGSHVDAILPPKGIG

SEQ ID NO: 109945 - protein, 148 aa, Glycine max
  Coding DNA Sequence Number=SeqID_18260
  Subcellular localization annotation: CTP_CleavageSite=73; ConfidenceScore=5.24e-01
MGNLQRQGYNQGGFSGFQQGPYNQQGQWRSHPGNQFNKDQGGPSNRSPQQGPNIFQRTTKLEETLAQFMQVTMFNHKSTESALKNLEIQVGQLAKQLAEKSSNNFGANTEKNPKEECKVVVTRSRKLVAAKDEDVVALKKQVSFKDTT

SEQ ID NO: 109946 - protein, 138 aa, Glycine max
  Coding DNA Sequence Number=SeqID_18261
NIAKRLFARANSCRVLANKLPALMEEAGSAAVRVIDLFTLGVERDSAVNAVIAEAGKWRVPASDRIAFQTLPARIGFPGGAKQDKGREQAADQPYCAPARINQCGTDEEAGYHIDLEAHTGAVINNPRFAPVDIAIAP

SEQ ID NO: 109947 - protein, 133 aa, Glycine max
  Coding DNA Sequence Number=SeqID_18262
MWQAEIPYGRLHLLSIEANEFDGIRMMLFLLSSSGDIQARRRTRFFFAGRGRSSSIAWGNVVVIPLYHFTLVVRGPLFGGIQPSLDRLKGVPTEGGAFWWKQPYSPGLAELTWANWAATTSLFSPINKGKRAD

SEQ ID NO: 109948 - protein, 44 aa, Glycine max
  Coding DNA Sequence Number=SeqID_18263
MEIQAEENRANQKVEGFKQQLVDELALELVDDLVELEEIVEKAE

SEQ ID NO: 109949 - protein, 202 aa, Glycine max
  Coding DNA Sequence Number=SeqID_18264
  Homolog annotation: Hit_ID=A2Q168; Match level="QueryCoverage=56%, HitCoverage=9%, E-value=6e-07, Identity=28%"; Hit description=RNA -directed DNA polymerase
MVENISSSRFPHGKTPKSKIFSPDLASSSPCRSLPELYFGGCWKETLIRSIFSEHDAQQFLGIPLRMFPDQDRVVLKYSEDGWGVHGKIRIPCDNEEYGKSSKHSPVLFLDFFWKDILSVIVAPKRRNLVWRTRKGIVSVRKTLRRKIQVLDPISPAAERMKRQLNPASCIVKRSNKYGLQISWGNLWEISAHRLILGWYDA

SEQ ID NO: 109950 - protein, 118 aa, Glycine max
  Coding DNA Sequence Number=SeqID_18265
MKSIPWRSPNSCSSTAESNPGGVNHETASGRELKEQNPLVVVVKVVHSPPLEPLLRLLIIDEQRHIEVAGGKGIEVDDAVEELRRIVVPPRDEADDHHAVGGTREKCAIKYSKIPNLF

SEQ ID NO: 109951 - protein, 110 aa, Glycine max
  Coding DNA Sequence Number=SeqID_18266
MHPPPTYSKPHELIVVHASSTVESEAPRIDCIALFVHPPPSNLIRSPFVATYPSAGGRRVTRGMRVPRKEYAGSRHQRLFEENVGKTGKDAIYELLSERFGSCIYARGRY

SEQ ID NO: 109952 - protein, 51 aa, Glycine max
  Coding DNA Sequence Number=SeqID_18267
MMRLHCYQASRGPSMTTDRPLLPMANTDLGIGTNISKCVQKVWVSCVNGAT

SEQ ID NO: 109953 - protein, 78 aa, Glycine max
  Coding DNA Sequence Number=SeqID_18268
MTCDHSLVLVRCLAPIIRQFVKFQDMPKKPKNIDAQSAHLALRIFLQKRLLLEEATGSPGRAELAWASWAATTSPILL

SEQ ID NO: 109954 - protein, 74 aa, Glycine max
  Coding DNA Sequence Number=SeqID_18269
MREKERKPQEANINLPYFHGKDNVEANLDWEIRVEQQLKRKSTSKSYGSHSYPKKDQGQGILGVRPSKPKEKVN

SEQ ID NO: 109955 - protein, 74 aa, Glycine max
  Coding DNA Sequence Number=SeqID_18270
  Homolog annotation: Hit_ID=B0HC01; Match level="QueryCoverage=47%, HitCoverage=74%, E-value=3e-12, Identity=100%"; Hit description =Putative uncharacterized protein
MRKRTLPKEKGGQGGGAYGKTPATRPFYGSWPFAGLLLTCSFLRYPLILWITVLPPLSELIPLAAAERPSAASQ

SEQ ID NO: 109956 - protein, 70 aa, Glycine max
  Coding DNA Sequence Number=SeqID_18271
VPSGVANCRNMPFCGRAKARLTGALSKGGKMHGVATNEGISTSYVDKSGALAPTYPPSKRKSDLRSSFLR

SEQ ID NO: 109957 - protein, 59 aa, Glycine max
  Coding DNA Sequence Number=SeqID_18272
MVHDIFVKVNLEVTRSSTILNVFGSRRSSDRKMQGSRMSEHENKRYAVCRTKSMLNAYA

SEQ ID NO: 109958 - protein, 248 aa, Glycine max
  Coding DNA Sequence Number=SeqID_18273
  Gene Ontology: Mol. function=aminoacyl-tRNA ligase activity; Cellular component=cytoplasm; Biological process=tRNA aminoacylation for protein translation
  Homolog annotation: Hit_ID=A7ZJW2; Match level="QueryCoverage=97%, HitCoverage=56%, E-value=1e-126, Identity=91%"; Hit description =Seryl-tRNA synthetase (EC 6.1.1.11) (Seryl-tRNA(Ser/Sec) synthetase)
  Pfam annotation: Domain name=Seryl_tRNA_N; Domain location=1-59; Score=-6.1; E_value=0.0094; Accession=PF02403.13; Description=Seryl -tRNA synthetase N-terminal domain
  Pfam annotation: Domain name=tRNA-synt_2b; Domain location=124-248; Score=64.9; E_value=2.7e-16; Accession=PF00587.16; Description=tRNA synthetase class II core domain (G, H, P, S and T)
  Pfam module annotation: Pfam domain module=Seryl_tRNA_N::tRNA-synt _2b; Domain location=1-59::124-248
AERNSRSKSIGQAKARGEDIEPLRLEVNKLGEELDQAKAELDVLQAEIRDIALAIPNIPDDSVPVGKDENDNVEVKRWGTPREFDFEVRDHVTLGEMHAGLDFAAAVKLTGSRFVVMKGQIAHLHRALAQFMLDLHTEQHGYSETYVPYLVNHDTLYGTGQLPKFAGDLFHTRPLDEEADSSNYALIPTAEVPLTNLVRDEIIDEDDLPIKLTAHSPCFRSEAGSYGRDTRGLIRMHQFDRLRWCRSF

SEQ ID NO: 109959 - protein, 127 aa, Glycine max
  Coding DNA Sequence Number=SeqID_18274
MKNEERRTKNERRTNEERMKNGEEQQKTFTDLLTETSRKRYGRKVGRRLPPSSPRRAGLLPPEAIQLRKILWKTHFKISKLLFAPPILIWLWKFYESITGIPKAHFLTKQGRWLPPSSPRRARVLPP

SEQ ID NO: 109960 - protein, 82 aa, Glycine max
  Coding DNA Sequence Number=SeqID_18275
  Subcellular localization annotation: CTP_CleavageSite=38; ConfidenceScore=5.27e-01
MLGFTSDSPQISASPHQLDFAPYASGPYMISTRYVRVVSSEKWRLRKPSRGMALVDNWVVDKENGCYWLSNDIVGLVGNLAM

SEQ ID NO: 109961 - protein, 145 aa, Glycine max
  Coding DNA Sequence Number=SeqID_18276
  Subcellular localization annotation: CTP_CleavageSite=53; ConfidenceScore=5.54e-01
MATPPASPPPPLPPPPADASASSSMLKQTHKATWLRSLVTRPPGAERPVVNIDLATGKANGPHKKKLRTYLGIVTRDKVDVTYETLKEVPAAQKDLIWEDIQLKSDLTRKWALAVNKDGVDDIDVRKKAQAIQKQNTAPNVLSRG

SEQ ID NO: 109962 - protein, 252 aa, Glycine max
  Coding DNA Sequence Number=SeqID_18277
DSFEEQATQGSFVPHGRQDVLTTAIGRPEHPGRVRAAGAGVTIKYYFGSAPWMSCTSSSLPSEELQQLTQQIRDQLEESITERVTRQSQMQSQGLTMPPNPLVGPSGPRVRTKGSCVDPSGNDPETGDSDRCDLYIEADPARLVSMGRVYEGSTVVHNTPLLPGQVKVSVEEVTHADAPVPVPTDEVVVSPAKPPPKPDPEVDDPLYLMTLTIPKLFLRPYQVTWDATVFGVFNPDFPLYIKHEDLSEITHG

SEQ ID NO: 109963 - protein, 79 aa, Glycine max
  Coding DNA Sequence Number=SeqID_18278
  Pfam annotation: Domain name=zf-CCHC; Domain location=51-68; Score =28.2; E_value=3e-05; Accession=PF00098.14; Description=Zinc knuckle
MQEENEEEESEDEEDFSLFFKKFQKFVKKRRIERCQNFNNGKRSQEDSQILRCYKCNQLGHIITNCPSNEEWPEKSDKK

SEQ ID NO: 109964 - protein, 565 aa, Glycine max
  Coding DNA Sequence Number=SeqID_18279
  Gene Ontology: Mol. function=DNA binding; Cellular component=nucleus; Biological process=regulation of transcription
  Homolog annotation: Hit_ID=A5AZN6; Match level="QueryCoverage=70%, HitCoverage=86%, E-value=5e-50, Identity=33%"; Hit description =Putative uncharacterized protein
  Subcellular localization annotation: CTP_CleavageSite=53; ConfidenceScore=5.06e-01
MDSDISQWVTEFLLRSSVPDSLIQKTLAALPLSTASPRLKKTLLLRTLQTLLRTATLSETALDILELLEPSAPVSDAHRRAYCAVAVECTVKYLAACPEDIDGEYAGAVRRIWRGRVSALKARWSRLVSGELARWRDVVEDAFGDSRARQRLVGLNSRRDAMKEVRVFLKEAWGAMGPSFLETVAAKEKNKDEGARDNDDNDNICDDHDDGACMEDVAMHGENQEPLEESVDANQEVGGFDLSPRRDKAIPKRNSQLKHKHSAFRASHRGRGVEISSPKEVKATKSWSKHDPVPSAEVKKVRESLKSSSLELRALVKDPLPHALHISDVVRSKLATSDTKTEPLIENQHEDVEVQDPDVCQSIVPFQPNDVNLGKKSFVHCSNIHQPYLMEQNISARTFEDGVLVKKSCKQLQYNVTGIAAIAIMMWKPQFETLLPLDPVAYGFHMWIHKDNIDHADVGGFSRQLATSKTAKEEEKEMEFVGRRNTKGWGSVLGCNPPLKLAAKVERGVGGRKDSVANGNGDTPPGAASPSGGIGHVGLAHGAGETAMLHVNLAGLQLFRLAGFK

SEQ ID NO: 109965 - protein, 58 aa, Glycine max
  Coding DNA Sequence Number=SeqID_18280
VEGSNPEYQEPWDLRSNPFQGKLLKEASQGSFSRKFLKEAYFSRKFLKKASQGGELSY

SEQ ID NO: 109966 - protein, 330 aa, Glycine max
  Coding DNA Sequence Number=SeqID_18281
  Gene Ontology: Mol. function=nucleic acid binding
  Homolog annotation: Hit_ID=Q5XM22; Match level="QueryCoverage=34%, HitCoverage=82%, E-value=7e-43, Identity=64%"; Hit description =Resistance-like protein HAAS-2
MARTRGIGRAIGRLVGRDKPDDQDAADVPEGRRPTASARRQRGADRAEGSDADDTAEGLPGGPRDPSVLTSFADHVAHVVWSGQERPDLKLVSHGRKVTLIGRPVPEIEGLVGATGLSPLIDCSVTTGDPGLISAFVERWHSKTSTFHLPFPCSFYGGGQIYADRVAGGWVRDIYETRCQARQWIVAARAYLLHLVGCTLFANKSATYVHVVHLDAFRDLAHSGGYAWGVAALVHMYDQLDEACRAPTRQLAGYLTLLQHFPSVHQCVTDDTYQETSPRASQWLTSKAHMKGITGAPYRAHCDGLTVTDVSWLPYTEHRGVRAFQEISSF

SEQ ID NO: 109967 - protein, 226 aa, Glycine max
  Coding DNA Sequence Number=SeqID_18282
MMQSYPARALDRRLQEDWARDAREGLRVLMSLRTHLLLEVASPFIFLLLHSAAIRSQEAKKSIDEEDPRSTSSTWSYITPPPCQKVNFYVERTIYVPKINIQRVAHKKCVLQPRRQASPSPNQERAWQPNLLAPNYQLSQLYLTKQTVKWRNCPSGILLPEEGSSGIIPEKPFPEAFRKNLLPEEEFVIFGSTQKLLPEERHPECFRKKLLPEYINLLPEEGSSGS

SEQ ID NO: 109968 - protein, 149 aa, Glycine max
  Coding DNA Sequence Number=SeqID_18283
  Homolog annotation: Hit_ID=A7QAJ6; Match level="QueryCoverage=38%, HitCoverage=16%, E-value=9e-09, Identity=44%"; Hit description =Chromosome undetermined scaffold_71, whole genome shotgun sequence
ITDIRPDPDLDPDPLGIIEEEKDLELPLLYFDLLSDLNSAINEDTKSSSPSPIDPTPSPIQADLTPSPSPINVDHTPSPHEDEVNNVEAKEEYGQTFLTPKMVQGKQELGAGTYDAEYAREELAKTIIMHEYPLSIMDHLGFRRYSVTL

SEQ ID NO: 109969 - protein, 221 aa, Glycine max
  Coding DNA Sequence Number=SeqID_18284
  Gene Ontology: Mol. function=sequence-specific DNA binding; Cellular component=nucleus; Biological process=regulation of transcription, DNA-dependent
  Homolog annotation: Hit_ID=A7PRH7; Match level="QueryCoverage=90%, HitCoverage=88%, E-value=4e-27, Identity=36%"; Hit description =Chromosome chr14 scaffold_27, whole genome shotgun sequence
  Pfam annotation: Domain name=SRF-TF; Domain location=9-60; Score =46.9; E_value=6.9e-11; Accession=PF00319.9; Description=SRF-type transcription factor (DNA-binding and dimerisation domain)
MPRTKVKIAFITNDAARRAAYRKRKKGILKKMEELSTLCGIEACAIAYSPYDPEPVIWPSELGVHHVLGKFRTMSEWEKNKKMANQESFLGHMIAKHKEQLKKLVKENKEKEMTVFMHQCLDEGRVLPDNNLTADDLNDLSSIIEQNLKDVCRRLETLNVMEKTPPHQQPPQIQSSPVLDMSANHDQKQKKFMDLLNGNEDETTTVPPFESDANLQLQIGF

SEQ ID NO: 109970 - protein, 190 aa, Glycine max
  Coding DNA Sequence Number=SeqID_18285
  Gene Ontology: Mol. function=translation release factor activity, codon specific; Cellular component=cytoplasm; Biological process =translational termination
  Homolog annotation: Hit_ID=A7Q103; Match level="QueryCoverage=35%, HitCoverage=17%, E-value=5e-20, Identity=75%"; Hit description =Chromosome chr7 scaffold_42, whole genome shotgun sequence
MEWDNNYDLSGYKEEEGFIFNDSDDAGPLLFPFPVAEDLLQTTPCGFDVTDVHEPEGEIKKRLMRMLLVGTMNVVKVYHERAHFNPNNKEHGAPKDEHRHATNCSNFAVLSENEDLMVLRQLEASPSEYARANKELRKLSGFMDLIKELKAKQKEIDGLMSLMAECFEDKDMLNTATEEMGQAVEEERRL

SEQ ID NO: 109971 - protein, 218 aa, Glycine max
  Coding DNA Sequence Number=SeqID_18286
  Homolog annotation: Hit_ID=A7PZL1; Match level="QueryCoverage=86%, HitCoverage=54%, E-value=2e-43, Identity=48%"; Hit description =Chromosome chr15 scaffold_40, whole genome shotgun sequence
MKSLCESHNDIRTLMTALELPHVSSRNPRIEKCNSMLDNLVGSLDLLKVKIFSKGKVLMQAMYGVKVETAFICRVFTAAFSGSSKKLSDLNVADIHSWAPDFRRLRNLVIEEIRVRFSGGKFTVLNELEVVDASVKILYPTIQAGVDTVETDWLVKTIEELRAGAEKLSQGIDLLAKGVYGFFQAVITSRDTLLSSVRFDKTVNDRSPGRNRDMQVVH

SEQ ID NO: 109972 - protein, 78 aa, Glycine max
  Coding DNA Sequence Number=SeqID_18287
  Gene Ontology: Mol. function=protein transporter activity; Cellular component=cytoplasmic vesicle; Biological process=intracellular protein transport
  Homolog annotation: Hit_ID=A9PF13; Match level="QueryCoverage=50%, HitCoverage=8%, E-value=2e-12, Identity=89%"; Hit description =Putative uncharacterized protein
MNVSRQASGLGIALSTTITFGDLITVLVVSVAHFLESRGMIEDALKVATDPDYRFDLAIQLGKLDVAKVCDRGRTEIK

SEQ ID NO: 109973 - protein, 177 aa, Glycine max
  Coding DNA Sequence Number=SeqID_18288
MAGARDIQDSFVPDLQYVCGVHLAITLWKQCFCKANQVDDALAKSRGSSSWTCFVATGVIASNDPNSILPWESHLVLKLEEVGLLVSRVDHGEARAMNSGRQDGFNILQFIVNVADKVEASHILADQPRIEPRDLASEGGVYFFPRGEHRINCFVAGRTSKVAVNRRRRFAIDYLIR

SEQ ID NO: 109974 - protein, 204 aa, Glycine max
  Coding DNA Sequence Number=SeqID_18289
  Gene Ontology: Mol. function=sequence-specific DNA binding; Cellular component=nucleus; Biological process=regulation of transcription, DNA-dependent
  Homolog annotation: Hit_ID=A5BJU9; Match level="QueryCoverage=45%, HitCoverage=47%, E-value=1e-14, Identity=46%"; Hit description =Putative uncharacterized protein
MALLVEKTTQVVSSTRSMTFPRPRSYHRLRLEEGDPPGVLVAHRACPRLDPDEGPNLIVDDGGDATLLIHKSIKADELYEKKPQHKQHFSLLNLFLLFSGHHHGSEEGRDKPEPEVWPSELGVLSVVERFRSRPELDQSRKKVNQESFVSQSIVKGQDRLQKVVKENKEIEMSSFMTQCLNIGNVQPCKNMTTADLNVLSSMIE

SEQ ID NO: 109975 - protein, 207 aa, Glycine max
  Coding DNA Sequence Number=SeqID_18290
  Gene Ontology: Mol. function=translation release factor activity, codon specific; Cellular component=cytoplasm; Biological process =translational termination
  Homolog annotation: Hit_ID=A7Q103; Match level="QueryCoverage=32%, HitCoverage=17%, E-value=5e-20, Identity=76%"; Hit description =Chromosome chr7 scaffold_42, whole genome shotgun sequence
MKPKGCATRFMPQPLALVSLLLLRSIHSCVLVEQQTKIASGMEWDNNYDLSGYEEEEGFIFNDGDDAGPLLFPFPVAKDLLQMAPCGFDVTDVHEPEGAHFNPNNKEHGAPKDEHRHATNCSNFAVLSENEDLMVLRQLEASPSEYARANKEFWKLSVFMDLIKELRAKQKEIDGLKSLMAECFEDKDMLNMATEEMGQAVEEERRL

SEQ ID NO: 109976 - protein, 67 aa, Glycine max
  Coding DNA Sequence Number=SeqID_18291
MPLTSMKRKLKKKSKRRRRKKKMATVKTNNNKQRLNLKGLICDPFTISKTKITIYPKMRGENQSIGQ

SEQ ID NO: 109977 - protein, 238 aa, Glycine max
  Coding DNA Sequence Number=SeqID_18292
  Gene Ontology: Mol. function=nucleotide binding; Cellular component =intracellular; Biological process=small GTPase mediated signal transduction
  Homolog annotation: Hit_ID=A7NZR8; Match level="QueryCoverage=59%, HitCoverage=30%, E-value=9e-51, Identity=75%"; Hit description =Chromosome chr6 scaffold_3, whole genome shotgun sequence
  Pfam annotation: Domain name=MMR_HSR1; Domain location=137-238; Score= 58.7; E_value=2e-14; Accession=PF01926.14; Description=GTPase of unknown function
MHLHLHLNGLRLSHVQLGAYECGYYVMHWMWCIVSGGLKNELHNFFSDGTPLVTDTMTTLCKKWAACQCSTSSCFGPFLRRNLVMNTKDQISQTSKFQPLPISAISGTGTAELIDLVYCRLQKIEESNNLVEEDYVLAISIVGRPNVAKSTILNALVGEDRTIGSPISGTTRDAIDTEFTGPDGQKFQLIDTAGIKKITTIASAGITTEALSVNRAFRAICRFDVVVLVIEAMACITK

SEQ ID NO: 109978 - protein, 78 aa, Glycine max
  Coding DNA Sequence Number=SeqID_18293
  Gene Ontology: Mol. function=transferase activity; Biological process= Mo-molybdopterin cofactor biosynthetic process
  Homolog annotation: Hit_ID=A7QJF9; Match level="QueryCoverage=89%, HitCoverage=14%, E-value=7e-20, Identity=68%"; Hit description =Chromosome chr8 scaffold_106, whole genome shotgun sequence
MAQLPEGITELWHHDKLSMPLGENVIILSATNVPELEKQWDCWIELAKSSDLLALLEPYVSKDVTTNLLDECTTFHIS

SEQ ID NO: 109979 - protein, 82 aa, Glycine max
  Coding DNA Sequence Number=SeqID_18294
MVEVSLAAHGSASYNDEQQHTLPTNEQGSSTSQSQNITEFGVVGDKWLTGSFDLISHLTLSLDKDAIILGSMFFQCRRPLRA

SEQ ID NO: 109980 - protein, 304 aa, Glycine max
  Coding DNA Sequence Number=SeqID_18295
MWDQHRLKRALKPDVFTPKAYTPKSPLGPLPPDLGFPNVREKEKGLKPPFHCLCAMSISPSTIIILQIPTANMRGSEAGTTYQIFTTIQRLMSQDRGFTETVLGFYRKRKSYDAKGLVISQPTLRREGDARAHGCVFQERNTRGVATNVYLRKTSEKLEKMWSTNFKCERRENDLNKRLKQGKEGEACHPARPGELGCFLQKASPSGGGTSWKAQNFTDCATMLSFDFRHVTELHGLPNDGCQAQNDHNLSLRALGHDQAWVARRRMTIIYLYVPSDTITSGWRKGVGNDHNLSPPTSRLTIPE

SEQ ID NO: 109981 - protein, 225 aa, Glycine max
  Coding DNA Sequence Number=SeqID_18296
MLSSEGVPFEGTIDDDWKFDFSSHDARQMVCTNQTDMTSRLLAGSLAFECRIMHYLIVRILLPRSSNLAQVSKEDLIVMWVFLTGHQIDWAHFARYRMNNALRSNALLPYPHLITLFSCHFNVPLDFEPFVQVKRSFSIGAGVVSSFRYRKERDGSWAKKDAQPQAADDRSPSPLPPSVDSSSLMQNVLDKLDGLHTFVGEHFDSLNSRIDAIDARFAGMDTHIT

SEQ ID NO: 109982 - protein, 125 aa, Glycine max
  Coding DNA Sequence Number=SeqID_18297
HALWCPYRTRARARVMGKVKEVQEQMKADMEAMKEQMAKLMEAMMSMKQIMEANAVAVATTRAVAKVNPMHLSDINQMNHPTSNMVGKDLGRYATKGQAVGGIPLRNTLEGPQYHPQPHSLHSTP

SEQ ID NO: 109983 - protein, 331 aa, Glycine max
  Coding DNA Sequence Number=SeqID_18298
  Subcellular localization annotation: CTP_CleavageSite=30; ConfidenceScore=5.07e-01
MATPPNSYPPESAPSPSMSKRTRKATQLISLSAKPVGVERPIAHVDPTTWKVDGPHKKKLRTYLGVIARDKVDTVGEQWRQSKLDLTSKKAFTQGKDDDDDTVCEMYGISKQKWNQFCQSCRDLSWYDVLTTTLGRLENSGRVRATRASGAIRKFFGPTSEGSYRYMQMQSHGIIASVEPKVALSGARVSTKGSCVDPLGQDLNTNASDKHGLYADDTSPFQRANACIPIPVEEVQLVGQALNTFLAWATHLDKQVPKGPTKLVDRLELDDDPIYQMTLMILQLFLKPMHVSWDATMFGAYEDNVSLYIKHGDLGEIAHDGQCLNIVVIQL

SEQ ID NO: 109984 - protein, 53 aa, Glycine max
  Coding DNA Sequence Number=SeqID_18299
MKFIANYYASLRKVMQSYPTRALDRRLQVDWARDAREDPKVLMSLRANFGPMS

SEQ ID NO: 109985 - protein, 346 aa, Glycine max
  Coding DNA Sequence Number=SeqID_18300
  Homolog annotation: Hit_ID=A5BJU9; Match level="QueryCoverage=30%, HitCoverage=53%, E-value=2e-13, Identity=43%"; Hit description =Putative uncharacterized protein
MKKIQGLQALHGSTLGHLESGCLKHQWDVRAKPSIFNVCSIAQHDLKWTGWTNNVAVSRSVFSAGKGEGEGKVVGEVRKVDGSANLLGGVGSKGGRVLGGIHGGLANKVGVACSLVSTSLRPKRKQFIMAVLGHVGDFQSHWNQPYSMKAGKGDEQEQWNSVKKLFNLEYPFKGGVYGAGWWGWWIVGFVFYKQFLKELESFKLDDFGFFSVGSSHHVRIPARDFWPFESGVLNGLGKFMCMPQWEQTKKMVDEEHFIAQSNVKGKEKLKKLVDENKEKEMSLFMVQWLKTRKVQPEHNMTKADFNAVSSMIDQNRKDIAERMEILSVSEVVPNQPRMQHQHSNPI

SEQ ID NO: 109986 - protein, 117 aa, Glycine max
  Coding DNA Sequence Number=SeqID_18301
MTRGNPSNLQPFDPEIDRTFHRLVRHHFIPFDHPEHSITGESVHSVIGDFEHPDLEHYNFEHSENMAQPPPRERTLREMAAPDFTYESLCIQYPDEDVPYVLKTGLIHLLPKFHGLA

SEQ ID NO: 109987 - protein, 181 aa, Glycine max
  Coding DNA Sequence Number=SeqID_18302
AKFDIPEAANAKIKVMSTVATRWRQFKSTMTTKFVYADSERQDKHDHSVKHGLDAETWEEFAASCKTLNWQLSSSFFRNLLKETSQGGELSYERASSPSFLSKVHLGGETPSSMAYSLDLIEAQRSSLHRSPTSKLPSRWMHLDGEHGAIKLKGETLTKVLLNTDGPPSARPFSQFEDVII

SEQ ID NO: 109988 - protein, 121 aa, Glycine max
  Coding DNA Sequence Number=SeqID_18303
  Homolog annotation: Hit_ID=A7PU75; Match level="QueryCoverage=79%, HitCoverage=10%, E-value=3e-09, Identity=41%"; Hit description =Chromosome chr7 scaffold_31, whole genome shotgun sequence
MENSIVVNFNVNLPLVKRARVRMGKSSTEAKLNSISQVQVKSGEEDITDLPHQIITSSNCENGLAEGGPSVFNNTLGLINCLIKKDQMLGCSVDDEVVLPPSKCIHRDGSLLVGLLWRLDL

SEQ ID NO: 109989 - protein, 62 aa, Glycine max
  Coding DNA Sequence Number=SeqID_18304
MIITKKLYPLLAMNPNAVSLLSPMITTKKLYPLLAMNPKAVSLLSLVINQEANPASCNEPKR

SEQ ID NO: 109990 - protein, 68 aa, Glycine max
  Coding DNA Sequence Number=SeqID_18305
MEGGIGASCDPECRRLRLEGRVVIDYTNMVIDYQRETLPEITACNRLHYYGNRLPVVILARKQKQQAF

SEQ ID NO: 109991 - protein, 71 aa, Glycine max
  Coding DNA Sequence Number=SeqID_18306
MEAKCLRKKGKYGEGMNEKVKVKKRLSFELQNVAVGLSSAAGLSKDPPLSAALARLAQRRIWQSISIKVAH

SEQ ID NO: 109992 - protein, 505 aa, Glycine max
  Coding DNA Sequence Number=SeqID_18307
  Gene Ontology: Cellular component=integral to membrane
  Homolog annotation: Hit_ID=A7PPD4; Match level="QueryCoverage=55%, HitCoverage=57%, E-value=2e-83, Identity=58%"; Hit description =Chromosome chr8 scaffold_23, whole genome shotgun sequence
  Subcellular localization annotation: CTP_CleavageSite=22; ConfidenceScore=5.14e-01
MASISTCITVTPTCRLARRLLSFTSKQAIAFPSVQQNPVIGGVTKRVWDSRVLVAGPGGAVETDKLPSDVRKRTMDAVDECGGRMTIGDVASRAGLNLNQAQKALQALAADTNGFLEVSEEGDVLYVFPKDYRSRLGAKSFRIKAEPFFEKAKAAGEYFIRVSFGTALIASIVIVYTTIIALVTSSRSEEDNRGRRGGRSYDSGFTFYFNPVDLFWRQRPQADDDKMNFIESVFSFVFGDGDPNQGIEEERWKLIGQYIASNGGVVAAEELAPYLDIDSTEGIKVLRPPSATVFGHHFSRRTQGWVRLEERDSPLEVAWPNSLPRAAIVSCQFRRVAFTRRTPVAGSSSDLFRHLCRLHLNTFSGLVFRFWQVVCSSPCVSLFFFIRVSVFDQKWLLLNSLVNKKLDKFYMVLILRSLHSDFDHVRDQVLAGDQVPSMDSLITRLLRVPHVLKNENLVDVVETSAMVAPRGRGGGRSGRGGRPHLQLQFFYCWDKNTESIGLGST

SEQ ID NO: 109993 - protein, 115 aa, Glycine max
  Coding DNA Sequence Number=SeqID_18308
MEMQRKTKEKRGCFNGGKERGRERERGEHEIEGIKEVEKWNFELCLTRLSFIKVTTSVTHASIYRLAPLELVGLGSSSSMDSFASWKINGSGMEKEEREETPLQGEDESRRSSPP

SEQ ID NO: 109994 - protein, 214 aa, Glycine max
  Coding DNA Sequence Number=SeqID_18309
MEFTLGDQHVCVISTSLGRELLGAPSNIAGAPSNLLKGQFCPSFKNIKNFIPLSEAFCLLSSAKKLFSSLLSSAKKHSVFFSSSPRGFSGFIFSARLVFHLHSRVEDAGKNGGSLVTVSLPEDPLGVLPELPEEDLPEDFRKKGSSVGNEMTFGRTDLPENSRNTSSGMFPEDVLVPETFRKRVLPDDLSVVPEALSGRVFFRSCSRRSTSSEK

SEQ ID NO: 109995 - protein, 261 aa, Glycine max
  Coding DNA Sequence Number=SeqID_18310
  Homolog annotation: Hit_ID=A2Q1Z1; Match level="QueryCoverage=65%, HitCoverage=55%, E-value=3e-07, Identity=27%"; Hit description =Homeodomain-like
MVVVDFAKREERLYMWDGGGWGWGWVTHRRPLPPPLPPVTYNESPSTKNSQSFQTFPSMPQNTFTTFHNYNTFCGNLSERSDNQLKSQCPKNHNVIQKFNGYYKQVVALKKSGYTENNMMINPYAIWKWLEQCAKVPSKRTKPNENWNYSSSSNPETPIDVFESDTPTPLARPMGQKAVKRKIKGKGPFPSTLVVNLSGIEKEMNERNVVQKQIVEAVASDSIVKMYEILMKDKDNMTQEQRNKHKIICDYIEKSLVLIIN

SEQ ID NO: 109996 - protein, 280 aa, Glycine max
  Coding DNA Sequence Number=SeqID_18311
  Gene Ontology: Mol. function=transcription factor activity; Cellular component=nucleus; Biological process=regulation of transcription, DNA-dependent
  Homolog annotation: Hit_ID=A7NXZ9; Match level="QueryCoverage=96%, HitCoverage=87%, E-value=4e-37, Identity=36%"; Hit description =Chromosome chr6 scaffold_3, whole genome shotgun sequence
  Pfam annotation: Domain name=AP2; Domain location=129-180; Score =87.0; E_value=6e-23; Accession=PF00847.11; Description=AP2 domain
MSDTHQPFMSVQPPMKLHNHPFNPQASSSNFDGDPPCKTAGKTKPPHTKLLRVILTDHDATDSDSSGDDEDPKNTKKHKKVKRQITHITINLPFFSKSPTPTSTPSSSSLDPTRSTRPKKRLGVPRRRNKFRGVRQRPWGRWTAEIRDPTQRKRVWLGTFDTAEEAAAVYDEAAVKLKGPNAVTNFPLSAAGNTEHDTPPPETVFSGEGLSSPTSVLTYCDGDSTPFDGFRYGEVDAFGFEFDIDAPFSLTAVNLGVLSQRFGKEEFGEFDPNEFLTWPS

SEQ ID NO: 109997 - protein, 179 aa, Glycine max
  Coding DNA Sequence Number=SeqID_18312
  Gene Ontology: Mol. function=small conjugating protein ligase activity; Cellular component=proteasome complex; Biological process =regulation of protein metabolic process
  Homolog annotation: Hit_ID=P35132; Match level="QueryCoverage=100%, HitCoverage=100%, E-value=1e-75, Identity=78%"; Hit description=SUMO- conjugating enzyme UBC9
  Pfam annotation: Domain name=UQ_con; Domain location=5-173; Score =255.4; E_value=1.2e-73; Accession=PF00179.17; Description=Ubiquitin -conjugating enzyme
MASKRIVKELKDLQKDPPTSCSAGPVAEDMFHWQATIMGPPDSPYTGGVFLVSIHFPPDYPFKPPKAISYPIAKPHTCGGGGGGASVAQMLNALVVKVAFRTKVFHPNINSNGSICLDILKEQWSPALTISKVLLSICSLLTDPNPDDPLVPEIAHMYKTDRAKYEATARSWTQKYAMG

SEQ ID NO: 109998 - protein, 154 aa, Glycine max
  Coding DNA Sequence Number=SeqID_18313
MELGEVKVHQVYSRLLSTFADLPTLGFQMLRDLGRRFVLIEQWEDVASSDSHSLGLVFPSSTGPSTTEGSRNLSTFLSQLPPNAAKKVGKSIVALMVATVAETGTSSRLKKHPVLKKRCLPPPITLLEYTWVDEEVGTYFLHYNHQSYMSNLIN

SEQ ID NO: 109999 - protein, 48 aa, Glycine max
  Coding DNA Sequence Number=SeqID_18314
MSRYLEINVFLSMEEEISIGEDGEVEDECDAGEFFGGGEGEGVMVEKS

SEQ ID NO: 110000 - protein, 389 aa, Glycine max
  Coding DNA Sequence Number=SeqID_18315
  Subcellular localization annotation: CTP_CleavageSite=30; ConfidenceScore=5.04e-01
MQTASPIGAFVVVVTRGMSSLSLATQSVVVATSIGEWREPAGVAAFDREVVIAAGDLGFKDITIPVGDLGFKDITIPAGDLGLVDYKIPLNESESLRVDGTQLIGPTNLDWVDLCEELLGVRPHEGELEGSVFLWEPYTTTVTSALPPIYGWKCSVNIHGITLKGKQDENWEQLFARMISQWNNRVEFRVDVYPRQEGLLSFNSDYMAEVMETLQYMVSPQGRNTWTVDNLVPYVEKITILFEEQERITEPMSHGPALERQFAAQEFHILQSSVETQGIGRRREAVEAEEYSQQMVERGHGMHYMPPTFSQYPSQMYQYPFEGHHTDTSTSEHSFGGVAETHPHFSWPSVDLRHQFSVETDQVKARRHWGRRNPDRQARRWDRPCGTSS

SEQ ID NO: 110001 - protein, 182 aa, Glycine max
  Coding DNA Sequence Number=SeqID_18316
MDVGHGFYMAKFDEELDRNKVMEEGPWMIFALIASIGKPIKVDSNIVDVRLGRFSQETSAKPGVAVSNQPSQSDGGGVSKQPVPATTMKEGASGEGATQGDKEINSSNNNIKGPRKEPLFPTSSVMMSGLVTATNAPPPIVINLGHNKEDPIIYDISNNAKSTMNMKLVSSVQYTNVVEDSN

SEQ ID NO: 110002 - protein, 47 aa, Glycine max
  Coding DNA Sequence Number=SeqID_18317
MSHPDVAPLKLFDSSGMEKEKDDWRRHFKEKMSLEEVHHHRKPRIKA

SEQ ID NO: 110003 - protein, 98 aa, Glycine max
  Coding DNA Sequence Number=SeqID_18318
  Gene Ontology: Mol. function=glycolipid transporter activity; Cellular component=cytoplasm; Biological process=glycolipid transport
  Homolog annotation: Hit_ID=O22797; Match level="QueryCoverage=40%, HitCoverage=19%, E-value=3e-09, Identity=72%"; Hit description =Expressed protein
MEGTVFTPALQEIEHVKSDQGEILSKLFLDACKHILPVIDVSARAFYEVSYPNFVRGLLLDDMQPLIGRFGILGILCFTICEVPRHAGNQKEAGLCDP

SEQ ID NO: 110004 - protein, 172 aa, Glycine max
  Coding DNA Sequence Number=SeqID_18319
MKTILHCTSVDNRNREPLATLSHGHVPHIPSSNRCSSIAYSNSRNTQPSHILEEYNNRQFQRLQKLSATRLNFDQVLHQQNVGLNDNGRATKTNTYNDNNLLLYWQSYVYVASLWTEFKNYDKLGIALCRNMPSCGRARRGSRVDKSEALAPTYPPSKRKSDLRSSFLRVIK

SEQ ID NO: 110005 - protein, 102 aa, Glycine max
  Coding DNA Sequence Number=SeqID_18320
MNCSHLSHRGEGLHVINTLNLRKPFCNKSWLVAFNTTISSTLDLVNPFASDGFNIRKSHNNVPSEDGVVGARGLNCEVDGLGTCEVMLGEKELGFLKGKMVS

SEQ ID NO: 110006 - protein, 118 aa, Glycine max
  Coding DNA Sequence Number=SeqID_18321
MTHHQDPDTRVYSPKVMSLIGKHLLFLIERESVEGRCLRDVVNYPNAYTVHLICHDKQVLRMFHSKEFLIVAQKPVPPAMLIEWIKKQKEDLKCQGYRGSRNDAPQDTQILNDESASS

SEQ ID NO: 110007 - protein, 120 aa, Glycine max
  Coding DNA Sequence Number=SeqID_18322
VQPRSNLVPLSGSSGPKCMIRGNPGDLQPFDPEIDRTFHRLVRHSVHPGHSVHFEHPNHFEHFVAGDSECSDFEHSAINFHTENMTQPPPRERTLREMAAPDFTYESLCIQYLDEGVPYC

SEQ ID NO: 110008 - protein, 250 aa, Glycine max
  Coding DNA Sequence Number=SeqID_18323
MTLGCRLGRLNSIAEIDDQKETWKIVVRVINMWIIPRSPKFIVELNLVHKKGDKFLTQMKNVDVQLDNATKVTPHKILEILETMYNFTMFDDIVSGSTNTDFSIDVIGEVVEIVQWNLHGKPKKVVFTMKDGWFRMDVIVGQPHESAIFTLWDRECYALIKETAAEIKQKMIDKDEVLPSISMMNEINDASESQCFSATTESDPTLLGSITLAKHILPLSHSQLDEISFEDLSSIQLSLTRLDKKHIKTE

SEQ ID NO: 110009 - protein, 163 aa, Glycine max
  Coding DNA Sequence Number=SeqID_18324
  Subcellular localization annotation: CTP_CleavageSite=45; ConfidenceScore=5.03e-01
MEDGVGIGNDAANTKTTTEGGALPVAPLVQSPAARARPRVGGGTTAMVAEGGAVVRKEEEEEGGEEEETEKKNKEKRRKHESERVRNKGLLDEKRRKHESERVRNEGLPNGPSSSLTKLIKLHHWIGSFFFLGSVPHSSVSFAETFLFFLLCNLLSLDLMGSL

SEQ ID NO: 110010 - protein, 141 aa, Glycine max
  Coding DNA Sequence Number=SeqID_18325
MRVTLAKAVLDTIPIYTMQNVWILEGVCNNIDNIVRRFMWGSQMLPYLGNTFGLFCKTQTSYGGDLSIWYDKWDQDGCVVGSVNHVNIQDVNLTLRDIFWNGIWHWNEATQDEYFPTKTTYGWLTRTLVTPGSSASYDSWI

SEQ ID NO: 110011 - protein, 75 aa, Glycine max
  Coding DNA Sequence Number=SeqID_18326
MINRGLEKNARRHVVIGRSTVQRMNTKTVFKSSHLCMSINATEKSRTNKQIESGWSANLRPNSKSSQALNVLKLW

SEQ ID NO: 110012 - protein, 239 aa, Glycine max
  Coding DNA Sequence Number=SeqID_18327
  Gene Ontology: Mol. function=monooxygenase activity; Cellular component=endoplasmic reticulum membrane; Biological process =electron transport
  Homolog annotation: Hit_ID=Q6J540; Match level="QueryCoverage=68%, HitCoverage=40%, E-value=1e-43, Identity=48%"; Hit description =Cytochrome P450
MKHTYRRTKQQNPRNRESVGKAVADNNDILNFGEAGERSPTGGLANASHVKGDSCVTIESQARNDSFEETLATTQNRIQELMMAAVDNPANASEWALAEMINQPKLLQKAIEVLDNVVGKKRLVQESDIPKLNFVKACAKETVVANYLIPKDSYVLLSIRGLGRNPKVWNEPLKFKPERHLKNDGSDVTPWLPWSAPPNVSTINLAESKRNMFLAEPLVAVAKPGLATELYTMKLSEHL

SEQ ID NO: 110013 - protein, 168 aa, Glycine max
  Coding DNA Sequence Number=SeqID_18328
  Homolog annotation: Hit_ID=A7NZZ5; Match level="QueryCoverage=29%, HitCoverage=22%, E-value=3e-15, Identity=78%"; Hit description =Chromosome chr6 scaffold_3, whole genome shotgun sequence
MGTQDGFTSVKQLRNKLTFAAGCVETHLIDGVGHFQMERPGYDAEMVDLIIKLEYILPLLILGDGFFQYGVSLWTEYASKALDIPSQFLDEEKYAKETLGSRGQMFHSIFEGMKISHDRVLTHFISFGFQTKVLSSILTFFSYNQKERCLTSRILIAIIIFLFVFPYG

SEQ ID NO: 110014 - protein, 169 aa, Glycine max
  Coding DNA Sequence Number=SeqID_18329
MASGFHVQKLCNSSLSTGNRLHTLIAMAAQLIHDRVVMECLEGVWETLEGNERCRFRGTIRLTATSLVHPEEPTHTLQQPVEWILPTPTPYRLVEPVQVIEVSSSEEDPEEDPEELPPEPAVDALDFPEDDEDPLPDVDSLEDIMSASEADSIEESGPGGTTNSEDSSS

SEQ ID NO: 110015 - protein, 184 aa, Glycine max
  Coding DNA Sequence Number=SeqID_18330
  Gene Ontology: Mol. function=oxidoreductase activity, acting on single donors with incorporation of molecular oxygen, incorporation of two atoms of oxygen; Cellular component=chloroplast; Biological process=fatty acid biosynthetic process
  Homolog annotation: Hit_ID=Q93YA9; Match level="QueryCoverage=94%, HitCoverage=19%, E-value=4e-72, Identity=76%"; Hit description =Lipoxygenase
MSVTDMHAESRVEMPLPMYVPRDEQFDESKLNTFLIKRLKAVVHNLIPGLKASLSANNHDFNRFSDIDDLYSDGLPLQDEILKKIPLLQVLTKIQECSQGLLKYDTPKIISKDKFSWLRDDEFSRQAIAGVNPVNIEGLKVFPLVSKLDPETYDHQDSALKKEHILGQLNGMTVQQVRTFKILN

SEQ ID NO: 110016 - protein, 140 aa, Glycine max
  Coding DNA Sequence Number=SeqID_18331
  Pfam annotation: Domain name=Transposase_23; Domain location=51-121; Score=4.6; E_value=0.00038; Accession=PF03017.5; Description =TNP1ENSPM transposase
MASFNQMQSQFQSQMQSQGLALPLEPLVGPSDPQVSTKKSCVDPSGNDPETGDSDRCGLYIEANPACLVALGRVYEGSTVVHNTPLFPGQVKVGVEEVKDPDALVPVPTNEVSLVGQAIHTFLAWPTHLVKPLSQQGASN

SEQ ID NO: 110017 - protein, 57 aa, Glycine max
  Coding DNA Sequence Number=SeqID_18332
MGGLTSHNNERLTNTKRKQEVWKKMEERVPNTIMFFDIECTLSRHVLAKRTCKFQLE

SEQ ID NO: 110018 - protein, 185 aa, Glycine max
  Coding DNA Sequence Number=SeqID_18333
MEAFLAQAPVAQKPQTQAPGDAEDTPADTTIDQAVEDDMPEARDTEETLAATPIEIIEEGGAIDTDIDEDYVENVTADAPSTPHDDPVIQSYPARALGRRLQVDWARDPREGPRVFMSLRLSSSFFRNLLKEASQGGELSYERASSPSFLSKVHLGGEAPSSMTYSLVDGASSHLFSFVFRCISM

SEQ ID NO: 110019 - protein, 86 aa, Glycine max
  Coding DNA Sequence Number=SeqID_18334
MARLAATRMQKASKYQTQLKDEVKAERQGTECNYEQLQKIVDNSANSAKRAMTRSGDSMPEDAVVGSRLVRWPHLVLLPFQREFWA

SEQ ID NO: 110020 - protein, 28 aa, Glycine max
  Coding DNA Sequence Number=SeqID_18335
MGEGGYFRWKLPSLPGQAGRQSPPSFLL

SEQ ID NO: 110021 - protein, 66 aa, Glycine max
  Coding DNA Sequence Number=SeqID_18336
MEVEELWVGLWLPLNYQALSLEISLLGWCFGSCYGWCLTLDVRQAAFVADLGVTFVDDWVVGNEKA

SEQ ID NO: 110022 - protein, 103 aa, Glycine max
  Coding DNA Sequence Number=SeqID_18337
MAKFDPEIVRGQWIPFDADALSQFLGHPLILAEGQQCKYNQRKREVSSFDEENIAQLLYIPGQDFAQTTAGRRVPRILLGKPLKVFKSLPKSQETHPPWKMQP

SEQ ID NO: 110023 - protein, 71 aa, Glycine max
  Coding DNA Sequence Number=SeqID_18338
MVAITFARFPQPPFFRGYDSNATCACHGEAPGHSIEHCMISKRKVQGPIDAGWLKFEENRIIFKFMPQLQR

SEQ ID NO: 110024 - protein, 234 aa, Glycine max
  Coding DNA Sequence Number=SeqID_18339
MGGDDHTKTDLQAKPKQQVQLLEELYQGIPDESVKLTFQDLANVNSSNNTMATNERVSDQGGIISNSTKVPSPSLSTVPSLDIKKGLGASNHNHHHHEKNYSHHHHHHQDFGHRGGGESPWGRFSHASGGVPSRAEKEVLVDEGGRGTTTKAEFNVGLNGYTTSVEDRRCLRRPPSLELTRDYDGHKDNTVVDIILFYDDYDGCLPRTVVEGSYHYNGVLLRTTVVRDGVNTTT

SEQ ID NO: 110025 - protein, 131 aa, Glycine max
  Coding DNA Sequence Number=SeqID_18340
MRQHTKTGLLEEPSLYVLYRHVAGVIQRRSFLGPVIVSQIVSRLRHVLVTFSYFGAPYHFFAPFFDYLPLLWRPSYTDLLLRQRASSPTNSISCPLPVVPFAAAADKGPLLLLVVFIVVYIIVFKEDKVVP

SEQ ID NO: 110026 - protein, 43 aa, Glycine max
  Coding DNA Sequence Number=SeqID_18341
MSKRLQEDWARATEEGPRVLMNLRVGYPRNIGFFSPCIFGHLD

SEQ ID NO: 110027 - protein, 127 aa, Glycine max
  Coding DNA Sequence Number=SeqID_18342
  Homolog annotation: Hit_ID=Q53LF6; Match level="QueryCoverage=80%, HitCoverage=11%, E-value=2e-08, Identity=32%"; Hit description =Transposon protein, putative, CACTA, En/Spm sub-class
  Subcellular localization annotation: CTP_CleavageSite=30; ConfidenceScore=5.67e-01
MASPPASPPPPPPAPSDASASPSAMKRTHKASRLRSLSTRPPGAERPVVHVDPAIGKADGPHRKKLRTYLGIVARDKVDVTYENWKEVPTPQKDLIWEDIKAEFEIPEASNSRTKRKLLQTMGERWR

SEQ ID NO: 110028 - protein, 149 aa, Glycine max
  Coding DNA Sequence Number=SeqID_18343
  Gene Ontology: Mol. function=protein kinase activity; Cellular component=cytoplasm; Biological process=protein amino acid phosphorylation
  Homolog annotation: Hit_ID=A7P0F2; Match level="QueryCoverage=42%, HitCoverage=21%, E-value=3e-23, Identity=78%"; Hit description =Chromosome chr19 scaffold_4, whole genome shotgun sequence
MHKTFVQELQHLRSERDRIENEMHHLNEFKNADEDTKKNFSATGDQIDGIAAVKVQTGESSRPKRNVLVTVEIPYSECDNVDKIYKKVSSGVRPTALNKVKDPKVKAFIEKCLAQPRARPSAAELLRDPFFDEIVDDGDENDDCSCSYQ

SEQ ID NO: 110029 - protein, 368 aa, Glycine max
  Coding DNA Sequence Number=SeqID_18344
  Gene Ontology: Mol. function=glutathione gamma-glutamylcysteinyltransf erase activity; Biological process=phytochelatin biosynthetic process
  Homolog annotation: Hit_ID=Q2TE74; Match level="QueryCoverage=69%, HitCoverage=50%, E-value=2e-89, Identity=70%"; Hit description =Glutathione gamma-glutamylcysteinyltransferase 2
  Pfam annotation: Domain name=DUF1984; Domain location=2-37; Score= -7.8; E_value=0.0091; Accession=PF09328.1; Description=Domain of unknown function (DUF1984)
MPKDYLQSCRHEGWSSVAKFLTEDVPQLLKSEDLKDIQEVLSHAFKSPPSELRGLITWIAEVCRQEDGNLTLSEDEKGRLAIKANILEQIQTTGLFKHVTRWLDSKISCCNSLANLGDKDMLPALTAPVCCQVADLLTVCGRLGLSGGKYCSQIDVKHLNADSENPVTLVSGTITTSGGSEQGVDVLVPLCQREPSRLCLSNEGHCIGMHPSTANVLTVLLLALPLHTWSGIKEEKLRVEALSLLATEDLPPLLQEEIWTFRSSLTGVYRLKWLVSVNFCGPSGLQETNDCFQQRKVPMRLLLEKYQNLVVPATEVVSNDNVQIHKWKQPTVCFMKANLDASVKKNIGTSVKSLLQHLWLFLAARNLM

SEQ ID NO: 110030 - protein, 78 aa, Glycine max
  Coding DNA Sequence Number=SeqID_18345
MVQRLTYCKRYSYATKSNQHRVVKTPGMSPFERQDILLPSSTNGVKDLHISASHSSGLALFASLGKKLSVLRHVCIKY

SEQ ID NO: 110031 - protein, 103 aa, Glycine max
  Coding DNA Sequence Number=SeqID_18346
MTPTHDVLLYYNGRWNMPRQHDFVGYSFTRKNPKRFDIPSGCIIDGVKDVIKKVASQGIPPYNIHESQTVRRLFFRQLGHSEYSDKVIKFEVIELKTDDDVLK

SEQ ID NO: 110032 - protein, 180 aa, Glycine max
  Coding DNA Sequence Number=SeqID_18347
  Homolog annotation: Hit_ID=Q53KI5; Match level="QueryCoverage=55%, HitCoverage=9%, E-value=1e-06, Identity=33%"; Hit description =Transposon protein, putative, CACTA, En/Spm sub-class
RYMKVLKGYTKNQYRPEASIVESRRDLTLGGKGTQGYNDATMIRQDVSQAHLYILNKIPEHNRTFINWFKETIFADDSASQTLKLLVVGPNLNVPTWKGYGRCGAHGCVFQGRKVMQSYPPKVSDRRHQEAWARATKEGPRVLMNLRLSSSFSRKLLKEEVFSKKLLKEVFSRKLLKEAT

SEQ ID NO: 110033 - protein, 114 aa, Glycine max
  Coding DNA Sequence Number=SeqID_18348
  Homolog annotation: Hit_ID=Q2HTK5; Match level="QueryCoverage=84%, HitCoverage=38%, E-value=2e-08, Identity=35%"; Hit description=H+ -transporting two-sector ATPase, alpha/beta subunit, central region
MGDFVEDRWEWKLNWRRNFFDHEIDMVAAFLAEIENVHIQHSSMDILIWKADPSGIYSTKSAYKLLQEADSVAIEDSASKIIRNLKIPPRPIAFSWRFFKNRLPTKANLRPHSL

SEQ ID NO: 110034 - protein, 129 aa, Glycine max
  Coding DNA Sequence Number=SeqID_18349
  Homolog annotation: Hit_ID=Q6UUU1; Match level="QueryCoverage=46%, HitCoverage=40%, E-value=1e-18, Identity=78%"; Hit description =Putative uncharacterized protein
MGNSTSSSNARPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 110035 - protein, 21 aa, Glycine max
  Coding DNA Sequence Number=SeqID_18350
HKGNVKIKVMFAHSIKGCRAL

SEQ ID NO: 110036 - protein, 257 aa, Glycine max
  Coding DNA Sequence Number=SeqID_18351
  Gene Ontology: Mol. function=motor activity; Cellular component=cell projection
  Homolog annotation: Hit_ID=UPI00016621D1; Match level="QueryCoverage =75%, HitCoverage=35%, E-value=2e-14, Identity=32%"; Hit description =UPI00016621D1 related cluster
LHVLAFRGLHIHAFRGLHALTIKRQHALTFRGPHILAFRGLHVLAFIGLLVLAFKGLHVLTFRGLHVLAFRGLHVPAFTGLHRATRPRLAFRALYILAFRGVDVLAIRGLHVLTFIGLHVVAFRGLHVFAFIGLHVLAIRGLHVLAFRGLHVLTFRGLHILAVIGLHVLAFRGMHVLAFRGLHVLAVRGLHALDLTSEDYTSSPSEVYTSSPSEGYVATCPFAGERRRGSRVDKSGTLASMYPPSKRKSDLRSSFLR

SEQ ID NO: 110037 - protein, 99 aa, Glycine max
  Coding DNA Sequence Number=SeqID_18352
MTKLGLCLSSALDDKRVRITVRYLRVSWVQNDQTWSLRAIGHRLCLNGKGVRITVRMTKLGLCLSSALDDKRVRITVRYLRVSWVQNDQTWSLLVICSG

SEQ ID NO: 110038 - protein, 214 aa, Glycine max
  Coding DNA Sequence Number=SeqID_18353
  Homolog annotation: Hit_ID=Q6WAY4; Match level="QueryCoverage=98%, HitCoverage=46%, E-value=8e-21, Identity=29%"; Hit description =Putative uncharacterized protein
MQVFCKAYGKILDLTIAEIFTEAVVSLTQYYDQPLRCFTFGDFQLVPTVEEFEEILGCPLEGRKPYLFSEFLPSLSKIAVVVKDSARELDRVKKTRNGVVGLPRKYLEGKARDMANQEEWVPFVDVLALLIFGGCPLSKRGRFGVRRVAHGSSAAYPFFVYVDWDQHLAGIGGRTINWFPRWKEGKEGVLFSCGDYPNIPLIGTRGCINYNPAL

SEQ ID NO: 110039 - protein, 52 aa, Glycine max
  Coding DNA Sequence Number=SeqID_18354
MDPPLTTPEAYRQQVAWPGDRPSTDREERPSGAAATEDPAVDEGLIADLAGF

SEQ ID NO: 110040 - protein, 184 aa, Glycine max
  Coding DNA Sequence Number=SeqID_18355
  Gene Ontology: Mol. function=adenosylcobyric acid synthase (glutamine- hydrolyzing) activity; Biological process=cobalamin biosynthetic process
  Homolog annotation: Hit_ID=Q1GXH3; Match level="QueryCoverage=100%, HitCoverage=38%, E-value=2e-83, Identity=83%"; Hit description =Adenosylcobyric acid synthase
  Pfam annotation: Domain name=CbiA; Domain location=1-184; Score=83.7; E_value=5.9e-22; Accession=PF01656.14; Description=Cobyrinic acid a,c- diamide synthase
MVQGTTSDAGKSTLVAGLCRVLYRSGVAVVPFKPQNMALNAAVTEDGGEIGRAQAVQAMACGLPPHTDMNPVLLKPNSDTGCQVIIHGHVLGNQEASTYHDYKKTAMQAVLQSYQRLQQQYDCIMVEGAGSPAEINLRANDIANMGFAEAVDCPVILVADIDKGGVFAHLVGTLALLSESEQAR

SEQ ID NO: 110041 - protein, 116 aa, Glycine max
  Coding DNA Sequence Number=SeqID_18356
  Subcellular localization annotation: CTP_CleavageSite=56; ConfidenceScore=5.29e-01
MATSKYLIALGAFGSGPSMFIPHTTKGQGKLKLWRLSTGMHKMSANSWHRLHFLVKSSAFAQSVGQHFNKGVVNPLLNSSRSRMTLECLLDDSLEVPSLFSAGQLGEQVCSGVALP

SEQ ID NO: 110042 - protein, 336 aa, Glycine max
  Coding DNA Sequence Number=SeqID_18357
MWMDQFALTLNGSQELPRLLAKAKAMADTYSALEEIHGLLGYWKNTITKRATRYPYRTRSKSRTMGDQEETQEQMKADMSALKEQMASMMEAMLSMKQLIEKNTATAAAVSSAAEADPTLLATAHHPPSNIRLTLYGLPPNYSPPVLQEDAGHIASPVHEREPPQQPDEVHKDPQDYARRDVEFYPPVPEGPAPGTLPQPNITASPIVLSMEGPPPATEERRKLDLLEERLRAVEGFGDYPFADMTDLCLVPDVVIPPKFKVPDFDPPPRDDLSQKPSQNLGRSCGSVVVATYPSAGGRRVTRGMRVPRKEYARSRHQRLFEENVGKTGKTRSTNF

SEQ ID NO: 110043 - protein, 90 aa, Glycine max
  Coding DNA Sequence Number=SeqID_18358
  Pfam annotation: Domain name=zf-CCHC; Domain location=20-37; Score =16.8; E_value=0.0043; Accession=PF00098.14; Description=Zinc knuckle
MERSHNFNNGKRSQDVSPTLKYYKCNQLGHIKANCPSNESWPEKNEKKSYKERRSKKASRDDNDSSNGSEKEINLLSKDYESDKNISQED

SEQ ID NO: 110044 - protein, 113 aa, Glycine max
  Coding DNA Sequence Number=SeqID_18359
LVAEPALEPVSDFVELEEVVEDEDDQDVRKTPIKESEIEIKIKEEQEKEKEKEKEKEEIEKEKNQKNEKEKEKVDEEKKKSKSEVSREKKREITSAEGKEVPYQLVPSKKDKE

SEQ ID NO: 110045 - protein, 114 aa, Glycine max
  Coding DNA Sequence Number=SeqID_18360
MSKKPEKVWSTNFNRERFGSCFYAWGRRKEGGGCRPARAGKQGCFHQKAPPFFGTLRKAQVGLNVAKLHGLRNNARFPSGTLRNFTNYATMLVSRVPKGANKVQGPTTSTLGRN

SEQ ID NO: 110046 - protein, 222 aa, Glycine max
  Coding DNA Sequence Number=SeqID_18361
  Gene Ontology: Mol. function=UDP-N-acetylmuramate dehydrogenase activity; Cellular component=cytoplasm; Biological process=cell wall organization and biogenesis
  Homolog annotation: Hit_ID=A6TGM9; Match level="QueryCoverage=50%, HitCoverage=33%, E-value=7e-42, Identity=73%"; Hit description=UDP-N- acetylenolpyruvoylglucosamine reductase
  Pfam annotation: Domain name=HTH_11; Domain location=143-196; Score =35.7; E_value=1.6e-07; Accession=PF08279.3; Description=HTH domain
  Pfam annotation: Domain name=MurB_C; Domain location=30-152; Score =161.9; E_value=1.7e-45; Accession=PF02873.7; Description=UDP-N -acetylenolpyruvoylglucosamine reductase, C-terminal domain
  Pfam module annotation: Pfam domain module=HTH_11::MurB_C; Domain location=143-196::30-152
MKHDYVIVAVGLRLSKLLETGTEAMGGVGGAQSRHRMRVGRIQCGVPYATNFFKNPLISAQQAEALLTHYPAMPHYPQHSGEVKLAAGWLIDQCALKGYRLGGAAVHRQQALVLINEDNATPQDIVALAHHVRQEVGKKFAVWLEPEVRFIGAQGERNAVELGEALGMSRAAVNKHIQTLKSWGLDVYTVTGKGYSLPAPIQLLNEEAILAHLHQADLAVIP

SEQ ID NO: 110047 - protein, 75 aa, Glycine max
  Coding DNA Sequence Number=SeqID_18362
MNVLSGATLFCKITRTPNIFMVCVHRNSLGRNNQHENTEKGVEEKSPEFQEPRDLRSNPFQGGGNNAILPSKSIG

SEQ ID NO: 110048 - protein, 109 aa, Glycine max
  Coding DNA Sequence Number=SeqID_18363
RSPAGDLIPIDFEINATCRRHNLERIRKFLQDLEVAIIPEEEPQSSEASSSFPITGHSHLDPIKDHIMAEEPRRVTLEDYSSSNVPQFFTSIAQPEVQVQTITYPPSLI

SEQ ID NO: 110049 - protein, 335 aa, Glycine max
  Coding DNA Sequence Number=SeqID_18364
EEVEIYHIEFDDFKTELERRNLHKRLTNLVDGTIDVALAKEFYANLYSSKDPSPKQARVRGHLVKIDADSLNTFLETPVVLEEGETLPTCSRYYRLPSDHREIEAALCIQGRGFILNAEGHPGRILRKDLTTLAQVWSVISYSNLAPTSHTSDLTVDRANLIFGLVSHMDMNIDALISGQMTSITQSNSCRLGFPALIIALCRARGVVSDSLTFERLSPAINLAYIRKNWTNFIAVEPIGGSSSRIQPISREVRPETDATPERSLKGTSEPHTLMADLSSPQPVADPSTPRLVIPEDLTTPVLALNTSPPATAVLHLIDEEDTQTQDTQDLSQEF

SEQ ID NO: 110050 - protein, 76 aa, Glycine max
  Coding DNA Sequence Number=SeqID_18365
  Subcellular localization annotation: CTP_CleavageSite=47; ConfidenceScore=5.04e-01
MGALITNDGSRDSKPAKQIRFNKIHNNLSIVSSGGHQTPHRTTWVVEAFAVSMKKPHSSTLQATLYMPRWPPGAEE

SEQ ID NO: 110051 - protein, 92 aa, Glycine max
  Coding DNA Sequence Number=SeqID_18366
GPVGPLRCKRTQSVSRPPPDLGGGPTVRIQPEEETISSFDEEAIAQLLCLSGQDFTQTTAGIQVSVHMAQLISDAIYQFIGVAPTRHCVDPK

SEQ ID NO: 110052 - protein, 109 aa, Glycine max
  Coding DNA Sequence Number=SeqID_18367
MVIYFLCRRLNYRSTLLYFSLPSSSRDSKSDDEHRPIWSSAPFVKDSTSIDRDYFSLPLSSRDGKSDDAQRPIWSSAPFVEDSMSIDRDYFSLPSSSRDGKSNDAQRTI

SEQ ID NO: 110053 - protein, 196 aa, Glycine max
  Coding DNA Sequence Number=SeqID_18368
MTGKRVCLYVWTILLECQPTCVNQTLDLMFEGHTLFYRVPRDTSMISAGRVGVVPLKERRLENLPGGHQHHLDGSEFCKFLYRKIPSRIGACARIGAVGGARLCRSRVLSGDPLWLSGCPLLDGRWAGGVFNTGRKAWLMLGILGCHLCCQVPPPLGVLLKGLMLPLAHILQLGSIGSHVSIVLVPPNEGSNQVLP

SEQ ID NO: 110054 - protein, 56 aa, Glycine max
  Coding DNA Sequence Number=SeqID_18369
  Subcellular localization annotation: CTP_CleavageSite=50; ConfidenceScore=5.22e-01
MGCSKQMLTKNTRAEKSYISRPMGLKSSLRLMRTLRPSLPSLAQSSWNLLSSALGG

SEQ ID NO: 110055 - protein, 230 aa, Glycine max
  Coding DNA Sequence Number=SeqID_18370
MDWDRLWAGIGAHKISRTIQAIHKAWETPLRKDQELRGIRNGIIGGYHEWLKVHIRGLDWLTKLKVVSKESFEAPEEDEEVQTLKSELGKAKLAKEKFKLAATHIRKECAGLREENATTARALEQETKRARKEEYGRNKFRGALWGSNNELKLRREERDQSRAHSMVLKEELVACSRSKRSLSQRLCETETNMLAIIAKYQEELGLATAHEHRIADEYAQVYAEKEARGR

SEQ ID NO: 110056 - protein, 113 aa, Glycine max
  Coding DNA Sequence Number=SeqID_18371
EEHGRNKFRGALWGSNSKLKLQREEMDQSRVDSLILKDELKVCSRSKRNLSQRLCETETNMLAIVIAKYQEELNLATAHEHKVADEYAQVYAEKEARGRVIDSLHQEATMWMD

SEQ ID NO: 110057 - protein, 91 aa, Glycine max
  Coding DNA Sequence Number=SeqID_18372
MFHPANSITSCGHNISHHESELPRNISNLHDDEDDDDDYLASNSYVEESFDEDDSVDGISDTDDEVTDIIEPVLIVHPTEGVPGMGKFILE

SEQ ID NO: 110058 - protein, 110 aa, Glycine max
  Coding DNA Sequence Number=SeqID_18373
EFFLRPYQVTWDATVFGVFNPDFPLYIKHEDLSEIAHGGQCLSISVLQLWILGHWQMVVIVPKEHLVVWFCSLHNRPDNYLKGIINSALKGLDDAPQPKSKAPARWIVVK

SEQ ID NO: 110059 - protein, 93 aa, Glycine max
  Coding DNA Sequence Number=SeqID_18374
MMMIKDDDKGDDKKLKDQSKNNSRESKANQRTTQVNQRAIKKTQEESLETRIKIQGSRSPAPHHQDSRLKIQGRREDSIKISIKKFFKTLNST

SEQ ID NO: 110060 - protein, 147 aa, Glycine max
  Coding DNA Sequence Number=SeqID_18375
  Gene Ontology: Mol. function=RNA-directed DNA polymerase activity; Cellular component=viral capsid; Biological process=regulation of transcription, DNA-dependent
  Homolog annotation: Hit_ID=A5BRA1; Match level="QueryCoverage=75%, HitCoverage=16%, E-value=9e-35, Identity=58%"; Hit description =Putative uncharacterized protein
MNEELLQYCQKEIKDLLDKGLIRKSKCPWSCAAFYVNKQSEIERGTPRLVINYKPVNQALQWIRLKKNPPPWSDLHTQTVKEIKVKVQSIKCLYLPIPQAFKIVETDASDIGYGGILKQQNISRALPTLYLTTSPVNFYRKFPMPPK

SEQ ID NO: 110061 - protein, 268 aa, Glycine max
  Coding DNA Sequence Number=SeqID_18376
  Subcellular localization annotation: CTP_CleavageSite=30; ConfidenceScore=5.09e-01
MDHIVAKVLIDNGSSLNVMPKSTLEKLPINASHLKPSSMVVRAFDGTRRELSVGASVDPLGGSCSLYTPPKLPIHSGRASGHRIRRGRHLGELPILYALCGGRRGVIRNRFPVFRGGKHFLRGFLLWATLPVRCSSNDGPSYVGERLRTRNGFRQRHGSITKLINAKGNSGKYGLGYKPTQADIKRSIAGRKSGSQGSRLRQEGGGSPPCHISRSFISAGLGDEGQVVAIYEDDVPSTLDLVRPCPPDFQLGNWRVEERPDIYAASIM

SEQ ID NO: 110062 - protein, 78 aa, Glycine max
  Coding DNA Sequence Number=SeqID_18377
MLLFALSLGHSLLDIILIIIIAPCGPCRPWIFFINRVLCFLKIMAAEWRRKKDDWRCHFKKKMSQEEVHHHMKPWIRA

SEQ ID NO: 110063 - protein, 74 aa, Glycine max
  Coding DNA Sequence Number=SeqID_18378
MKGNQQRMESPTVATYPSAGGRRETRGMRVPRKEYARSRHQRLFEENVGKTGKDEIYELLSERFGSCIYARGRY

SEQ ID NO: 110064 - protein, 295 aa, Glycine max
  Coding DNA Sequence Number=SeqID_18379
KVEIYHTKLDEFKGELERRNFHKRLTNLANSSISLALVKEFYANLYSPEGPSPKQVKIQGHLIRIDADNLNAFLETHMVLAKGESLPAYSRYCRMPTDIREIEVALCIPGQGFILNVEGHPGKILRKDLTTLAQVWSVLSYSNLALTSHTSDLTMDRARLIFGLVTQLDMNVRALISGQITSMAQSNSSKLGFPALIIALCRTRGVTSNTLVFECLSRVINLAYIRKNCWNPDDPTIIIRGARRPRARTAEALSTSAAPPPARIVAALSTLPPANFQCFEAYIRGRLFCCKVSRW

SEQ ID NO: 110065 - protein, 90 aa, Glycine max
  Coding DNA Sequence Number=SeqID_18380
MLGNPFWIPSDGQKSSVKLLLHFFFYLQGRFGLHPPQFLFYWGTPGDLEAIGAAQCQNSNRAYLGAAMPVPIFTSLFPLPIPKSTSSVSP

SEQ ID NO: 110066 - protein, 168 aa, Glycine max
  Coding DNA Sequence Number=SeqID_18381
  Homolog annotation: Hit_ID=A7UQU7; Match level="QueryCoverage=86%, HitCoverage=29%, E-value=7e-19, Identity=32%"; Hit description=IMP dehydrogenase/GMP reductase, putative
CIVFANKSATHVHVVFLDTLRDLSQIGMYAWGAIALCWIYEHFLSVAECIADLDYNEVSPRACRWIATNATVKTKSTATYRQRLDRLRIPDVCWMPYGEHQPVREFHLISCFSGRLRWGLVAVRHRPERVMHQFGYVQSIPTQPIDSWESFDEIDDRWIHYLDHLAPT

SEQ ID NO: 110067 - protein, 76 aa, Glycine max
  Coding DNA Sequence Number=SeqID_18382
MAPRKLSAKRSRKGATAEGTSAAPKFDSHRFRSAKHQQRFEAIKGWSFHRERRVQLRDDEYTDFQEEIARRRWTSL

SEQ ID NO: 110068 - protein, 177 aa, Glycine max
  Coding DNA Sequence Number=SeqID_18383
MCSVIADAIYILQGLGFPALITGLCQSFGVPVAPTKVIRPPITRAFIEKYCTQRQAQGDAPQAAGAPPPPHQAGQAGAFDMEQYLRHLVRQQAANHRAHVRTHDCLYQMSLSMQSQGFAPFSCPTPDQFRAEVAWPGDWPEAQAGEAPPEAPGDGEEAHEDEEMADLLDFLGGSGDT

SEQ ID NO: 110069 - protein, 139 aa, Glycine max
  Coding DNA Sequence Number=SeqID_18384
MEAMKEKMSTMMEAMMSMRKMMEVNTDTVVAASTATKVDPTHPSGLNQNKNSFPPYGLPPNYTPPNVAHIPDENVENFAPMPIESQQPQSDHAHVSQPMGETHEAPLDHNLADFELHLGYAIEGQAVGGVPLPNTLEGP

SEQ ID NO: 110070 - protein, 127 aa, Glycine max
  Coding DNA Sequence Number=SeqID_18385
MWQPLGGLSLRPYKRELRKSPDTPPPLMAKPVPFPYQNSHAVPWRYTPPGKKEEEVTDVSSLSAKVTNITGLSGVTRSGRVFAPPDLPVQPADVKGKGKVVEEQDGEASHASNKDIPAKGPPEKKGW

SEQ ID NO: 110071 - protein, 38 aa, Glycine max
  Coding DNA Sequence Number=SeqID_18386
MEEKLACGASMEGGSLSFNDVGGWFSTMEMQRKTKEKR

SEQ ID NO: 110072 - protein, 147 aa, Glycine max
  Coding DNA Sequence Number=SeqID_18387
  Gene Ontology: Biological process=viral procapsid maturation
  Homolog annotation: Hit_ID=Q66BK7; Match level="QueryCoverage=74%, HitCoverage=40%, E-value=5e-36, Identity=56%"; Hit description =Capsid portal protein [Enterobacteria phage 186] gb|AAC
ESAGLPPDYLVFGNAFTELRRNALGKPLRLETSPTKYTRHSVEEGVYWFVKEWKEAHQFEADQAATLFRHKYYQNGAHASYILYMTDTAQSTSDIERICQAMRDTKGSGNFRNLFIRPVKRTPRATLNDGHYFGHCWRVRGCGEGGA

SEQ ID NO: 110073 - protein, 360 aa, Glycine max
  Coding DNA Sequence Number=SeqID_18388
  Gene Ontology: Mol. function=helicase activity; Biological process =viral genome replication
  Homolog annotation: Hit_ID=Q2A9I1; Match level="QueryCoverage=100%, HitCoverage=26%, E-value=1e-82, Identity=43%"; Hit description =Putative uncharacterized protein
MKKGKCSRFYPKKFQPHTVLDADGFPVYRRRNNGNAIEKNGVIVDNKYIVPYNARLLRKYQVHINIEWCNQSTSIKYLFKYINKGYDRVTTILIDEDNDQTENGGTHNDEIKEYLDCRYISPCESTWRIFGFPIHGRKPVVERLHFHLPGQHSVLYEDHDDIDDDLFLVCIQSEERCWQLRKKGYTIGRLLWVPPITGELCYLRMMLTVCKRATSFEDLRTVDNVQYSKYKEACFAMGFLQDDKEFIEAIKEAKDWGSAHYIRKLFVLLLLTATMSKPKQVWDQTWHWMADDIVYNYKKSSTSPALQLDDRTLQNLVLLEIEQLLQANQRSLRDYPSMPYPEDENCPAYLDNSLILLELN

SEQ ID NO: 110074 - protein, 395 aa, Glycine max
  Coding DNA Sequence Number=SeqID_18389
  Homolog annotation: Hit_ID=Q6WAY6; Match level="QueryCoverage=95%, HitCoverage=64%, E-value=9e-23, Identity=26%"; Hit description =Putative uncharacterized protein
MANQGDWVPFMDVLALLIFGVVLFPNVDGLEDLAAIDAFLAYQHSKESPVVAVLADLFDTFDRRCEKSSARIICCLPALCVWLVSHLSLQDTRHPCPLQSHRSCTEKRRIDWDQLLAGIGDRTINWFPRWKEGKEGVLFSCGGYPNIPLIGTRGCINYNPALAIRQLGDFGAQNFKAIQRIHKAWETPLRKDQELRGIRNGIIGGYHGWLKVHIRGLDWLAKLKVISEESFEAPEEDEEVQALKSELGKAKIAKEKFKLAATHIRKECAGLWEENAITARALEQETKRAHKEEYGRNKFRGALWGSNSELKLRREERDQSRAHSMVLKEELVACSRSKRSLSQRLCETETNMLAIITKYQEELGLATAHEHRVADEYAEVYAEKEARGRVIDSLH

SEQ ID NO: 110075 - protein, 153 aa, Glycine max
  Coding DNA Sequence Number=SeqID_18390
  Gene Ontology: Mol. function=nucleotide binding; Biological process =defense response
  Homolog annotation: Hit_ID=A5BAA8; Match level="QueryCoverage=82%, HitCoverage=20%, E-value=2e-12, Identity=30%"; Hit description =Putative uncharacterized protein
IPHFPLEQRQTSSRGNQDITWQKHRRDPLFIEEDEVVGLDGHRGVGKTTLAKQVYDQVRNNFECHALIRGAQSFSTEGGVRHMLNEHCKEKKEDPPKDVSTIESLTEEVRNRWRNKRAFQYSSDGDCPEELKDISLEIVRKCKGLPLAIVAIG

SEQ ID NO: 110076 - protein, 73 aa, Glycine max
  Coding DNA Sequence Number=SeqID_18391
MGETHEIPHHNLADFEPWLGYATEGQAVGGNGVSSGHLSVTHNHNPHIPSLKYALMLWQKWERWKGSGPFGRR

SEQ ID NO: 110077 - protein, 17 aa, Glycine max
  Coding DNA Sequence Number=SeqID_18392
MADQQATKSKAKGSKIP

SEQ ID NO: 110078 - protein, 248 aa, Glycine max
  Coding DNA Sequence Number=SeqID_18393
  Homolog annotation: Hit_ID=Q6WAY6; Match level="QueryCoverage=98%, HitCoverage=40%, E-value=1e-20, Identity=30%"; Hit description =Putative uncharacterized protein
MARIAKVVKISVQELDRVKQNRNGVVGIPRKHLEEKAKALADRGEWASFIDVLALLVFGVVLFPNVDGLVDLAAIDAFLAYHYSKESLVVAILADAYDTFDRRCEKSSARIIYCTPALYVWLVSHLFRHESRPICPLQGHCTCAEKGKANWEQLLASIVGTSVNWFPRWKEGRVGVLSSCQGFSNIPLMGTRGCINYNPILAIRQLDYPMRGASSEESTMPFIAWGFSDPNADISKGPKGTACGAKEG

SEQ ID NO: 110079 - protein, 213 aa, Glycine max
  Coding DNA Sequence Number=SeqID_18394
QRDSKVSMTDLVSAEDNAFRLTDSKKFIRITTRVFPSRQRDSKVNMTDLVSAEDDGAEDDVSLCVLLGFSSYRQQKVYTDNHSGISARQRDSKVNMTDLVSAKDDVNLRMSTGLSAAIDEGQNDDVSLCVLSGFLSYRQQKLYTDNHSDISARQRDSKVSMTDLVSAEDDVNLHVSTGLSAAIDDGAEDDIILCVLSAFRLTDSKKFIRITTR

SEQ ID NO: 110080 - protein, 105 aa, Glycine max
  Coding DNA Sequence Number=SeqID_18395
  Homolog annotation: Hit_ID=Q4A3R7; Match level="QueryCoverage=86%, HitCoverage=27%, E-value=3e-07, Identity=41%"; Hit description =Capsule O-acetyl transferase
MSSKVILMMPKNQESRKSKDSRIKFQDSRFKFQESRFKNNQDQDSRLKIQESREDSIKIIQVEDTSTWFFKETKGGYIPCGSLACKGFYKVERNPKNHRLLGDWM

SEQ ID NO: 110081 - protein, 71 aa, Glycine max
  Coding DNA Sequence Number=SeqID_18396
MAKLSTSVLSELSARLVLSSNSLTRAKHKNGAKGDVEIRKPFLILICTELRGETRELFTTQRPEECGFQRA

SEQ ID NO: 110082 - protein, 31 aa, Glycine max
  Coding DNA Sequence Number=SeqID_18397
MNGEFNRGGGHKPLFEDSPSECGGGTATDMG

SEQ ID NO: 110083 - protein, 171 aa, Glycine max
  Coding DNA Sequence Number=SeqID_18398
  Homolog annotation: Hit_ID=A7R5Q5; Match level="QueryCoverage=54%, HitCoverage=19%, E-value=7e-11, Identity=37%"; Hit description =Chromosome undetermined scaffold_1022, whole genome shotgun sequence
MTRGNPGDLQPFDPEIDRTFHRLVRHNVYPDHSVHFEHFEHPDHFEHSIAGDFEYSDFEHSTIYFHTGNMAQPPPRERTLREMAAPDFTYESLCVQCPDEGVPYALKTGLIHLLPKFHGLAGEDPHKHLKEFHIVCSTMKPPNVQEDHIFLKAFPHSLEGVAKDWLYYLAP

SEQ ID NO: 110084 - protein, 136 aa, Glycine max
  Coding DNA Sequence Number=SeqID_18399
MIRGDTYGYLHPFAIQTQSCPMARRDQVWSFCTHDTRRYLMVIYTPFVHSRHSRGPMARRDQVWSFCTHDTRRYLMVIRTLLSSRGGGPDGTAETKFGHSAPMIRGDTLRLSAPLCHSDTVVSDGTQRPSLVILHP

SEQ ID NO: 110085 - protein, 35 aa, Glycine max
  Coding DNA Sequence Number=SeqID_18400
MKMLLIPHDMNGSGMEKEEREETPLDAILPRKGIG

SEQ ID NO: 110086 - protein, 98 aa, Glycine max
  Coding DNA Sequence Number=SeqID_18401
MNRKYAQTKIPHGLSPYKSHALMPLRHFTEHLVGARLGINSKRTGTMWHSTKRRSKYTNEKLESLGMEYLLVGDEQKRKTESKNAKKDDPRAANSSIP

SEQ ID NO: 110087 - protein, 103 aa, Glycine max
  Coding DNA Sequence Number=SeqID_18402
MSKSCGFGMTGPLDESISCFLIRVDPWVLVPITLRGLHVLAIRGLHVLNFRGLHALAIRGLHVLALRGLHALILVTLTVERTTRPRLERTTRPHHQRAARPHL

SEQ ID NO: 110088 - protein, 75 aa, Glycine max
  Coding DNA Sequence Number=SeqID_18403
MASIMEAVATCPFASEGEAHGCAFQRRKDARSRHQRLFVENVGKTEGNWSTKAGLLLLRTLHQRGNQTYVVLSYA

SEQ ID NO: 110089 - protein, 61 aa, Glycine max
  Coding DNA Sequence Number=SeqID_18404
MTPTPLHAQKWRSICGHAGSPTSLITGKPHLEFSSFDGTLSLVVPTATMFDIKEVDISRNL

SEQ ID NO: 110090 - protein, 289 aa, Glycine max
  Coding DNA Sequence Number=SeqID_18405
  Homolog annotation: Hit_ID=Q6WAY6; Match level="QueryCoverage=64%, HitCoverage=30%, E-value=8e-19, Identity=33%"; Hit description =Putative uncharacterized protein
MEMQQKTKEKSLLYPMPLWGRIASEVSAKAIVSLTQYYDQSLRCFTFGDFQLAPTIKEFKGILGCPLGGRKPYLFSGFYPSMARIAKVVKISEQELDRKENPVTTILADAYDMFDLRCEKSSARIVCCMPALYVWLVSHIFRHEGRSVCPLQGNRMCAEKGKANWEELLEGMVGASINWFPQWKEGGAGVLCSCEGFPNVPLMGMRGCINYNSMLAIRQLGYPMRGAPSEEIILPFIARGFNEANVKILQRIHRAWNTMERKDKELSGSSNGVIGGYHNWLKSRTQGIT

SEQ ID NO: 110091 - protein, 115 aa, Glycine max
  Coding DNA Sequence Number=SeqID_18406
RLTGAHEVPHHNLANFEPCLGYATEGQAIGGTCRNLPFCGQARRGLQVDKSGALAPTYPPSKMKPDLRSSCKRGESIDSFYLEGGPFKALDLKMTHFYLVRKTEVSNLKILFIEP

SEQ ID NO: 110092 - protein, 130 aa, Glycine max
  Coding DNA Sequence Number=SeqID_18407
LTNMSLATLFGKLQEHEMELMRLYQHEENDKKRIGIALKASSSSIHEENDKEDSNEKNLKEDDDFSLFVKRFNKFLRNKGNQRRSKFNPKKKGEDSSLVPKFYECDQLGHFRFDCCSNPASALDHTSSIK

SEQ ID NO: 110093 - protein, 180 aa, Glycine max
  Coding DNA Sequence Number=SeqID_18408
  Homolog annotation: Hit_ID=A6FJQ2; Match level="QueryCoverage=21%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPRALTLLAQGPGGGRETCRASCINESANARGEAVCVLGALPLPRSLTRCARSFGCGERYQLTQRRSFAPSWAVCTNPPFSPTAAPYP

SEQ ID NO: 110094 - protein, 78 aa, Glycine max
  Coding DNA Sequence Number=SeqID_18409
MELQRLNQNEETDKRKRSIALKASSSMQEEEEESDDEEDFSLFVKKFHKFVKNRRMERSHNFNNGKRSQEVSPTLKCY

SEQ ID NO: 110095 - protein, 184 aa, Glycine max
  Coding DNA Sequence Number=SeqID_18410
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTEIHNPPGMQAWHWPSFYNVVTGKTLALPNLIALQHIPLSPAGVIAKRPAPIALPNSCAA

SEQ ID NO: 110096 - protein, 88 aa, Glycine max
  Coding DNA Sequence Number=SeqID_18411
  Subcellular localization annotation: CTP_CleavageSite=54; ConfidenceScore=5.49e-01
MVSLANVRMHKRFPPQILASPHQLDFALMFKSPTMLNGMPRNSPMISTCQVGVVSSRKWSCFLFHFFFVEIYSKEIRFAGKRTGSSSI

SEQ ID NO: 110097 - protein, 185 aa, Glycine max
  Coding DNA Sequence Number=SeqID_18412
MGRLQDTHRVVNSASNSLCNFQIQTAIAQTSEWTMARGIHRYQNSPLAYMFQKDIELVDEEEAQIGADRSSATSNKAEIYNEEARKKTQKHKPKRVESVNADAEAFAEALEHMKKRDTGHQSVSLENKTGDLTMLKIGDSAKVVIKQDMKGRKHKYGFNNNKRQRQRRKGWWMMKLATNISWMKS

SEQ ID NO: 110098 - protein, 102 aa, Glycine max
  Coding DNA Sequence Number=SeqID_18413
  Homolog annotation: Hit_ID=P0AF38; Match level="QueryCoverage=76%, HitCoverage=96%, E-value=4e-23, Identity=74%"; Hit description =Uncharacterized protein yiiU
  Pfam annotation: Domain name=DUF904; Domain location=1-79; Score =139.6; E_value=8.8e-39; Accession=PF06005.3; Description=Protein of unknown function (DUF904)
MSLEVFEKLESKVQQAIDTITLLQMEIEELKEKNNSLAQEVQNAQHGREELERENNQLREQQNGWQDRLQALLGRMEEDNAGIIGVEMVPGEEGHAAEIDAH

SEQ ID NO: 110099 - protein, 264 aa, Glycine max
  Coding DNA Sequence Number=SeqID_18414
  Gene Ontology: Mol. function=motor activity; Cellular component=cell projection
  Homolog annotation: Hit_ID=UPI00016621D1; Match level="QueryCoverage =98%, HitCoverage=41%, E-value=4e-20, Identity=33%"; Hit description =UPI00016621D1 related cluster
GLHVLAFRGLHVLTFRGLHGLAFSGLHVLAFRALHVLTFRGLHVLAFRGQHVLVFGGQHFLAFRGPHALAFRGLHVLAIRGLHVLAFGGLHILTIEGLHVLALRGLQVLTFRGLHSLAIKGLRVLVFRGLRALAFVGLHVLNFRGLHVLAFRGLHTLAIRPLHVLTFTGLYVVAFRELQVLAFGGLDAIAVRGQHVLAFRGQHVLTFRGIHILTFRGLHVLAFSGLHVVTFKGLHVLTFRGLHVLAFRGLDILTFKGLHILAFR

SEQ ID NO: 110100 - protein, 182 aa, Glycine max
  Coding DNA Sequence Number=SeqID_18415
VWRYQAPLDPDKSNRALGFPALITGLCQSFGVPVAPSKVIRPPITRAFIEKYCTQRQVQGDAPQATDASPPHQAGPAESFDMERYLRHLVRQQAANHRAHVQTHDCLYQMSLSLQSQGFTSFPCPTPDQFMAEVAWPGDWLEAQAGEAPAGAPAEAPDEADEAHEDEEMTDLLDFLGGSGAT

SEQ ID NO: 110101 - protein, 64 aa, Glycine max
  Coding DNA Sequence Number=SeqID_18416
  Subcellular localization annotation: CTP_CleavageSite=54; ConfidenceScore=5.25e-01
MYISTAQKYIMKHSQQNMLSNKTPHTYSQNNSKAPKFLKVKEASTRIKPRLLCKQSMGKNTPND

SEQ ID NO: 110102 - protein, 106 aa, Glycine max
  Coding DNA Sequence Number=SeqID_18417
  Homolog annotation: Hit_ID=A5C407; Match level="QueryCoverage=56%, HitCoverage=3%, E-value=5e-07, Identity=42%"; Hit description =Putative uncharacterized protein
STLEDPPTIREVVEMLAQAKKPNAFQKQLPRKVADNLIGIQRSFLWGGGTFNKVLLEKWRWDLFHQSKELWARILASKYGGEQYGGWAVGIKFISGRINGLELVNH

SEQ ID NO: 110103 - protein, 49 aa, Glycine max
  Coding DNA Sequence Number=SeqID_18418
MMQSYPARALDRRLQVDWARDPRESPRVLMSLRLSSSFSSQGGDLAIRE

SEQ ID NO: 110104 - protein, 360 aa, Glycine max
  Coding DNA Sequence Number=SeqID_18419
  Homolog annotation: Hit_ID=Q2HW90; Match level="QueryCoverage=83%, HitCoverage=68%, E-value=4e-24, Identity=27%"; Hit description =Putative uncharacterized protein
MGSNQAPSFKKRFYPVKIKSLEDLAMIEVSIEAIASLTQYYDQPLRCFTFGDFQLVPIVEEFEGILGCPLGGRKLYLFFGLYPSMARVAKVVKISTQELDRVKQNRNGVDGIPKKHLEEKAKALADQGEWTSFIDVLALLVFGFILFPNVDGLVDLATIDVFLAYHYSKESPAIVVLADAYDMFDQRCEKSSARIDCCTPALYVWLVAHIFHHESRPVCHIQGHRMCAEKGKANWEQLLVGFPNVPLMGMRGAPSEESITPFIARGFSDPNARMLQRVRKAWNAVQRKDKELKGSSNGIIGEYHKWLKARMREISWLPKLKISSGEEAKVPEESEEVLALKAELERTRVVKEKFKTIAIR

SEQ ID NO: 110105 - protein, 333 aa, Glycine max
  Coding DNA Sequence Number=SeqID_18420
  Gene Ontology: Mol. function=metalloendopeptidase activity; Cellular component=periplasmic space; Biological process=proteolysis
  Homolog annotation: Hit_ID=A4WFU9; Match level="QueryCoverage=100%, HitCoverage=67%, E-value=1e-161, Identity=83%"; Hit description =Peptidase M16 domain protein precursor
  Pfam annotation: Domain name=Peptidase_M16_C; Domain location=35-214; Score=99.6; E_value=9.8e-27; Accession=PF05193.12; Description =Peptidase M16 inactive domain
MVATWPADTKEGWWRYRLKGSTLLGHDPAEPLKQPVDAEQVKSFYQKWYTPDAMTLIVVGNVDSRAVVEQINKAFGDLKGKRETPAPVPTLSPLRAEPVSIMTDTVRQDRLSVMWDNAWQPIRESAALLRYWRADLAREALFWHVQQTLSKNNVKNIGLGFDCRVLFQRAQCAINVESPGDKLNANLGVVAKELAKVRKEGLPEEEFNALVAQKKLELQKLFATYARADTDILISQRIRSLQNQVVDIAPEQYQKLRQDFLNGLTVEMLNQDLRQQLSQDMALILLQPKGEPEYDMKELQTTWDSIMATAPQPAQAATADDLHPDATDIPQGQ

SEQ ID NO: 110106 - protein, 449 aa, Glycine max
  Coding DNA Sequence Number=SeqID_18421
  Homolog annotation: Hit_ID=Q84VH5; Match level="QueryCoverage=98%, HitCoverage=76%, E-value=0.0, Identity=71%"; Hit description =Envelope-like protein
MIPGPGPVPEKLVPKRQQGVKISENPSFATSPREEDTEMDKKIRSFVNSILKNASVPDADKDVPTSSTPNAEVLFSSSEEKSTEEEDQATEETLAPRAPEPAPGDFIDLEEVESDEEPIAKKLAPGIAERLQSRKGKTPITRSGRIKTTAQKKSTPITPTTSRWSKVAIPSKKRKEISSSDSDDDVELDVPDIKRAKKSGKRLALERELGRDALDCKEIMDLIKAAGLLKTVTKLGDCYESLVREFIVNIPSDITNRKSDEYQKVFVRGKCIRFSPAVINKYLGRPTEGVVDIAVSEHQIAKEITAKQVQHWPKKGKLSAGKLSVKYAILHRIGTANWVPTNHTSTVATESFAVKLPIAFPTVLCGIVLSQHPNILNNIDSVKKRESPLSLHYKLFEGTHVPDIVSTSGKAAASGAVSKDDLIAELNDTCKVLEATIKANTEKKCSWNA

SEQ ID NO: 110107 - protein, 41 aa, Glycine max
  Coding DNA Sequence Number=SeqID_18422
MGANDIIIDKQYVSYPNFVRGPLLDDVRPFFGPREVLGTHH

SEQ ID NO: 110108 - protein, 138 aa, Glycine max
  Coding DNA Sequence Number=SeqID_18423
MSQNLTDYAIVPSLASGLLRNFTDCALTLPSNSRHVAELHRLPNDGCQVPRSGQARVASQQTDGPWMKLGDSPPQISANLHRSDFAPYVSRSYNAQWNAPGWCLVLDVQQVDFVADLGVAIVDDWAFLVGRVVSNGKD

SEQ ID NO: 110109 - protein, 100 aa, Glycine max
  Coding DNA Sequence Number=SeqID_18424
MEGSQQNTHYPKEILPKIITHKWKFGNLLEAPNTLPMKGLFVTKLESNKVLLSPIALKVVSPLLLDSILQGMAPILLSNPYMALTNKETKRQQYQRPKNE

SEQ ID NO: 110110 - protein, 104 aa, Glycine max
  Coding DNA Sequence Number=SeqID_18425
  Subcellular localization annotation: CTP_CleavageSite=59; ConfidenceScore=5.20e-01
MRKRHASRREKGGQVSGGASRVDLHMQALVTGRSFFTTFFCVPDSGINPGVTLMSCNPRLAAERSPSFAASSERRIAEEALQPIALPRDVASRSLECSAERFPD

SEQ ID NO: 110111 - protein, 125 aa, Glycine max
  Coding DNA Sequence Number=SeqID_18426
MPIIRAFIEKYCTPRQAQGDAPQAADAPSPPYQVDPAESLGMERYLQHLIHECLYQLSLSQQGQGSAPFTCPTPDQFRAEVAWPRDWPEAQAGEVPAGAPDDVEEARMDEEMTELLGFLGGSRAT

SEQ ID NO: 110112 - protein, 52 aa, Glycine max
  Coding DNA Sequence Number=SeqID_18427
MSAALMADRSGVTFHEDIRVILAILDPALIAVSRSGPVVIAGKSIVLKPPTQ

SEQ ID NO: 110113 - protein, 128 aa, Glycine max
  Coding DNA Sequence Number=SeqID_18428
  Homolog annotation: Hit_ID=A4WFU7; Match level="QueryCoverage=100%, HitCoverage=49%, E-value=3e-59, Identity=87%"; Hit description =Diguanylate phosphodiesterase
  Pfam annotation: Domain name=EAL; Domain location=1-128; Score= -130.6; E_value=0.056; Accession=PF00563.11; Description=EAL domain
MAIEILTVVTHPSNPLQRIAPDRYFAEVAVRQRLDVLEEQLRMLATKQAFFERHNILASVNVDGPTLLALRQNAKLQELIATLPWMRFELVEHVRLPQDSSFASMCEFGPLWLDDFGTGMANFSALSE

SEQ ID NO: 110114 - protein, 152 aa, Glycine max
  Coding DNA Sequence Number=SeqID_18429
  Gene Ontology: Mol. function=endonuclease activity
  Homolog annotation: Hit_ID=Q9AY32; Match level="QueryCoverage=36%, HitCoverage=83%, E-value=2e-22, Identity=96%"; Hit description=RRNA intron-encoded homing endonuclease
GRSGEGAEKRLHIQGSSRRANYPILTRGVKKLVVGPWVGSIGPPPVCTGRLVPSAGDALLSLTGRVVPPDSDPIVLAFGIGVMINRDSRGHSYFIVRDTVLVSTINDADQGSADVAFRTPLAPYEKSKSLGSGGSMVARLKLKGIDGRAPPG

SEQ ID NO: 110115 - protein, 156 aa, Glycine max
  Coding DNA Sequence Number=SeqID_18430
MSASEADSTKDSGPGDMAISGGSSSYHYFGDATKATTSPSSSESEEAKGQESNEEIYPQEEGQPLVVKEKCKEVSVSSKRLAKKETHFTIKTNIKETFPLRQPPHFLFCKKTLASIATPPGLEFIPQVKKLLDVGLVRKSLNPCALLVPKIGMGIL

SEQ ID NO: 110116 - protein, 230 aa, Glycine max
  Coding DNA Sequence Number=SeqID_18431
  Gene Ontology: Mol. function=transporter activity; Cellular component= integral to membrane; Biological process=transport
  Homolog annotation: Hit_ID=P0AEG0; Match level="QueryCoverage=100%, HitCoverage=67%, E-value=1e-113, Identity=87%"; Hit description =Dipeptide transport system permease protein dppB
  Pfam annotation: Domain name=BPD_transp_1; Domain location=59-230; Score=24.9; E_value=0.00031; Accession=PF00528.13; Description =Binding-protein-dependent transport s
MAGERGISPERHAQLMAQFGLDQPMWKQYITYINGVLHGDLGISLKSRIPVWDEFVPRFKATLELGICAMIFAVAVGIPVGVLAAVKRGSIFDHTAVGISLTGYSMPIFWWGIMLIMLVSVQLNLTPVSGRVSDTIFLDDSHPLTGFMLIDTLLWGEEGDFKDAVMHMILPAIVLGTIPLAVIVRMTRSSMLEVLGEDYIRTARAKGLTRMRVIVVHALRNAMLPVVTVI

SEQ ID NO: 110117 - protein, 168 aa, Glycine max
  Coding DNA Sequence Number=SeqID_18432
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRNRKKAALLAFFHRLRPPDEHHKIDAQ

SEQ ID NO: 110118 - protein, 140 aa, Glycine max
  Coding DNA Sequence Number=SeqID_18433
  Subcellular localization annotation: CTP_CleavageSite=7; ConfidenceScore=5.00e-01
MPISPCRCIGIAPTRRPVGPKKFNRALGFPALVTSLCQSYRVPVPPARSCHRDIESHPQRHPVDPEKSNRALGFPALVTGLCSLTGCPFPPARSRHHDIEIMPARHPVDPKKSNRVLELSSSNYGSLSVLRNACHLQQGH

SEQ ID NO: 110119 - protein, 202 aa, Glycine max
  Coding DNA Sequence Number=SeqID_18434
  Gene Ontology: Mol. function=motor activity; Cellular component=cell projection
  Homolog annotation: Hit_ID=UPI00016621D1; Match level="QueryCoverage =97%, HitCoverage=40%, E-value=3e-14, Identity=32%"; Hit description =UPI00016621D1 related cluster
RATRLAFRGLLVLAIRGLHVLAFRGLHVLAFRGLHVLAFRGLHVLVFRGLHALSFRGLDVLAYKGLHVLTFKGLHVLTFGGLDVLAFRWQHALAFRGLHRTTCPRLQRTTCPRLQRATHPHLRGLRALTFRGLHILAFIGQHVLTFRGLHVLALRGLHVLAFRGLHVLAFRGLHVLIFRWLHALTFRGLQVLAFRGLHALAL

SEQ ID NO: 110120 - protein, 182 aa, Glycine max
  Coding DNA Sequence Number=SeqID_18435
  Homolog annotation: Hit_ID=Q51617; Match level="QueryCoverage=22%, HitCoverage=59%, E-value=2e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPNLSLRAIGHDRAWMERRRMTIICLCAPSETIASGWRKGVRNDHNLSPRAIGHNCV

SEQ ID NO: 110121 - protein, 284 aa, Glycine max
  Coding DNA Sequence Number=SeqID_18436
  Gene Ontology: Mol. function=nucleoside-triphosphatase activity; Cellular component=plasma membrane; Biological process=peptide transport
  Homolog annotation: Hit_ID=Q2NWY7; Match level="QueryCoverage=80%, HitCoverage=67%, E-value=4e-87, Identity=73%"; Hit description =Dipeptide ABC transporter ATP-binding component
  Pfam annotation: Domain name=ABC_tran; Domain location=1-132; Score =78.6; E_value=2.1e-20; Accession=PF00005.18; Description=ABC transporter
  Pfam annotation: Domain name=oligo_HPY; Domain location=135-199; Score=75.0; E_value=2.5e-19; Accession=PF08352.3; Description =Oligopeptidedipeptide transporter, C-ter
  Pfam module annotation: Pfam domain module=ABC_tran::oligo_HPY; Domain location=1-132::135-199
MTSLNPCYTVGYQIMEALKVHQGGSKRTRRQRAIDLLEQVGIPDPASRLDVYPHQLSGGMSQRVMIAMAIACKPKLLIADEPTTALDVTIQAQIIELLLELQKQENMALILITHDLALVAEAAQHIIVMYAGQVVESGKAVDIFKAPRHPYTQALLRALPEFAADKARLASLPGVVPGKYDRPNGCLLNPRCPPNVTSHWMMPGDRLMSLDNTKQDYLLQAIDLKKHYPVKKGLFGQERLVKALDGVSFNLERGKTLAVVGESGCGSAETRSAGAKAAPAENPD

SEQ ID NO: 110122 - protein, 94 aa, Glycine max
  Coding DNA Sequence Number=SeqID_18437
TSFGYRKDRNGQWLKKDALPPQDEHTHSPPPQRDDSALMTEVLSELRGLHSYVGERFDSLDTRFAGMDIRLTQLEEDVGYIRQSFDLPPPLPSS

SEQ ID NO: 110123 - protein, 113 aa, Glycine max
  Coding DNA Sequence Number=SeqID_18438
MVNNIFTPSRYKEIIMVQPKPSAGLKGKPHQHALTFMPSCIKKSKAWVPRLKSYFGIYPNLCKLSTHPKMQYSQTYAQTPLRHFTEHLVDALLGTNSKGMGTIWLAPSFQNTT

SEQ ID NO: 110124 - protein, 140 aa, Glycine max
  Coding DNA Sequence Number=SeqID_18439
MAEPSKKRKNSSSQSQRLSETQETQIPSSISSSSLFSTEEQWIRYTNLFSSRSIIDPKFIDMDFFSNESFECIQAFENSNLIPFMSLKLPIYSKLVKAFYSNLEIQEDTLISEVYGIKMVIDQSLFYDLTQLSSEGVPFE

SEQ ID NO: 110125 - protein, 120 aa, Glycine max
  Coding DNA Sequence Number=SeqID_18440
  Gene Ontology: Mol. function=nucleic acid binding; Biological process= DNA integration
  Homolog annotation: Hit_ID=A5BTC5; Match level="QueryCoverage=42%, HitCoverage=11%, E-value=2e-11, Identity=58%"; Hit description =Putative uncharacterized protein
MIWVPKGSFIKVDIQGPNNVWVSLKKIWYIDSGCSKHMMGDASKFTHISSKNSGHVTYGNNNKGRILGVGKIGKQVRGYLMVIHTFCQPEANEPVDAQRLMSSSAPFVNQRQASPLTRKD

SEQ ID NO: 110126 - protein, 104 aa, Glycine max
  Coding DNA Sequence Number=SeqID_18441
MNSWGSRLNGGGGMNSASQTIHGAPDSMVEDARTALGNQFVGLRTQWMHEQRLAINSWGSGLDGGGCMNDNQLMGLRIRFDGGGCTNSARQSIRGAPDSMVEDA

SEQ ID NO: 110127 - protein, 262 aa, Glycine max
  Coding DNA Sequence Number=SeqID_18442
  Gene Ontology: Mol. function=motor activity; Cellular component=cell projection
  Homolog annotation: Hit_ID=UPI00016621D1; Match level="QueryCoverage =89%, HitCoverage=40%, E-value=2e-17, Identity=32%"; Hit description =UPI00016621D1 related cluster
MTNPLNESISCFLIRVDPWVLEPIAFRGLHVLAIRGLHALTIRGLHVLAIRGLHALTFRGLHILAIKGLHVLAFRGLHVLAIRGLHALAIRGLHVLAFRGLHVLTFRGLHVLAFRELHVLTIRGLHVLAFRGLHVLTFRGLHALTFRGLHAVAFVGLHALTFKGLHVLAFRGLHILTFIGLYALTFRGLDFLAFRGLDVLAFRGLDVLAFRGLHALAIIGLHALTVRGLHVLAFRGLHALTIRGLHVLTLRGVQALAYKGLH

SEQ ID NO: 110128 - protein, 77 aa, Glycine max
  Coding DNA Sequence Number=SeqID_18443
  Gene Ontology: Mol. function=aspartic-type endopeptidase activity; Biological process=DNA integration
  Homolog annotation: Hit_ID=P10978; Match level="QueryCoverage=98%, HitCoverage=5%, E-value=1e-09, Identity=42%"; Hit description =Retrovirus-related Pol polyprotein from transposon TNT 1-94 [Includes: Protease (EC ...
  Homolog annotation: Hit description=3.4.23.-); Reverse transcriptase (EC 2.7.7.49); Endonuclease]
MEMGGDFHDHIKKFNQLVSQLLNANDKLSDEEQALLLLASLPRSFKALVQTLLVGRSTLNLDEVTIALRENERIMRT

SEQ ID NO: 110129 - protein, 143 aa, Glycine max
  Coding DNA Sequence Number=SeqID_18444
MAAQLIHDRVEMECLEGVWETLEGNARCQFQGTIRFTTTSLVHPEEPARTLQHTMEWILPTPTPYRLVEPVQVIEVTSSEEDPEEDLEEQPPEPVVDALDFPEGDEDPLPEVDSPEDVMSASEADSTEESGPGGIATSGGSSS

SEQ ID NO: 110130 - protein, 61 aa, Glycine max
  Coding DNA Sequence Number=SeqID_18445
MSQPTLWREGDARLTGVSSKEGKRAESPPTFIRGKRWKNEKRCGLRTVSVKGLGVVFTHRK

SEQ ID NO: 110131 - protein, 41 aa, Glycine max
  Coding DNA Sequence Number=SeqID_18446
MTLRLANMHNSSFFQILPRTQPRSVALSGWLAKLADWLSEK

SEQ ID NO: 110132 - protein, 108 aa, Glycine max
  Coding DNA Sequence Number=SeqID_18447
  Subcellular localization annotation: CTP_CleavageSite=44; ConfidenceScore=5.22e-01
MTVKTSDTCSSGDGHSCLCVRRKYRIRRHSPFRLRNCWEGRSVRASSLLRQLAKGGCAARRLSWVTPGFSQSRRCKTTASAKLACLQVDSRGSPCRGNSKTKRGNAEI

SEQ ID NO: 110133 - protein, 222 aa, Glycine max
  Coding DNA Sequence Number=SeqID_18448
  Gene Ontology: Mol. function=transferase activity, transferring glycosyl groups; Cellular component=membrane; Biological process =biosynthetic process
  Homolog annotation: Hit_ID=A4W522; Match level="QueryCoverage=98%, HitCoverage=59%, E-value=6e-91, Identity=73%"; Hit description =Glycosyl transferase, group 1
  Pfam annotation: Domain name=Glycos_transf_1; Domain location=28-194; Score=106.2; E_value=9.9e-29; Accession=PF00534.11; Description =Glycosyl transferases group 1
MTALGVPLEQTTSVPSGVDTQRFYPDDKYDARAYCELSQNDFWLGVVSHLRPNKGHSVLLKALAQINDPTVKLAIVGEGPHREALEEQIIQLNLLSRVVMAGHRPDPQRWFPAFDVAISPSHDMEGVPQGVLQSLASRIATIATDAGGTGDAVIDRRTGLLIAQNDVDALREAIVTLYQDASLRRQLAEQGYEYLTTHFTRECMLEAMESVFRSAAQRKRSR

SEQ ID NO: 110134 - protein, 113 aa, Glycine max
  Coding DNA Sequence Number=SeqID_18449
  Homolog annotation: Hit_ID=A6FJQ2; Match level="QueryCoverage=33%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPLHLIQIEVEANKWKPI

SEQ ID NO: 110135 - protein, 375 aa, Glycine max
  Coding DNA Sequence Number=SeqID_18450
  Gene Ontology: Mol. function=metalloendopeptidase activity; Cellular component=integral to membrane; Biological process=proteolysis
  Homolog annotation: Hit_ID=A6X3E2; Match level="QueryCoverage=99%, HitCoverage=72%, E-value=0.0, Identity=97%"; Hit description =Peptidase M16 domain protein precursor
  Pfam annotation: Domain name=Peptidase_M16; Domain location=2-135; Score=70.5; E_value=5.4e-18; Accession=PF00675.11; Description =Insulinase (Peptidase family M16)
  Pfam annotation: Domain name=Peptidase_M16_C; Domain location=140 -330; Score=153.4; E_value=6.4e-43; Accession=PF05193.12; Description= Peptidase M16 inactive domain
  Pfam module annotation: Pfam domain module=Peptidase_M16::Peptidase _M16_C; Domain location=2-135::140-330
MIWYHVGSADEAPGVSGIAHFLEHLMFKGTKNHPAGEFSAKVASIGGQENAFTSYDYTAYFQRVSPEALEMVMQFESDRMENLVLNEEAVKTERDVILEERRMRVDSNPASMLMENTDAVLFYNHPYRKPVIGWQQEMEKLSLKNAIDFYQQYYTPNNATLVIAGDVSPERVRELTLKTWANVPKRAEVLPRERPQEPKKHAARIVTLHDERVSTPSFRVSWLVPSYANEKRFPNAKPGDAPALDLLSEILGGSLRSRLYQELIVRQGIAANTGASYGGDALDDGTFSVYGAPRNGATLGDVEKAVEAEVARIIKEGVSQTELDQARNRFLKAVIFARDSQTGMARIYGSSLSVGQTVDDIQKWPEVIKRVTGIL

SEQ ID NO: 110136 - protein, 295 aa, Glycine max
  Coding DNA Sequence Number=SeqID_18451
NWHKQLTNLTEGSIDVAIVKEFYANLYVPKDKSPKQVRVRRHLIKFDVDSLNTFLETPVVMEQGESLPSYSRFARLRPNPQELAAWLCIPGRGFVLNVEGLPWKLLRKDLTTLAQTWNVLSYSNLAPTSHTSDLNLDRAKLVYKLVMKMNMNLGSLISGQISLIAQSNSSRLGFPALITALCKARGVTSDSLTFESLSPAINLAYIKKNCWNLDDPSVTFLGTQKSMARRSEALSSSATPAPPTPAPFTFALPSAPVTPVLPGPFAQSLEPFMSMLQSLHQGQLLIMQSLQDVVQ

SEQ ID NO: 110137 - protein, 173 aa, Glycine max
  Coding DNA Sequence Number=SeqID_18452
MKRLPTDIREIEVALCIPGRGFVLNAKGHPGKILRKDLTTLAQVWSVLSYSNLAPTSHTSDLMVDRARLIFGLVSQMDMNVELSSLSRGVASDSLVFKRLSPVINLAYIRKNCWNPDDLTVTIRGARRARTRPAEAPSTSTAPPPARTLAALSALTSAYFQRLEAMLQSIHQG

SEQ ID NO: 110138 - protein, 108 aa, Glycine max
  Coding DNA Sequence Number=SeqID_18453
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=78%, HitCoverage=12%, E-value=2e-35, Identity=65%"; Hit description=DNA -directed RNA polymerase subunit beta
  Pfam annotation: Domain name=RNA_pol_Rpb2_6; Domain location=1-104; Score=-164.6; E_value=0.00019; Accession=PF00562.19; Description=RNA polymerase Rpb2, domain 6
MAKESSYSPEDRLLRAILGIQKREIKVGDKVAGRHGNKGIVSKILSRQDMPYLQDGRPVDMVFNPLGVPSRMNVGQIFECSLGLAEWTIMHLLHNNHLEEGPSREDNG

SEQ ID NO: 110139 - protein, 118 aa, Glycine max
  Coding DNA Sequence Number=SeqID_18454
MARRDKLWSFCALLSSKGGEPDDMRRQIMVIPHTFSPFRHNRVRWHAETNYGHFAPFCHPEAASPMTCGDKLWSFRTPFRHSETIVSDGTQRQMVILRLVSTERNGFGSIRMMLVVRC

SEQ ID NO: 110140 - protein, 138 aa, Glycine max
  Coding DNA Sequence Number=SeqID_18455
MYNYHEKRRAPDLESVLADFMTYQANSNAFKRAETQIRKLVDDMIKVMVRREEEYAEIETHQESILQVNTIHHQLITKEEKDEVSIIPEYPCIATTGYVVGKDKGRLELSVEDQKISFDLFEAMKHPDMSDAYFEEEE

SEQ ID NO: 110141 - protein, 39 aa, Glycine max
  Coding DNA Sequence Number=SeqID_18456
MKRCIMRSRKPDMGLSVTMHHQKRKTLDETSLLSSELGI

SEQ ID NO: 110142 - protein, 118 aa, Glycine max
  Coding DNA Sequence Number=SeqID_18457
MAYGYRGTLFYSLFVAEDHDESSVHKVEIEQTKIVSFSLQALIKMSSPLEISEPITSTHTNDNEVNVQVPADSTQVEANNEENEHQEPVVRRKRKKTLVVWNDFDEMEISPGVKKVVL

SEQ ID NO: 110143 - protein, 109 aa, Glycine max
  Coding DNA Sequence Number=SeqID_18458
MRLLMLEEGEEDAQNKRGPYGCIDRIQILKTKTNRMTNEERYRSRLRSNLARPGELSSHRRAGYITPKLFGGPSEPEASLGEPRFRKPPEMTLLPLLFSMFCILDQNIE

SEQ ID NO: 110144 - protein, 149 aa, Glycine max
  Coding DNA Sequence Number=SeqID_18459
  Gene Ontology: Mol. function=helicase activity; Biological process =viral genome replication
  Homolog annotation: Hit_ID=A2YRS6; Match level="QueryCoverage=88%, HitCoverage=26%, E-value=3e-24, Identity=35%"; Hit description =Putative uncharacterized protein
MMMEQQDNVLMSLSTMLMVDDDEIDALLSKPTIKESMFTSWLQTNSIFNESKHLTYMQFITKSTYLAKDRCWKPRKGGYTIGRLNWVPPSTGELYYIMMMLVVVEGPTSYEEICTVNGQLYPLFREACFVMGFLLDDKEYIEALTEAYH

SEQ ID NO: 110145 - protein, 35 aa, Glycine max
  Coding DNA Sequence Number=SeqID_18460
MLRMLKREKKDCKSDGLPLVIHYIQHAQLVAFLCK

SEQ ID NO: 110146 - protein, 168 aa, Glycine max
  Coding DNA Sequence Number=SeqID_18461
  Pfam annotation: Domain name=G-patch; Domain location=26-70; Score =20.5; E_value=0.00062; Accession=PF01585.14; Description=G-patch domain
MAFQSFEVVSCASVEPSPSLPSLSKAAIMVARVMLRNGFDPGMGLGKDCLGNADVVDIKGNPYKYGLGYEPEMPGRRNVTSRFRVDKVWPDRISQCFTSAGMASEEEVAAIEEEFPHDPPSFVQPCHPDFQVGNWRVIRQSEVYTADSMYLEPIDFRSLLFCETYLIK

SEQ ID NO: 110147 - protein, 110 aa, Glycine max
  Coding DNA Sequence Number=SeqID_18462
QKLLAEKTKKKLEEAAQSGSVDGVIDPPSPATQGSFVPHGRQDVLAAAIGRPEHPGRVRAAGAGVTIKQYYGSAPRTSRSASSLPPDELQQLTQQIRDRLEESITEKVTR

SEQ ID NO: 110148 - protein, 111 aa, Glycine max
  Coding DNA Sequence Number=SeqID_18463
  Subcellular localization annotation: CTP_CleavageSite=32; ConfidenceScore=5.22e-01
MPPHTNTAGPSDNPKNVQTNMSVPPHRKHVLVANHVPVLQNSSDLKETGNTELDDLIEEGFVQVKTKHQKKGKKVSLIKTTRIEDMQADVQRGRNHKAVTRVEEASSRPNP

SEQ ID NO: 110149 - protein, 218 aa, Glycine max
  Coding DNA Sequence Number=SeqID_18464
  Subcellular localization annotation: CTP_CleavageSite=78; ConfidenceScore=5.09e-01
MTVKTLTHAAPETVTACLCVRRKYRIRRHSPFRLRNCWEGRSVRASSLLRQLAKGGCAARRLSWVTPGFSQSRRCKTTASAKLACLQVDSRGSPERLKSLLRRFPNHSFDDAAQLPIFYSGLKPHTKMILDASARGTMMSKSPKEAIVIIDSIAASDYQSHHDRAPVQRKGGLRIGRSSASSLTDSLRSVVRLRRAVSAHSKAVYGYPQNQGITQKDM

SEQ ID NO: 110150 - protein, 40 aa, Glycine max
  Coding DNA Sequence Number=SeqID_18465
MDPKRIKVIPEWPTPPSVEERIHEFQEPLDLSQILFKGRE

SEQ ID NO: 110151 - protein, 45 aa, Glycine max
  Coding DNA Sequence Number=SeqID_18466
MAERQSGSRRAWVMVLGSMGEEAWTWRLSFWMDSCGDDCEVGGGD

SEQ ID NO: 110152 - protein, 239 aa, Glycine max
  Coding DNA Sequence Number=SeqID_18467
MVWQSPNQKSIFSKLEFDSLVTIYIKAFKIVETDASDIGYGGILKQRVHGQDHNTSRAPQIHYLTTLPVNSYRKVVMSPKASGISLRGGRSTGKGARLALPEPTIKKSSTSSGSPTQAGSSTQKTNLEGSSTQIASIKPEPSTQESPKPATAKQTSADYAWPIETLQALQDMGLTKFPKIIKKSWADIASESDDESESNLQTMIQKASMTKTATNTKGKLPLAKAQHHLQNKLTIIFIK

SEQ ID NO: 110153 - protein, 135 aa, Glycine max
  Coding DNA Sequence Number=SeqID_18468
MGEVEEIQEKMKADMEAMKEQMAAMMEAMMSVKKIIEANAVAIAAINVVAKGNPTSLFGINQMNHPTSDMVGKDLGSTGGPHDVQIQNKHAFPPYGLPPNYTPPNVAYTLNEDVNNSTPIPIESQQPQTNHAYVS

SEQ ID NO: 110154 - protein, 243 aa, Glycine max
  Coding DNA Sequence Number=SeqID_18469
  Gene Ontology: Mol. function=helicase activity; Biological process =viral genome replication
  Homolog annotation: Hit_ID=Q2A9E0; Match level="QueryCoverage=59%, HitCoverage=9%, E-value=2e-37, Identity=51%"; Hit description =Putative uncharacterized protein
MSILNSSPCIEPHTTTGCRPTQIGMTSQHINSGRYTIFNSKLIEHISHDTDDELDITQGDIVTDYSFDDITTEDFAHTEYDGNLEAPYDNENTGAGYKDIGNPIWQCKQCKAKMWYDERINKDKQTKNPKFSLCCGDGKIQLPILHDAPQPLWQLLFDSRDSQVKKFQQNIRLYNLMFAFTSLGVKVDTSYNTGRGPPTLRIHGQSHHLIGSLLPIPDNSPKFAQLYIYDTENEVNNRLSQYP

SEQ ID NO: 110155 - protein, 86 aa, Glycine max
  Coding DNA Sequence Number=SeqID_18470
MASMMEAMLGMRQLMEKNVATTAAVSSAAKADPTLLATAHHPPPNAGGRERNTLGHSSNPHLGYNRVAYPYGLPPNYTLLVMHDDA

SEQ ID NO: 110156 - protein, 117 aa, Glycine max
  Coding DNA Sequence Number=SeqID_18471
MFFEGRLWRGLNCWLFLGLLLLLDWWRNVWSAWASSILEGRSRLLLLLLRAGPSEVRVIPPSRVVSVAGKHKLQAAQLLQVAAWKGKGLYGGQQRSTNHKPLRQVQISDSRPAGLPS

SEQ ID NO: 110157 - protein, 98 aa, Glycine max
  Coding DNA Sequence Number=SeqID_18472
MYLVGGGGPRDIVLSGSGRLVHGPLDGRCKARNWNTLIPLVPVLHFRACPSVWASFLLPFLLTRKGSGPPQRLRSRLNISAIGGNFARIRSPILVHPG

SEQ ID NO: 110158 - protein, 28 aa, Glycine max
  Coding DNA Sequence Number=SeqID_18473
VFKRTITLNNDLLQKRSRFYATRVGGRR

SEQ ID NO: 110159 - protein, 51 aa, Glycine max
  Coding DNA Sequence Number=SeqID_18474
MKDKRDEEEKLEKLEKQKKKKDRINETLGLIRILVVDLKRANKAALTLVNF

SEQ ID NO: 110160 - protein, 107 aa, Glycine max
  Coding DNA Sequence Number=SeqID_18475
MELATEELINKTQLPPKIISTSSCRLGGSTKESHFTYSTTVILLPRTKVHDHHMYSLEWRRKREKRSHSKEKISLEEAHHHRRPWIRAWRKKVLKEGRGREEHEILC

SEQ ID NO: 110161 - protein, 150 aa, Glycine max
  Coding DNA Sequence Number=SeqID_18476
MEEIKVRRLRDNMVLPNTEGELNLVEIFKGGNEWWEEMKILGAKVKNNVIVGLEEERWKLMMNHQLMAMIGNEPFPVPLNAQSEESLKDKEKGDEGTLVDIRCGEKEKVMKQQIEETLDEREDTHVNVGKERQQVDDSAELSRGKAPTRG

SEQ ID NO: 110162 - protein, 127 aa, Glycine max
  Coding DNA Sequence Number=SeqID_18477
  Pfam annotation: Domain name=GRP; Domain location=39-112; Score= -19.8; E_value=0.0081; Accession=PF07172.2; Description=Glycine rich protein family
  Subcellular localization annotation: CTP_CleavageSite=26; ConfidenceScore=5.40e-01
MATMMAMIVVVVVAVTTMVVTMMTIVVMMVTVSVIVVVSVATMIVVEVVVVIVVMVAVAVVTMAMVGVIVTAKMAGSCGSNGGGGCYGDDNPGGYHGHGGGNNGGNGVSNSGDDDSYSNNGGCGDNS

SEQ ID NO: 110163 - protein, 87 aa, Glycine max
  Coding DNA Sequence Number=SeqID_18478
MNFLSGATLFCKITRAPDIFMVSVHRDPLGSDQGVPMNPKRIKVIPEWLTPPSVEGRSPEYEEPRYLRSNPFQGGGNDAIPPCKGTG

SEQ ID NO: 110164 - protein, 148 aa, Glycine max
  Coding DNA Sequence Number=SeqID_18479
LGHHFKNSVSTPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 110165 - protein, 215 aa, Glycine max
  Coding DNA Sequence Number=SeqID_18480
MEVKDKVELVPYRNLDVLVQLYIRVEQQLKRKATSKSYGSHSYPKKDKGQGILGAATSKKKDDKGKNRKGKEEQSLMVKEQCKETISASSPCKGTLVSTAIPLKLEVIPQVKELLHKGLVHKSLNPCALLVPKIGILRNQIPMIGGMMNVLRGATLLCTITHASNIFMIHIHRDSLGSDQWVPTYPKRIKVIPEWTTTPSIREIWGFHDLTNFYK

SEQ ID NO: 110166 - protein, 30 aa, Glycine max
  Coding DNA Sequence Number=SeqID_18481
MVSGASATSVKFPKTLVFFFFPFDVLKPFI

SEQ ID NO: 110167 - protein, 224 aa, Glycine max
  Coding DNA Sequence Number=SeqID_18482
GGPLRTTRPHLQRTTRPRLEDYTSSPSEGYKPSPLEDYTTTHLRLQRTTCPPLQRTTRLPHQRATRPHLQRTTRPHLQRLHALAIIGLHALTFRGLHVLTFIGLHALALIGLHALTFRGLHVLAFRGLHALAFRGLHVLAFRGLHALTFRGLHVLTFKGLHVLTFIGLHALTFRRLHVLAFRGYTPSPSEGYTSPPSEDYTSLPLEDYMSSPLEGYTPSPSEDY

SEQ ID NO: 110168 - protein, 184 aa, Glycine max
  Coding DNA Sequence Number=SeqID_18483
  Homolog annotation: Hit_ID=A6FJQ2; Match level="QueryCoverage=20%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPNASNSESGEREGTPARTIAGRYDASIGTKLMLDLPGRETCRASCINESANARGEAVCVLGALPLPRSLTRCARSFGCGERYQLTQR

SEQ ID NO: 110169 - protein, 111 aa, Glycine max
  Coding DNA Sequence Number=SeqID_18484
MPQARLYQAESGNLRGGSARQGLRADNRSVRNGALSDEAAALTEASIMRRSQAQQKVIRQLPEVMAFEYEAEASDRTTGADNHPAGRLCTNPGAMTGIHSNKADSPHIAKN

SEQ ID NO: 110170 - protein, 141 aa, Glycine max
  Coding DNA Sequence Number=SeqID_18485
MQLRRRSQLSVSGCREQTKPVRARQRVLAGVGAGFNYAASEQIVLRVHHMRCEIPHRCVRRKYRFRRHSPFRLRNCWEGRSVRAFSLLPQLAKGECAARRLSWVTPGFSQSRRCKTTASAKLACLQVDFRGSPGSCLKSLR

SEQ ID NO: 110171 - protein, 271 aa, Glycine max
  Coding DNA Sequence Number=SeqID_18486
  Gene Ontology: Mol. function=motor activity; Cellular component=cell projection
  Homolog annotation: Hit_ID=UPI00016621D1; Match level="QueryCoverage =71%, HitCoverage=41%, E-value=3e-16, Identity=32%"; Hit description =UPI00016621D1 related cluster
AARPRLQRTTCPRVLAIKGLHALPFRGLHAITIRGLHVLPFRGLHVLTFRGLHALAFRGLHALVFRGLLALAFRGLRVLTFKGLHVLAFRGLHALTFRELHAFTFKGLHVLTFKGLHVLTFRGLLTHAFRGLHVLTFRGVHALTFRGLHALTVRGLHVLAFRGLHVLSFKGLHNLAFRGLHALAFRGLHAFTFRGLRVLTFIVSFYQFLFLGHPPDPGEVPTVLAQPRGGGYHAATMHTGARFHPCRYKETSADHAHQHDHSYPNMDDVAT

SEQ ID NO: 110172 - protein, 232 aa, Glycine max
  Coding DNA Sequence Number=SeqID_18487
  Gene Ontology: Mol. function=motor activity; Cellular component=cell projection
  Homolog annotation: Hit_ID=UPI00016621D1; Match level="QueryCoverage =97%, HitCoverage=40%, E-value=2e-15, Identity=31%"; Hit description =UPI00016621D1 related cluster
TLTFRGLHVLIIRGLQTLTCRGLHILAFQGLHVLTFRGLHVLAIRGLHALTFIGLHALTFRALHVFAFRGLHVLTFRGLHALAFRGLYVLAFRGLHVLAIRGLHVLAFRALHVLTLRGLHTLIFRGLHVLTFRGLHTLICRGLCVLPLRGPHAIAFRRLHSLIFRGLYVLPLRVLHVHAFGGLHALAFRGLHVFTIRGLHVLAFRGLHLLSFKGLHVLTFRGLHILAFQGIL

SEQ ID NO: 110173 - protein, 93 aa, Glycine max
  Coding DNA Sequence Number=SeqID_18488
HDGTWVKKGAQPNDDEGQLPVQEDSSLLQSILDRFDGLQTYVGERFDSLEHEVDTRFEEMNSRIAKVEEDVPSFATALIYLHHHHHFRHYYYY

SEQ ID NO: 110174 - protein, 67 aa, Glycine max
  Coding DNA Sequence Number=SeqID_18489
  Homolog annotation: Hit_ID=A6FJQ2; Match level="QueryCoverage=56%, HitCoverage=84%, E-value=3e-11, Identity=92%"; Hit description=50S ribosomal protein L5
MQLPRRSQLSMRKEKIPHQAPFAIQAAQLLGRAIGAGLFAITPAGERGMCCKAIKLGNARVFPVTTL

SEQ ID NO: 110175 - protein, 227 aa, Glycine max
  Coding DNA Sequence Number=SeqID_18490
  Homolog annotation: Hit_ID=UPI00016621D1; Match level="QueryCoverage =97%, HitCoverage=40%, E-value=9e-24, Identity=36%"; Hit description =UPI00016621D1 related cluster
MVHALAFRGLHVLVFRGLKVLAFRGLHALVFRGLHALTFRGLHVLAFRGLHTLTFRGLRILTFRELRALTLRGLCVLAFRGLDVLAFRGLHVLTFRGLYVLAFRMVHALAFRGLHVLVFRGLKVLAFRGLHALIFRGLHALTFRGLHVLAVRGLHTLTFRGLNVLTFRELRALTLRGLCVLAFRGLDVLAFRGLHDLTFRELHVLAFRGLNTLAFRGVHILTFRGLH

SEQ ID NO: 110176 - protein, 226 aa, Glycine max
  Coding DNA Sequence Number=SeqID_18491
  Homolog annotation: Hit_ID=Q6WAY4; Match level="QueryCoverage=73%, HitCoverage=30%, E-value=8e-20, Identity=34%"; Hit description =Putative uncharacterized protein
MGTNQIGKMFYQVKVKGLDTTSIKELGRLMEPLQMQAFRKTYGKILDLTIAEVSIEAIASLTQYYDQPLRCFTFGDFQLVPTIEEFEEILGCPLGGRKPYLFSGCLPSLSRIATVVKDSARGLDRVKQTRNGIAGLPRKYLEDKARDMANQEEWVPFMDVLALLIFGVVLFPNVDGLADLATIDAFLAYHHSKESPVGAARSIGFLVGKKARKEFFSRVGTTLIFH

SEQ ID NO: 110177 - protein, 94 aa, Glycine max
  Coding DNA Sequence Number=SeqID_18492
MQSQEQQRLMRRDNVVEGALPVKHHHAKSSRKKYVKKNQPTSNEDSANNQNKGKGKKKIIHLVSIAENWVTHHTNVGNNQTQSAASAINLGTKL

SEQ ID NO: 110178 - protein, 67 aa, Glycine max
  Coding DNA Sequence Number=SeqID_18493
  Homolog annotation: Hit_ID=A0ST23; Match level="QueryCoverage=76%, HitCoverage=100%, E-value=1e-11, Identity=70%"; Hit description =Putative reverse transcriptase
MEHLINLDLDVAVLSRMKQFRAMNKLGYRARIRNHVGKPVVPAALMNRPTRGERRFAYWALFRFLAH

SEQ ID NO: 110179 - protein, 133 aa, Glycine max
  Coding DNA Sequence Number=SeqID_18494
MKSLRGKEIALVKVQWGPDEGDSTWEVEDRVRELYPRSHSERFDIYIAYFRKRAPTGAEKRELEPERWHANRGRILASKSFKIPPHFYSKLQGEVIFGVLEPPSTSWGFKFQVWVDFFSHEIRGCWVFGSYDG

SEQ ID NO: 110180 - protein, 143 aa, Glycine max
  Coding DNA Sequence Number=SeqID_18495
LGGIDGDPVLRGTRIKATWEYVSSVEGGQLGMVDLCMICGCGESTCTIARSPPSTTYDGVVPRDMSRGSGDLGDVRRAPGSQPIKEQRPQSKEACVVAGQLWILSDIWNMASGIQLPRALKGGHEVEMASGNRLPRGVIDYKA

SEQ ID NO: 110181 - protein, 84 aa, Glycine max
  Coding DNA Sequence Number=SeqID_18496
MAKKARSSPFGAMYDTFDRGCEKSSARIVCCALALYVWLESRTSRLLAKAKAVADTYSAPEEIHGLLSYCQHMIDLMDHMIRNR

SEQ ID NO: 110182 - protein, 73 aa, Glycine max
  Coding DNA Sequence Number=SeqID_18497
MPRIMTRGDRVHADGPLAGHCPCRHVYQQPMAAAAPDEADVDVHRPGHAVDGYVAIADKLERLLNLRILIEGT

SEQ ID NO: 110183 - protein, 48 aa, Glycine max
  Coding DNA Sequence Number=SeqID_18498
MRKGPLEEGGTKAIDSVETLRTWALSAHQALSEQLTGGAGRGGNRYAR

SEQ ID NO: 110184 - protein, 71 aa, Glycine max
  Coding DNA Sequence Number=SeqID_18499
MGCYSEWIKFNVRLFVRCFTFGDFQLTPTIEEFEEIFGCPLGGRKPYLFSRFYPSMARIEKVVKILEQELD

SEQ ID NO: 110185 - protein, 49 aa, Glycine max
  Coding DNA Sequence Number=SeqID_18500
MATPRVFLSWKTHPASHASQSHRRGPYTRVCGNIRSGGESVIILGLRLA

SEQ ID NO: 110186 - protein, 127 aa, Glycine max
  Coding DNA Sequence Number=SeqID_18501
MNDRLDFILTVIKRDYNTNDRLKFILSFIRQDNGLNKRLKRKEGGGCRPARAGKQGCFHQKAPPFFGTLRKAQVGLNVAKLHGLRNNARFPSGTLRNFTNYATMLVSRVPKGANKVQGPTTSTLGRN

SEQ ID NO: 110187 - protein, 88 aa, Glycine max
  Coding DNA Sequence Number=SeqID_18502
MKLASTDNTYTVTLTKLTLSKRMDESTNRHNDNLGVNKMGKNIRKTKRDQPNYGKNNNSSMNGVDSNIPTERVDPPGCRNLIPNSRIY

SEQ ID NO: 110188 - protein, 124 aa, Glycine max
  Coding DNA Sequence Number=SeqID_18503
MQVSLPNHKSTESAIKNLEIQVEQLAKQIVDTCSNKFGANTKNNPKEECKVVMTRGRMATMAEEEKDEKMVDGDKQQLVIELAPELVDPFCELEEVEDEEDDKEKENTISKNEREINDEKKKEK

SEQ ID NO: 110189 - protein, 192 aa, Glycine max
  Coding DNA Sequence Number=SeqID_18504
  Homolog annotation: Hit_ID=UPI00006A2D9E; Match level="QueryCoverage =53%, HitCoverage=73%, E-value=7e-09, Identity=16%"; Hit description =UPI00006A2D9E related cluster
RTTHPHLQRTTRPHLQSTTRPHLQRATRPHLQRTIRPPLQRATHPCIQRATHPHLRGLHVFAFRGLHGLTFRGLHTLTLKGLQVLAFRGLHTLAFRGVHALAFRGLHVLTFRGLHVLTFRGQHALTLKGLHALAFQGLHTLTFRGLLILAFKGLHVLNFRGLHVLTLRVLHTLTFRGLHVPAFRGLHILTFR

SEQ ID NO: 110190 - protein, 78 aa, Glycine max
  Coding DNA Sequence Number=SeqID_18505
MTTLVFTCQSDLGSLNDEVRITVRCPRMLPDSWVMIAKGGVVNKTEALAPTHPPFVMRNLDLHSSFKSETKIVSVFSH

SEQ ID NO: 110191 - protein, 217 aa, Glycine max
  Coding DNA Sequence Number=SeqID_18506
  Homolog annotation: Hit_ID=UPI0000ECBAF8; Match level="QueryCoverage =18%, HitCoverage=48%, E-value=3e-16, Identity=100%"; Hit description= UPI0000ECBAF8 related cluster
ADRYPVSGRVGTGERTRELPGGNAGIFIVLSGFATSDLSVDFCDARQGGGAYGKTPATRPFYGSWPFAGLLLTCSFLRYPLILWITVLPPLSELIPLAAAERPSAATGTTGFPTGKRAVSATQLIYDHDYEFELGTQYWNRAVVLSVSAIVLGAQGNSPSSTTRGMQAWHWPSFYNVVTGKTLALPNLIALQHIPLSPAGVIAKRPAPIALPNSCAA

SEQ ID NO: 110192 - protein, 200 aa, Glycine max
  Coding DNA Sequence Number=SeqID_18507
  Gene Ontology: Mol. function=ATP-dependent DNA helicase activity; Cellular component=intracellular; Biological process=DNA recombination
  Homolog annotation: Hit_ID=Q8XD86; Match level="QueryCoverage=91%, HitCoverage=26%, E-value=1e-87, Identity=89%"; Hit description=ATP -dependent DNA helicase recG
  Pfam annotation: Domain name=DEAD; Domain location=14-184; Score =112.1; E_value=1.6e-30; Accession=PF00270.20; Description=DEADDEAH box helicase
  Pfam annotation: Domain name=ResIII; Domain location=11-178; Score= -12.9; E_value=0.00058; Accession=PF04851.6; Description=Type III restriction enzyme, res subunit
  Pfam module annotation: Pfam domain module=DEAD::ResIII; Domain location=14-184::11-178
MMRSKISCWPLCRLTDQRKARVTAEIERDMALDVPMMRLVQGDVGSGKTLVAALAALRAIAHGKQVALMAPTELLAEQHANNFRAWFAPLGIEVGWLAGKQKGKARLAQQEAIASGQVQMIVGTHAIFQEQVQFNGLALVIIDEQHRFGVHQRLALWEKGLQQGFHPHQLIMTATPIPRTLAMTAYADLDTSTIDELPPG

SEQ ID NO: 110193 - protein, 101 aa, Glycine max
  Coding DNA Sequence Number=SeqID_18508
MIVHTLGFDGPMSLSPMENLKGRNDIQIAGETNTAPIAMAERLTLHQTIQMPFVLVLNCLVFPRTVMHASSGNSGPAWADSRWAAEPNNLLGAFFYPFWVT

SEQ ID NO: 110194 - protein, 102 aa, Glycine max
  Coding DNA Sequence Number=SeqID_18509
MARTRSLGRAIGRVVGRDRPADDDAGDVPERRRPTASARRLRVYQMTTEGRDMTEDVADMTDDVPEQPTEAPEMRVDAQGADSGEGSDGDDAAEGFLGGPRD

SEQ ID NO: 110195 - protein, 66 aa, Glycine max
  Coding DNA Sequence Number=SeqID_18510
DSFEEQATQGSFVLHGRQDVLTAAIGSPEHPGRVRAVGADATIKQYFGSSPRMSHSSSSLPPDELQ

SEQ ID NO: 110196 - protein, 460 aa, Glycine max
  Coding DNA Sequence Number=SeqID_18511
MNECCPVSGVETLTSLRELQVDVACQAPELGQVLFGLFLSSECIEDKRYFCLLQQTCAVHVQHSCIHVTHGMGTYWSSGSCVSGKRYGHCSLSSCFLAFLLAFVLSGFRFPFLLPPTSKGGSRSKDTHQGASNNESSSTKRVRASRQTGGGASRPRGGSWLSATAGEPVPVTVNLPPSASGGVRKGRGGGHVRASPCMRRSLCVRLPLSIPTIAGYEWVKLENPKDSCPGCQFTLDHFSVCSTGALECGPFLTSPKQLGDVEWQDQSGFLKQRVQEAVLVIDAMDDDMPLMLNRDREPCFPFYWESNPTRFKSYDKDLLTFVDRAILSVPSVSDPLAALDGIMGDFTWRPLMKQPAGEVGPVAIAVEVTLNAPSSVLAKRKMDDIVGSSGHKKLKALMSLHAQRWAAGLMPTAGCLSTVQDVPLAPLTVKTLATPAPSPPPAVAIQEVAHAADEVFMPAA

SEQ ID NO: 110197 - protein, 302 aa, Glycine max
  Coding DNA Sequence Number=SeqID_18512
  Gene Ontology: Mol. function=transferase activity; Cellular component= integral to membrane; Biological process=carbohydrate metabolic process
  Homolog annotation: Hit_ID=A6TH33; Match level="QueryCoverage=100%, HitCoverage=68%, E-value=1e-154, Identity=89%"; Hit description =Putative glycosyl transferase
  Pfam annotation: Domain name=Glycos_transf_2; Domain location=78-246; Score=132.5; E_value=1.2e-36; Accession=PF00535.17; Description =Glycosyl transferase
MTDRVIAFSILCLVFGLPLGVAALFTGELILDFVFFWPLFMSVLWITGGLYFWFQLERHWSWDHDTPAPTLAGEPLISILIPCFNEERNARETISAALAQRYENIEVIAINDGSSDNTAQVLQELALEQPRLRVINLAENQGKALALKAGAAAARGDLLVCIDGDALLDRDTAAYLVAPLIQYPHVGAVTGNPRIRTRSTLIGRIQVGEFSSIIGLIKRTQRIYGRVFTVSGVIAAFRRQALADVGYWSPDMITEDIDISWKLQLRHWDIFFEPRALCWILMPETLKGLWKQRLRWAQGGAE

SEQ ID NO: 110198 - protein, 111 aa, Glycine max
  Coding DNA Sequence Number=SeqID_18513
MSSDCIVQFSILTLFRSPWNGVLVHVSSTLELGAMGSDCLVQFSILTLFGSPINGVLVQVSSPLELGAMGGDCLGHFCFLNFSLHACRSTLEEPQFMCPPPSSLELCVVIA

SEQ ID NO: 110199 - protein, 70 aa, Glycine max
  Coding DNA Sequence Number=SeqID_18514
MGKWLRRNSPRRGLEETPQQKGPVPPPSLIVIVSGALSTNSDSRPSKDGRSTEKGMSSSGRMSIHTFRRR

SEQ ID NO: 110200 - protein, 434 aa, Glycine max
  Coding DNA Sequence Number=SeqID_18515
  Gene Ontology: Mol. function=methyltransferase activity; Biological process=carbohydrate metabolic process
  Homolog annotation: Hit_ID=Q5PDI9; Match level="QueryCoverage=100%, HitCoverage=42%, E-value=1e-157, Identity=61%"; Hit description =Putative hydroxymethyltransferase
NYALTLSSGNAVERCQIAYQPAVLFAAIELLLADDELEGAEVVVELWSEAGVRERTLTLMANQPQRVTRLLANHQYAICLQPTTMNNQLLTTPAQPATFVPTVGTTVQADVALQKTPVASDNFVEVAVTVLGLPQGTAAQRYRFRCGSYQYSFVLASDTRQQKLPLRLSAGEYSVQVADVYIAGTPWRCDVSAPLRLLQSVNNVTLEFIQGVPLQVKGWPNYLAHGGVTVNAAETVDLYRGVPFSALFKYDGFDGGGDPIPAAEVDTNGDGFLDYASLPIHKTVPLVREIEADAGRAVMPVMVVYTANASGGSAVSDLQDEQRLRNHFGSFITQCLAAQSWKDDQHPVPATFVLNPDFLGAMQQESYGYTALRKANSVQVNVQLAAAINALPSMPGFSAPTLPTFSNDLYGYVQAINYIVRQFAPDIAFGWQTN

SEQ ID NO: 110201 - protein, 112 aa, Glycine max
  Coding DNA Sequence Number=SeqID_18516
  Homolog annotation: Hit_ID=A6FJQ2; Match level="QueryCoverage=33%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLVWVMKQGIILNYADHLDNRIG

SEQ ID NO: 110202 - protein, 93 aa, Glycine max
  Coding DNA Sequence Number=SeqID_18517
MYLAPFVVQYVKFRDMPEIKRGYCYAIQGGVKKERVSLLGTSYSLEITEENCFREENPSRGASVTFPWVISQRFSTVLRHSSSVLHCSSVFNW

SEQ ID NO: 110203 - protein, 90 aa, Glycine max
  Coding DNA Sequence Number=SeqID_18518
MGHCAPNAQVRRDDFSGPHHVYSRVFHLYEMLSKYWRSNCHSLDYGVEPSSCFYEKVHQVKLKYGSNHLAKIGAKDGSCYIIASSTAKHV

SEQ ID NO: 110204 - protein, 239 aa, Glycine max
  Coding DNA Sequence Number=SeqID_18519
MALKHKVQSLIEAGWLTFQEDEPNVKMNPLANHGGSDVNAIEVDKLQKPNHLKDVMTSRRFIFEALQEASVVPLSGHKGDPCLMHPAAPHDMKTCLVVEELLQRMIDQGRLEIGEEGMKKQHVCMQSADKESPRKSKPLKPSERKKGAASIDSLSAKVTNITGLSGVTCSGRIFAAPDMPVRPVNAKGKAKVVAEETNEASPTPDEDVPAGWFAEKREGFGEKEVSLEEANKFLRIIQK

SEQ ID NO: 110205 - protein, 308 aa, Glycine max
  Coding DNA Sequence Number=SeqID_18520
  Gene Ontology: Mol. function=oxidoreductase activity, acting on CH or CH2 groups
  Homolog annotation: Hit_ID=Q7WHJ0; Match level="QueryCoverage=66%, HitCoverage=66%, E-value=1e-104, Identity=89%"; Hit description =Ectoine hydroxylase
  Pfam annotation: Domain name=PhyH; Domain location=37-261; Score =97.6; E_value=3.8e-26; Accession=PF05721.4; Description=Phytanoyl -CoA dioxygenase (PhyH)
DPYASRTDRSSAIISRQDPVVYGEGKYADALSGEQIGSYERDGFLLLENLFSEAEVRALSAEVERMTRDPSIVRREESITEPGSNAVRSIFMVHVLNPVLARLVRDPRLVNVARQILGSEVYIHQSRANMKPGFKGKEFYWHSDFETWHVEDGMPSMRALSCSVLLTENNDCNGPLMLVPGSHRQFISCVGETPNDHYKQSLKKQERHPHDDGQGGVGGVLRLQYHARLQQQHLAVAARQRVHGLQQHGEHAGSAQAFKAGHAARHVEAGRQLARHLVRGGCLPALVGAWADRPRAGATHAVPAARFP

SEQ ID NO: 110206 - protein, 289 aa, Glycine max
  Coding DNA Sequence Number=SeqID_18521
  Gene Ontology: Mol. function=RNA-directed DNA polymerase activity; Biological process=regulation of transcription, DNA-dependent
  Homolog annotation: Hit_ID=A7NWH9; Match level="QueryCoverage=85%, HitCoverage=23%, E-value=2e-39, Identity=35%"; Hit description =Chromosome chr5 scaffold_2, whole genome shotgun sequence
MEPEFWDKNPFKATAKAFPPGFHYKPTTILKTRTFYELILVDSNSVSIKHFKDPKDQTLNTHSTIQILKVLQPRHFGSDLNKGKRFSVPFDPVGYTYWDYVDAWTKVFWHQNTRFKHSWLIYFKTNTIYNFPNWFLQWWDFFGPIPEIFPKTLALSWIFSWQYRYSKTEKTNQYPSLQRHAFVKWWTQFDSSKADPEQVKLWFQSHPEFLKAADPETSVFLNQKSHLAAFLAGSTSKEVLAKNLKEVLQMLQQEEEASSSKKEETSSAEEDEEDPFYQNEDYCFGICLD

SEQ ID NO: 110207 - protein, 135 aa, Glycine max
  Coding DNA Sequence Number=SeqID_18522
  Homolog annotation: Hit_ID=Q6WAY4; Match level="QueryCoverage=98%, HitCoverage=24%, E-value=1e-14, Identity=34%"; Hit description =Putative uncharacterized protein
MYGKILDLTTTEVFTEAVVSLAQYYDQPLRCFTFGDFQIVSTVEEFEEILGCPLGGRKPYLFSGFLPSLSKIVAVVGDSARELDHMKQTRNAVVGLPWKYLEGKARDMANQEEWVPFADILALLIFGVVLFPNVD

SEQ ID NO: 110208 - protein, 128 aa, Glycine max
  Coding DNA Sequence Number=SeqID_18523
WDATVFGVFNPDFPLYIKHEDLSEIAHDGQCLSISVLQLSGQLQFESESYIKSWMQSSQRDVYLGAYLNGGYWQMVVILPKEHLVVWFCSLHNRPDNYLKGIINSALKGLDNAPQPKSKASARWIVVK

SEQ ID NO: 110209 - protein, 99 aa, Glycine max
  Coding DNA Sequence Number=SeqID_18524
  Subcellular localization annotation: CTP_CleavageSite=45; ConfidenceScore=5.05e-01
MTVKTSDTCSSRETVTACLCVRRKYRIRRHSPFRLRNCWEGRSVRASSLLRQLAKGGCAARRLSWVTPGFSQSRRCKTTASAKLACLQVDSRGSPELGI

SEQ ID NO: 110210 - protein, 73 aa, Glycine max
  Coding DNA Sequence Number=SeqID_18525
MNKKGITSVCMAFAGGQGVHTKSQGTTFREGGLEKKVLMILTMVSGDEDNNDDENGGSCDNGDRSNYYDSDDN

SEQ ID NO: 110211 - protein, 510 aa, Glycine max
  Coding DNA Sequence Number=SeqID_18526
  Gene Ontology: Mol. function=transcription coactivator activity; Cellular component=cytoplasm; Biological process=transcription from RNA polymerase II promoter
  Homolog annotation: Hit_ID=Q949K3; Match level="QueryCoverage=100%, HitCoverage=81%, E-value=1e-159, Identity=57%"; Hit description =Suppressor-like protein
  Pfam annotation: Domain name=SGT1; Domain location=1-505; Score =625.0; E_value=6.8e-185; Accession=PF07093.2; Description=SGT1 protein
SDGDFLLIEAAFHLPRWLNPDSAHHRLFLRDGSLHIVPRNRLPNPSLIDSLNFIVNSPHESLASDGIQRAVRKRISNYPEQARKNMHRVRVRVPVSVAQVLKHEPRLISLAVEGFYDRDIDTMKFASRMERFVERGKAEELVCVSVKMSRAMYAQLVQQRFQAPKCYPGMPARSEKEGFAEAELGMKIACGLEMMYQQRKRDGVEGKGSSWEAFRKSLESSGYFQGMLPGSSEYQRLMQSAQEYYRNTSLHSKASDLLNALVRRIDEILALPHLVDDFKDQEVPPSDDDSWLYGGEEELNSVLMERQKEMELYDLKHKKKGKAKEGQDAGPSSASNADEFDPGDIAKTMQAFVHKLSSYKGAEAPEDRNKEVDLDVDQFIKDMESIMMHTDGEVANSNIEEGSSSDLDFDDSDESDIAELDEDTEDGEEIFMRSYSDAMNEELKTTTLQKSFVRANEQIPKKDQGTSNASEHIVDEDFSPVDVDQGLPGPASNLLGLMGVQLPQDGKKGK

SEQ ID NO: 110212 - protein, 73 aa, Glycine max
  Coding DNA Sequence Number=SeqID_18527
MAQPSISLSAYLVLSETGDIELALSAQQKTEPAKREEPAKRAIQQKHQALSERGHAERAYEGPKPTSVAINKS

SEQ ID NO: 110213 - protein, 126 aa, Glycine max
  Coding DNA Sequence Number=SeqID_18528
MYHPTRDVSSQVEECTVLHLLILPNNLQTYILDELKAILTDLVRAFKRDRGIQRKRERGGCRMEAEEKAEKKGFQKCCKEAKYDPIGIKGILSMKYYYLLRNLAKIQNVGVAHLEYSRFDVEYYNF

SEQ ID NO: 110214 - protein, 43 aa, Glycine max
  Coding DNA Sequence Number=SeqID_18529
MPLGNSISTKVLSFSMEGLSGFVQGFLATKWVEVCYCDKWEVA

SEQ ID NO: 110215 - protein, 186 aa, Glycine max
  Coding DNA Sequence Number=SeqID_18530
  Gene Ontology: Mol. function=hydrolase activity; Biological process =lipid catabolic process
  Homolog annotation: Hit_ID=A7PUA1; Match level="QueryCoverage=60%, HitCoverage=30%, E-value=9e-28, Identity=58%"; Hit description =Chromosome chr7 scaffold_31, whole genome shotgun sequence
MAEPHLAPSATLGLFTPFHFSSINEKTSCAVVDGGLVINNLVAAAIMHVLHNKRDFLSVNSVEDLLVLSIENEAQAKRMNNIGECSTSTVVDIALEGVFKTVDQMLENAFLNATSCYVFDGQNEEICHVVHRWEITFVVEDEKWKGVKGPGVVDSARCGPGNNNLMMLSNFNGRDHDAILPRKSIG

SEQ ID NO: 110216 - protein, 56 aa, Glycine max
  Coding DNA Sequence Number=SeqID_18531
MAIEGFTMRRGERKGVNETPRRGGALSATPSRSARVDRALSAHVAGLVRASVRLRA

SEQ ID NO: 110217 - protein, 632 aa, Glycine max
  Coding DNA Sequence Number=SeqID_18532
  Gene Ontology: Mol. function=RNA binding; Cellular component =ribonucleoprotein complex; Biological process=gynoecium development
  Homolog annotation: Hit_ID=A5AKJ4; Match level="QueryCoverage=66%, HitCoverage=76%, E-value=2e-73, Identity=40%"; Hit description =Putative uncharacterized protein
  Pfam annotation: Domain name=KH_1; Domain location=144-198; Score =28.0; E_value=3.5e-05; Accession=PF00013.20; Description=KH domain
  Pfam annotation: Domain name=KH_1; Domain location=302-356; Score =33.2; E_value=9.5e-07; Accession=PF00013.20; Description=KH domain
  Pfam annotation: Domain name=KH_1; Domain location=394-472; Score =28.5; E_value=2.4e-05; Accession=PF00013.20; Description=KH domain
  Pfam annotation: Domain name=KH_1; Domain location=42-102; Score =29.2; E_value=1.5e-05; Accession=PF00013.20; Description=KH domain
  Pfam annotation: Domain name=KH_1; Domain location=560-622; Score =44.6; E_value=3.5e-10; Accession=PF00013.20; Description=KH domain
  Pfam annotation: Domain name=KH_2; Domain location=144-193; Score =8.6; E_value=0.036; Accession=PF07650.8; Description=KH domain
  Pfam module annotation: Pfam domain module=KH_1::KH_1::KH_1::KH_1::KH_ 1::KH_2; Domain location=144-198::302-356::394-472::42-102::560 -622::144-193
  Subcellular localization annotation: CTP_CleavageSite=48; ConfidenceScore=5.71e-01
MQDPATSDTDHQTTPSPKRSNTTTTNRSSKRPVFKVLPGQIAFRLVCHASTVGGLIGSSGSIVSQLRRETGCKIHCEDSLSSAEDRVILVIGSLSPRKGLLLGDGGEVEVSSAQEAVVRVFERVWDLEAEKGVNSNRAVNGEVFSKLLAHTSQIGAVVGKGGKNITAIRNNTGAKIRVFPPPQCATKDEELVQAFLPIFFTGGVKLPTKGYRITGGILAVKKALISVSHCLQDCPPLCKVPVTSSTPTVSSSDRLSSDPNAELFPHLNSLLTSMEGLSIYERTTNSNETSNRDSKGAEHEVVFRLLCSNNVAGSVIGKRGAIVRALESKTGASIIFAAPLSEHAERIVTISAVESLESCNSPAQDAVILVFARIIEDHIGKGFLQVSSMESPVTARLLVATSTVNCFSGNEGQVISELREVTGADIQILHGESVPNGASDEDVVVQSSLYLERDFVQITGEYRCVQNALYKITSRIRDNLSPNEVVAEARPKSNWKVNKDPIKGKPFARGKSAFPSGRFLPRNAGVHAETILQNGELHTDLSENLERGRGNMFATVTNTTVEIIVSEHVFGSVYGEDGGNLDRIRQISGAIVTVYDPSVGTSGGKVVISGTPDQTFAAQSLLQAFIQTGQAS

SEQ ID NO: 110218 - protein, 106 aa, Glycine max
  Coding DNA Sequence Number=SeqID_18533
  Gene Ontology: Mol. function=mannitol dehydrogenase activity; Biological process=metabolic process
  Homolog annotation: Hit_ID=Q9ZRF1; Match level="QueryCoverage=33%, HitCoverage=9%, E-value=5e-12, Identity=85%"; Hit description =Probable mannitol dehydrogenase
  Pfam annotation: Domain name=ADH_N; Domain location=7-70; Score=28.4; E_value=3.5e-06; Accession=PF08240.3; Description=Alcohol dehydrogenase GroES-like domai
MEWETGGKDVAFKVLYCGVCHFDLHMVKNEWGFSNYPLVPGHEVVGVVKEVGSKDAWLIPAAPARTVVTFLRIIVHNLRSHMVQSIKMTPSHMEATLTQWLLMSIL

SEQ ID NO: 110219 - protein, 71 aa, Glycine max
  Coding DNA Sequence Number=SeqID_18534
MKQFVDANRREENYHLEDKVLPDEQGDVMKQPSIGELQVDKEETSTNLRAKRKTSKPHYLDDFVINSDPKR

SEQ ID NO: 110220 - protein, 28 aa, Glycine max
  Coding DNA Sequence Number=SeqID_18535
MEKWESKPDLKQERGGSAMGFGMEGSEK

SEQ ID NO: 110221 - protein, 627 aa, Glycine max
  Coding DNA Sequence Number=SeqID_18536
  Gene Ontology: Mol. function=transcription regulator activity; Cellular component=nucleus; Biological process=regulation of transcription
  Homolog annotation: Hit_ID=Q41102; Match level="QueryCoverage=93%, HitCoverage=100%, E-value=0.0, Identity=64%"; Hit description =Phaseolin G-box binding protein PG2
  Pfam annotation: Domain name=HLH; Domain location=441-490; Score =49.0; E_value=1.6e-11; Accession=PF00010.17; Description=Helix-loop -helix DNA-binding domain
MNLWTDENSSVMEAFMSSSDLSSIWPSPAPPQSTAVFNQDTLQHRLQALIEGARETWTYAIFWQSSYDYSGSTLLGWGDGYYKGDDDKAKAKAKAKVKVTSAAEQDHRKKVLRELNSLISGSSSSSAASDDVDEEVTDTEWFFLVSMTQSFVNGGGLPGQAFFNSAPVWVTGGDRLSASACERARQGHVFGLQTLVCIPSANGVVELGSTELIFQNPDLMNKVKVLFNFSNNNFDMGSSWPATSADQGENDPSSLWLSDPELESSIQTPGSSTLTETPSSIHAIPQNQSVFSRELNFSEYGFDPKTGNNQNHHSLKPESGEILSFGESKRTSYGGVNGNSNSNSHFFSGQSPFVAAADENTNKNNINNNGKTKSPNSRGSNDDGMLSFTSGVILPASNLKSGGGGDSDHSDLEASVVKDPVVEPEKRPRKRGRKPANGREEPLNHVEAERQRREKLNQRFYALRAVVPNVSKMDKASLLGDAISYITELKSKLQTLESDKDGMQKQLEGVKKELEKTTENVSSNHAGNSSSCNNNNKLSNQKLIDVLEMDVKILGWDAMIRIHCSKKNHPGARLLTALMELDLDVHHANVNLVNDMTMLQATVKMGSRFYTQEQLRAALAAKVGDAR

SEQ ID NO: 110222 - protein, 714 aa, Glycine max
  Coding DNA Sequence Number=SeqID_18537
  Gene Ontology: Mol. function=cysteine-type peptidase activity; Cellular component=nucleus; Biological process=ubiquitin-dependent protein catabolic process
  Homolog annotation: Hit_ID=A7PC87; Match level="QueryCoverage=52%, HitCoverage=61%, E-value=1e-131, Identity=62%"; Hit description =Ubiquitin carboxyl-terminal hydrolase
  Pfam annotation: Domain name=UCH; Domain location=103-412; Score =247.1; E_value=3.8e-71; Accession=PF00443.20; Description=Ubiquitin carboxyl-terminal hydrolase
MASEEPMDAPPAPNLLSETLSAAELVADLGGDYALFPPGGGSTEFRQLDDDVSSSLWSSALVSNSRVSAVAPESWIAPQGNWLLPENEGSDNAESASEVVPSKMGAGLVNLGNTCFLNAILQCFTHTVPLVQGLRSSTHPIPCSGHKDGFCVICALRIHVERSLAASGGTFSPLEFVNNLKYFSSDFRRYQQEDAHEFMQCTLDKLERCFLGLKKSNLNFEDVNLVEKVFGGRLISKLQCSTCDHTSNTFEPLIDMSLEIDNVDSLPSALESFTKVENIDDNLQCDNCKEEVSMEKQLMLDQTPSVAAFHLKRFKTDGILVEKIDKHIDFPLELDLQPYTIKVMEDPGAENDVPLKYDLYAIVVHTGLSSTSGHYFCFVRSAPDTWHKLDDSMVTEVSVETVLSQEAYILFYARQGTPWFLSIMEEKTQCLNPNIMSTSPKSVLDVGDNMSKSNPILLPNIERSVAEESKEYSEPQFDYYCQEDHGFLEINDTEDVTHGSGQLLSGSNQEIFYSNTSKDVDAQKLFSSRGGHKVATHGCGQLLSGLNQESVGLNSSKNVDAQQLFRNWTTLDDSAMFDIGNSYIENGSLDNDNTFQEAVDFLEKAGFHSLTLPSLPPDDAPDKFHISCDNLKRENHRSCKRSSNKLTGDSEERREAVKYLCKNRSRRGALLKFVTPNKVLDKKRKNMDSLQCKKSTKKPSHTSVTPPVAAGSSR

SEQ ID NO: 110223 - protein, 277 aa, Glycine max
  Coding DNA Sequence Number=SeqID_18538
WNQIIFKEASIDVDRVFDAARYRAWSWCKAVVVVESDIGCFPGVHWSKLVVEIFFIRVKSTWSAIEYGGLSSPSCIVIVLITPRSKVLGEGFSSGRGASTASQGSAIFSVVTSDLVISTTLGFGVMAKLGPRRSIGSRFSLIMVALDFHLSLSEKELDFSAIIIKISTTFGFKFLIRTETNENLSMKSRSGSSSFYLMLASATTVRWCGMLVIYGAPKRMISVTNESMEFLVNRVYQWNVVPFNVVGNTRHMIVLLFINKLVSMVGHIGVIVVCNHL

SEQ ID NO: 110224 - protein, 81 aa, Glycine max
  Coding DNA Sequence Number=SeqID_18539
MTLVVTPSGCDCNDNRGCDRSDEGDSNVVTTIYDNDNGSSDNNIGGVMVMMMEVVMVVTMIKVIIMVTTKNVIVKCEKCIF

SEQ ID NO: 110225 - protein, 108 aa, Glycine max
  Coding DNA Sequence Number=SeqID_18540
  Homolog annotation: Hit_ID=A7PDG0; Match level="QueryCoverage=85%, HitCoverage=23%, E-value=3e-15, Identity=50%"; Hit description =Chromosome chr17 scaffold_12, whole genome shotgun sequence
MKLDMMTLKQSLFEAKKIQDETIDDNNRMSTSIEELWVALQDAQKNIITLKTEIRELEEKLDTANKNSRNSSQKDKYWLENKDRSQFETQSSLNVRGNNSTILEDISC

SEQ ID NO: 110226 - protein, 161 aa, Glycine max
  Coding DNA Sequence Number=SeqID_18541
  Gene Ontology: Mol. function=hydrolase activity; Cellular component =endoplasmic reticulum membrane; Biological process=biological_process
  Homolog annotation: Hit_ID=A9PHT4; Match level="QueryCoverage=60%, HitCoverage=39%, E-value=4e-44, Identity=88%"; Hit description =Putative uncharacterized protein
  Pfam annotation: Domain name=SNARE_assoc; Domain location=13-124; Score=-7.9; E_value=0.0063; Accession=PF09335.2; Description=SNARE associated Golgi protein
MVIAQDRDFGNLIWKGYLSFGGIQQLGMSMRKLGLLLFIGANLDNLESYTSDYTAQVLVGYCVVAKRRKGLLNYMLFLRLTPTLPNTFINFASPIVDVPYHIFFLATVIGLIPAAYVTVKAGLALGELQSVGDLYDFNSIATLFLIGVVSVTPTLMSKNES

SEQ ID NO: 110227 - protein, 352 aa, Glycine max
  Coding DNA Sequence Number=SeqID_18542
MVKTRGLGRALGRIVARGLGRGDGDDSDGAPQHRRLTASARKRHLLVIVDDDVPAIPVDSPAVLEAEAAVVGDEPMDAVDEPEGFPGGTRDPSVLMEYADHVAASEHPELKLSSHGRKVHNLGRLVPAIEDMVAGTGLSPLIACSIDTGDHGLISSFVGERRGGAVVGCVTDGLTRGGHGRDRPMWWTIRAPAHFSSIAECNADPNYDEVSPRACWWIATKKIVEKIQTREGYAPVRLCPVHSCVHSWVSYDDFFFISHPFMIAPQTDPPRDAYTTQPSHIPHEVAPTSTHVDPDADELRHAMEACHAIAYTLERHLILNEVTSGTSTHDVILKCLRITKGVTEDDNVYVRS

SEQ ID NO: 110228 - protein, 228 aa, Glycine max
  Coding DNA Sequence Number=SeqID_18543
  Gene Ontology: Mol. function=transferase activity
  Homolog annotation: Hit_ID=Q2HUA0; Match level="QueryCoverage=46%, HitCoverage=45%, E-value=9e-29, Identity=65%"; Hit description=UDP-N- acetylglucosamine transferase subunit ALG14, related
  Pfam annotation: Domain name=Alg14; Domain location=155-227; Score= -61.8; E_value=0.023; Accession=PF08660.2; Description=Oligosaccharide biosynthesis protein Al
MGDCMRHTARVLIIGEVSATLKEVIDDIEGGNVSKVIVVDKGDGVDGEMKSELMVFSQGKSDGIVLSIVKDLTLGRGVVAEICEEDDEDVSVALTDILKLPLMDKSNGCSFSSISSIAVFSSAVFVVSLILVRLLYVLYCSSKPLSKRASKPFSTLIILGSGGHTAEMLNLLAVLQKGRFNPRFYIAAATDNMSLQKAQLLENSLAAEYRKSEKALLERPAPVQVADG

SEQ ID NO: 110229 - protein, 578 aa, Glycine max
  Coding DNA Sequence Number=SeqID_18544
  Gene Ontology: Mol. function=NAD+ ADP-ribosyltransferase activity; Cellular component=nucleus
  Homolog annotation: Hit_ID=A2Q3R6; Match level="QueryCoverage=63%, HitCoverage=62%, E-value=4e-72, Identity=43%"; Hit description =Poly(ADP-ribose) polymerase, catalytic region
  Pfam annotation: Domain name=WWE; Domain location=177-247; Score=6.1; E_value=0.032; Accession=PF02825.11; Description=WWE domain
MLGSRTGDIILIPAPPHPTRLSCHLLLNFCYEVVSKTAQLLGVYFKGLSVRIGIAKYSGCYGLHHCHRSFFETAQGLGFYLTSAPELLYLRVLIDIGLGDRNGSKIAKELNRVALNLKRKQATRYAAHLSGASQPMLGHWSSLTSPASRAVKRMRLGGYRNRLTNAGRHIGRSLARRFLNYKKSGRLERLMFYENGEWLDFPKDVVDLVKKDLEVKKAAVEIESNGYHLLFDFLHLHKVDLKTGLQQPIALIDAAGWCFSPEIYAASDEEPYNLSKQECGRSPDSYASNEIKLHLEVDINGVDQSRLSECSGESNALVKGIQIDTKQNCCQYDVEVEDSINKKDCGNVGEDIQQHQDIDLDAYTESVYGILDLNSVQKMFLKGMSSFGSTDSDIFEIYQCSGASMQARWELFQKQAEISKKNHGEANIQYDWLASSKGELSTMMNYGLSHYGLSGSKCTYDIGVHLAAVTCPDASLFYPCPVLEGSLPSNGSRSRERVGMHFAAGGSSNQKAYGMFTSLRTKHFPSVTRIMRPFIPAWTTIHGRQFSASTPQIVGSNYRVNCSCGVIRKDIMQWMLHR

SEQ ID NO: 110230 - protein, 27 aa, Glycine max
  Coding DNA Sequence Number=SeqID_18545
MCRDQVAAHNNQTNEYEASKEPKSDNE

SEQ ID NO: 110231 - protein, 323 aa, Glycine max
  Coding DNA Sequence Number=SeqID_18546
  Gene Ontology: Mol. function=SNAP receptor activity; Cellular component=integral to membrane; Biological process=intracellular protein transport
  Homolog annotation: Hit_ID=Q3HRZ4; Match level="QueryCoverage=94%, HitCoverage=93%, E-value=4e-91, Identity=61%"; Hit description =Syntaxin-like protein
  Pfam annotation: Domain name=SNARE; Domain location=235-297; Score =92.9; E_value=1e-24; Accession=PF05739.10; Description=SNARE domain
  Pfam annotation: Domain name=Syntaxin; Domain location=15-116; Score =50.1; E_value=7.7e-12; Accession=PF00804.16; Description=Syntaxin
  Pfam module annotation: Pfam domain module=SNARE::Syntaxin; Domain location=235-297::15-116
MSFQDIEAGRSFASRRNLINGKQDPTQAVASGIFQINTAVSTFQRLVNTLGTPKDTPELRDKLHKTRLHIGQLVKDTSAKLKQASEIDHNVEVNASKKIADAKLAKDFQAVLKEFQKAQRLSAERETAYTPFVPQALLPSSYTASEVDIGSDKTPEQRALLVESRRLLLEFSQLLFSSVMALILKRVSPGAAVKLCLGDLLVMGSNPETASLHMQGQEVLFLDNEISFNEAIIEEREQGIQEIQSQIGEVNEIFKDLAVLVHEQGAMIDDIGSNIEHSHEATAQAKSQLAKASKTQRSNSSLTCLLLVIFGIVLLIVIIVLAA

SEQ ID NO: 110232 - protein, 59 aa, Glycine max
  Coding DNA Sequence Number=SeqID_18547
MKEEDEVDDCGSVESGHVIFMEEGSLRMVKTSSLETTTMMAMTFSNKFSRACCVVGVNN

SEQ ID NO: 110233 - protein, 314 aa, Glycine max
  Coding DNA Sequence Number=SeqID_18548
  Gene Ontology: Mol. function=catalytic activity; Cellular component =plastoglobule; Biological process=cellular metabolic process
  Homolog annotation: Hit_ID=Q9FVR6; Match level="QueryCoverage=92%, HitCoverage=100%, E-value=2e-85, Identity=57%"; Hit description =Uncharacterized protein At1g32220, chloroplast precursor
  Pfam annotation: Domain name=3Beta_HSD; Domain location=73-277; Score= -118.0; E_value=0.0064; Accession=PF01073.10; Description=3-beta hydroxysteroid dehydrogenaseisomerase family
  Pfam annotation: Domain name=Epimerase; Domain location=72-281; Score= -24.5; E_value=2.5e-05; Accession=PF01370.12; Description=NAD dependent epimerasedehydratase family
  Pfam annotation: Domain name=NAD_binding_4; Domain location=74-265; Score=-98.3; E_value=0.021; Accession=PF07993.3; Description=Male sterility protein
  Pfam annotation: Domain name=RmlD_sub_bind; Domain location=70-305; Score=-179.4; E_value=0.027; Accession=PF04321.8; Description=RmlD substrate binding domain
  Pfam module annotation: Pfam domain module=3Beta_HSD::Epimerase::NAD _binding_4::RmlD_sub_bind; Domain location=73-277::72-281::74-265::70- 305
  Subcellular localization annotation: CTP_CleavageSite=44; ConfidenceScore=5.69e-01
MASFLSFLPAVSARPIPTSAFSPKRPLFQTPPTLHFKNHRFAVSCSYAEAGVYANSSSNTIDVVADVRSERIVVLGGNGFVGSSICKAAVSKGIEVISLSRSGRPTYSGDVFYVNWDEVLVGATAVVSTLGGFGSEEQMKRINGEANVVAVNAAKEYGIPKFILISVHDYNLPSFLLSSGYFTGKRKAESEVLSKYPNSGIVLRPAFIYGKRRVDGFELPLDLVGEPAEKILRAVENFTKPLSSLPASDLLLAPPVSVDDVALAVINGVTDDDFFGIFTIDQIKEAANKVRARRNYHEAIFLMLIPAAFGAQSF

SEQ ID NO: 110234 - protein, 619 aa, Glycine max
  Coding DNA Sequence Number=SeqID_18549
  Gene Ontology: Mol. function=protein dimerization activity; Cellular component=nucleus; Biological process=regulation of transcription, DNA-dependent
  Homolog annotation: Hit_ID=Q94KA7; Match level="QueryCoverage=82%, HitCoverage=91%, E-value=1e-150, Identity=80%"; Hit description=BZIP transcription factor 3
  Pfam annotation: Domain name=HALZ; Domain location=537-586; Score =6.5; E_value=0.059; Accession=PF02183.9; Description=Homeobox associated leucine zipper
  Pfam annotation: Domain name=MFMR; Domain location=77-403; Score =341.4; E_value=1.6e-99; Accession=PF07777.2; Description=G-box binding protein MFMR
  Pfam annotation: Domain name=bZIP_1; Domain location=514-577; Score =88.7; E_value=1.9e-23; Accession=PF00170.12; Description=bZIP transcription factor
  Pfam annotation: Domain name=bZIP_2; Domain location=514-568; Score =30.9; E_value=4.7e-06; Accession=PF07716.6; Description=Basic region leucine zipper
  Pfam module annotation: Pfam domain module=HALZ::MFMR::bZIP_1::bZIP _2; Domain location=537-586::77-403::514-577::514-568
MGISQTVQNGKENLTGQRHRTTIHGGEENLYHLRFGDNIGQHQKLDFGMIGREQGAMYWLVPVGWFNVYFEDTDISMGSSEMDKTPKEKESKTPPPPPTSQEQSSTTSTGTINPEWPGFQAYSPIPPHGFLASNPQAHPYMWGVQEDDWRDAQVEKLAGVLHDLGRRVFVGARDGAVRHTMTKVGGWLNKARPDLKTGDHRSSNHGSSKNVLHQWLVSSQLQNIGGPAAIDNHEYDCTRERLLQLQKHMPELMVVAYQLYSGNGTGDAGLVSGVQFMPPYGTPPHPYVAMYPPGGIYAHPSMPPGSYPFSPFAMPSPNGIAEASGNTPGSMEADGKPPEVKEKLPIKRSKGSLGSLNMITGKNNEHGKTPGTSANGIHSKSGESASEGEGTSEGSDANSQNDSQLKSGGRQDSFEDEPSQNGSLAYTAQNGGLNTPHTVVNQTMSIIPISAGGAPGAVPGPTTNLNIGMDYWGTPASSNIPALGRKVPSTAVAGGMVTVGSRDSAQSQLWLQDERELKRQRRKQSNRESARRSRLRKQAECDELAQRAEALKEENASLRSEVNRIRSDYEQLVSENSALKERLGELPANDDHHRSCRNDQHVGNDTQQSGQTEAMPGGQ

SEQ ID NO: 110235 - protein, 235 aa, Glycine max
  Coding DNA Sequence Number=SeqID_18550
  Homolog annotation: Hit_ID=A7P2Q7; Match level="QueryCoverage=64%, HitCoverage=41%, E-value=1e-40, Identity=52%"; Hit description =Chromosome chr1 scaffold_5, whole genome shotgun sequence
MPHRNNPAPLPLVVTLNCVEDCSLEFESLAGVATAVEEVVDPKCKEARNDDDKKPHELFTERHKELVKAGEKWAKETANSFTLVGTLITTIMFAAVFTVPGGNTQDTGVPIFLKEKIFTAFVVADAISLFTSATSVLICIWIVASRYAEQDFLRRLPYKLLLSIFYLFLSEVSMIFAFCAALGILLKNYWAYKRLFIGGVISGSIPVIILALSLNNDIGRLNGPNVLYYRQFLSA

SEQ ID NO: 110236 - protein, 318 aa, Glycine max
  Coding DNA Sequence Number=SeqID_18551
  Gene Ontology: Mol. function=CP2 mannose-ethanolamine phosphotransfera se activity; Cellular component=endoplasmic reticulum membrane; Biological process=metabolic process
  Homolog annotation: Hit_ID=A7R6R3; Match level="QueryCoverage=90%, HitCoverage=35%, E-value=1e-114, Identity=71%"; Hit description =Chromosome undetermined scaffold_1394, whole genome shotgun sequence
  Subcellular localization annotation: CTP_CleavageSite=51; ConfidenceScore=5.11e-01
MSSISCTKLTLFSLAAVAIQFIGLSIFVFGFFPVKPLLSGYSGCESFRRPTCDNDGAANQSYASLSPDRRRFLYQEGSEIPPLYDRLVLMVIDGLPAEFVLGKKGQPPSKAFMEAMPYTQSLLASGMAVGYHAIAAAPTVTMPRLKAMVSGAIGGFLDVAFNFNTLAYLDDNLVAQFFKIGWKMVMHGDDTWLRLFPGLFARHDGVSSFFVKDTVQVDQNVSRHLGDELSRDDWNFLILHYLGLDHVGHIGGRNCVLMAPKLFEMDEVVKMIHINTLRNLENDQRKTLLSMKKVISSMYYFVRAEIHYIEENEKGKNK

SEQ ID NO: 110237 - protein, 367 aa, Glycine max
  Coding DNA Sequence Number=SeqID_18552
  Gene Ontology: Mol. function=microtubule motor activity; Cellular component=microtubule associated complex; Biological process =microtubule-based movement
  Homolog annotation: Hit_ID=A5C8Q9; Match level="QueryCoverage=95%, HitCoverage=19%, E-value=1e-102, Identity=59%"; Hit description =Putative uncharacterized protein
  Subcellular localization annotation: CTP_CleavageSite=34; ConfidenceScore=5.19e-01
MTRENCGSSKTLMIVNVCPNSSNLSETLLSLNFSARARNSVLSLGNRDTIKKWRDVANDARKELYEKEKEIQYLKQDGLRLKQALKDANDQCALLFNEVQKAWKVSSALQTDLKSEHILLADNYKVEKEQNAQLRNQVAHMLQLEQEQNLLIQQRDSTIQSLQAKIGSLEIQLNEALKSSNTGSNVGPETLSGTLSNPRTTGDGTDSSAVTKKLEEELKKRDALIERLHVENEKLFDKLTEKASLAGSPQLSSPLSGGAVNVQPQNRGSIWILALFSLYSNRNGTSTTARARSLDVLPSSLMTDKNDGTVALVKSDSEKVKTTPAGEYLTAALNDFNPDQYEGLAAISDGANKLLMLVWVLSVLGSV

SEQ ID NO: 110238 - protein, 121 aa, Glycine max
  Coding DNA Sequence Number=SeqID_18553
MSPESPSYAVDISHKAKQGKEVEQAIDVDQQQQQQHGNKAKGLLCLKHPDDETSPDSNNSNNGSRKKLKLTKDQSASSEDIFKLHSTLNPLRVCNCNATKGMSNIGTKTSTHNAVPRRTIR

SEQ ID NO: 110239 - protein, 121 aa, Glycine max
  Coding DNA Sequence Number=SeqID_18554
MTRGNPGDLQPFHPEIDRTFHRLFRHSVHPDHSVYFEHFEHFVHSEHSVASDSEHFDFEHSAANSHTENMAQPPPHERNLREMDAPDFTYESLCIQYLDEDVPYVLKTGLIHLLPKFDGLA

SEQ ID NO: 110240 - protein, 65 aa, Glycine max
  Coding DNA Sequence Number=SeqID_18555
  Subcellular localization annotation: CTP_CleavageSite=32; ConfidenceScore=5.04e-01
MTLGAEFNVKSLTCRDWNTSSKVSQKECVRFCARKKRTTYISMKFSRFKKLGLGFDMLMKDRDTG

SEQ ID NO: 110241 - protein, 100 aa, Glycine max
  Coding DNA Sequence Number=SeqID_18556
  Homolog annotation: Hit_ID=A6FJQ2; Match level="QueryCoverage=38%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVDSRGSPPTHRPDLGLKYPSSAKTKKRTIGILVLGLALFYTNSITSAEQG

SEQ ID NO: 110242 - protein, 405 aa, Glycine max
  Coding DNA Sequence Number=SeqID_18557
  Homolog annotation: Hit_ID=Q6WAY6; Match level="QueryCoverage=79%, HitCoverage=58%, E-value=6e-37, Identity=31%"; Hit description =Putative uncharacterized protein
MGPLQRQAFRKVYGKILDLATAEVFTEAVLSLAQYYDQPLRCFTFGDFQMVPTIEEFEEILGCPLGGRKPYLFSGFLPSLSKIAAVIGDSAKELDRMKQTRNGVVGLPRKYLEGKARDMASQEKWGPFVDILALLIFGVVLFPNVDGLVDLAAIDAFLAYHYSKESPVVAILADLLTPLTGDTRHPCPLQSYRSCAEKGGVDWDQHLAGIGGSAINWFPRWKEGKEGVLFSCGDYPNVPLIGTRGCINYNPALTIRQLGYPMRGAPIEESLSPFLVRDLGAQGLKVIQRIHKAWRSPLKKDKELRGIQNGVIGGYHGWLRIHAQGLDWLSKLKVIDEENFEALEEDEEVRALKLELGKARLAKEKFKSAATHIRKVCTELQEENAATARALEQETKRAHKEEGIL

SEQ ID NO: 110243 - protein, 67 aa, Glycine max
  Coding DNA Sequence Number=SeqID_18558
MIGPPRAFIKHDIQWLSARNNPEEDELSSLLSAPLQVIKRTASAHLLSERSALRQKSLTCAKQSIRA

SEQ ID NO: 110244 - protein, 55 aa, Glycine max
  Coding DNA Sequence Number=SeqID_18559
MTGDVSKFTHISPKKNEHVIYGDNNKGRILGVGKIANIMIHGYGIKGLLTLTWNT

SEQ ID NO: 110245 - protein, 131 aa, Glycine max
  Coding DNA Sequence Number=SeqID_18560
  Subcellular localization annotation: CTP_CleavageSite=46; ConfidenceScore=5.23e-01
MLILMLRERQILSKNCMQKFKPALRKRMNNMQSKQIRVASKLFLKQGSNKSYSRMNFCVGEGGNDGGATSSSNDPLLGIGGPMTRSMTKRMKQALQGLILKIKKKEDQCELRATPNWVTPLQVDEYVLRST

SEQ ID NO: 110246 - protein, 79 aa, Glycine max
  Coding DNA Sequence Number=SeqID_18561
MKPKGKRKKDREGRHVIVKKYKSFVKSKRIFWKQGTDAKSLFYGITEIRMDEFIELMKEHNMETLGSVCVNFHRSITMP

SEQ ID NO: 110247 - protein, 94 aa, Glycine max
  Coding DNA Sequence Number=SeqID_18562
MHTHTHAYCCGKTGAGSSRATFWGRDEVKAAGNQSRYLGTDASGDGVTTDRSLPLLCAKQAENVAARQPSILCIRSFLLLFVCFKISNRRLILT

SEQ ID NO: 110248 - protein, 112 aa, Glycine max
  Coding DNA Sequence Number=SeqID_18563
MLDFKPQHCGSNDFQDYFDDAKESRVKQVPKNQASRIKIQEQLSFKIQDSRTIKIKIQDSREVDFKIQEKKSRSNNQDFTREVFFKNPNIAQFCFTKEFFQKFSKLPEYLLS

SEQ ID NO: 110249 - protein, 220 aa, Glycine max
  Coding DNA Sequence Number=SeqID_18564
  Homolog annotation: Hit_ID=A5B2J2; Match level="QueryCoverage=47%, HitCoverage=30%, E-value=4e-10, Identity=34%"; Hit description =Putative uncharacterized protein
MVAPPGSILSIEQFLEQVSWPRAQPSIVRTGGRFAAQAPQQEGSNEAAALPEPTPMRRMLRLGIPRICLRTFKFLMILLFGTYHPFDHPEHSITGESVHSVIGDFEHPDFEHYNFEHSDFEHSENMAQPPPRERTLREMVAPDFTYESLCIQYPDEDVPYVLKTGLIHLLPKFHGLAGEDPHKHLKEFHIVCSTMKPPDVQEDHIFLKAFPHSLEGVAKD

SEQ ID NO: 110250 - protein, 58 aa, Glycine max
  Coding DNA Sequence Number=SeqID_18565
MRSATLPEGRRRTGGRSLWKNASNAAFLRFLAFCWPFAHMFFPALSPDSVDNRITAFE

SEQ ID NO: 110251 - protein, 161 aa, Glycine max
  Coding DNA Sequence Number=SeqID_18566
MAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHGSASFSCPTPDQFRAEVAWPGDWPEAQAGEAPPEAPDDGEEAHEDEEMADLLDFLGGSGD

SEQ ID NO: 110252 - protein, 116 aa, Glycine max
  Coding DNA Sequence Number=SeqID_18567
  Homolog annotation: Hit_ID=A6FJQ2; Match level="QueryCoverage=32%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARPENLLLDAKGVLKVSDFGMRPLFQQVPLHTPWGTELEFVIMVIAVSCVKLLSAHNSTQHTSRKHKV

SEQ ID NO: 110253 - protein, 108 aa, Glycine max
  Coding DNA Sequence Number=SeqID_18568
  Subcellular localization annotation: CTP_CleavageSite=85; ConfidenceScore=5.86e-01
MATPPSSPPPPPGAASQLPSTLKQTRKTTQLRSLATRLIRAERPGRPTPTRKVSMTLYVKSTTLARRSGPNFVRPAETLRGRMCEKSHRPSKSKTLSLTCCLVGVMHI

SEQ ID NO: 110254 - protein, 92 aa, Glycine max
  Coding DNA Sequence Number=SeqID_18569
  Homolog annotation: Hit_ID=A6FJQ2; Match level="QueryCoverage=41%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLAVRLGRSREWVMVVAESGSQVATSTESGSRRDCVRRQARAAVMERE

SEQ ID NO: 110255 - protein, 121 aa, Glycine max
  Coding DNA Sequence Number=SeqID_18570
MLLPPNLKPNVINTHTHSDPNEIQQRRHENARGEFRLQRRQGHDDLEKTTAKSQLAAFLASSKSKESLTHNLKEVLQLLQQEVEDEPPKKEAESSETNDDQEDDPFYQNEDDCFGISLDDD

SEQ ID NO: 110256 - protein, 77 aa, Glycine max
  Coding DNA Sequence Number=SeqID_18571
MKLAKYRLKAQVEKDEGPSGEGQSPQVEKDEGSSNPCGVYPDLSSFIGSGIYPDLSSFTGSGVNQKLYSLYQAIRAP

SEQ ID NO: 110257 - protein, 187 aa, Glycine max
  Coding DNA Sequence Number=SeqID_18572
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=100%, E-value=1e-10, Identity=27%"; Hit description= UPI00006A17C9 related cluster
MLVCMIRTRLFAAARVESCPGMHSSCTIASSSGCTCIVGPPPGSGGDPGTDKRKLLAPEPRVQVWIWSPLKVRTRNPLKARACIPLKFRTCRPLKARACSSLKVRTCSPLKARTCCPLKARTCSPLKVRTCSPQKVRACSPTKARARKSSPLKVRACNPLMVRTCSPLKAKTCSPLKARTGSPLEAT

SEQ ID NO: 110258 - protein, 100 aa, Glycine max
  Coding DNA Sequence Number=SeqID_18573
MGRLQGRHRILNFASNSLCNFQPQTTIAQTSEWTVARGIYTDQNSLLAYLFKEVFVLYVEREVWIKDPEHGGIPCNLVRPQEKLWNGQCHQIKQIIDLQI

SEQ ID NO: 110259 - protein, 124 aa, Glycine max
  Coding DNA Sequence Number=SeqID_18574
NLLADSISPESAQGSKPEAKFLFYDTLESDSSPGPVVELDPRPTPIEIFPCAVQVNFALEGIPGSSELQPEEVGETVPVAKVKPVHSFMAIGLQSCFGSRLRSRKSLQAMALDRPDFLERKASE

SEQ ID NO: 110260 - protein, 202 aa, Glycine max
  Coding DNA Sequence Number=SeqID_18575
MAAAQSSWAGFRPSAWVGGLARDCSASASAQSSAGDEPEPGSFLSVMGVLAVEDAVAALHQRHAVDVGDDGLRHIHGQDVADLHAHQFADAGRNAGEFGDHVDVGAAHLARELLRPALVDFLERGFLQRPREQVAHRLDHGVGQADVEVAAGRAEFDVEGGDHHHFIVAGDAGELGVHLRAHVIEFDRIDGIPGLAVAFQGQ

SEQ ID NO: 110261 - protein, 201 aa, Glycine max
  Coding DNA Sequence Number=SeqID_18576
VDSRGSPPKVVQHLIDAGWLTFQEDRPNVKTNPLANHGGGAVNAIESDRPRKFKPLKDVATPRREEQHICMQSANERSFGRPKPLVIYFTKDAASQKPRYPSTAKPVPFPYQNGHAVPSRYTPPSERKEEATDISSLSTKVTNITDRSGRMFAPPDLPTQPANVKGKAKVVDEYDKMTLTPNEDIPVKGLPEKRDGCGKKE

SEQ ID NO: 110262 - protein, 82 aa, Glycine max
  Coding DNA Sequence Number=SeqID_18577
MTVANKRHEWDIGGIAEFTIDSKGISAQPTPTWAIGMPIMSLCPKLHQDVMVELLRQINDLEMPFAWPFLSKTSTTTVKGLG

SEQ ID NO: 110263 - protein, 98 aa, Glycine max
  Coding DNA Sequence Number=SeqID_18578
  Subcellular localization annotation: CTP_CleavageSite=44; ConfidenceScore=5.27e-01
MTVKTLTTCSSGDGHSCLCVRRKYRIRRHSPFRLRNCWEGRSVRASSLLRQLAKGGCAARRLSWVTPGFSQSRRCKTTASAKLACLQVDSRGSPVCPN

SEQ ID NO: 110264 - protein, 214 aa, Glycine max
  Coding DNA Sequence Number=SeqID_18579
  Homolog annotation: Hit_ID=Q2HSV3; Match level="QueryCoverage=70%, HitCoverage=22%, E-value=2e-09, Identity=29%"; Hit description=IMP dehydrogenase/GMP reductase, putative
CWIDEHFPSVVESIADQDYDKASPRACKWIATKKTVKSIRTPSYRERLDRLQIPDVCWIPYWEHREVRDFHVRSCYSGLLRWGACCCVLPTGEGRAAVWLHADHSAPPVDSWVSYDDIHDRWMHYEDHIIPAGEVCVVPGACSSDYINWFFRISHPFMTPSHAVDPLPHGHASQPRVVPQAPQMDIPRVPEPGASSTSAEEPRHAVEVCDDIAE

SEQ ID NO: 110265 - protein, 149 aa, Glycine max
  Coding DNA Sequence Number=SeqID_18580
MVNQEEWVSFMDVLALLIFGVVLFPNVDGLVDLAVIDAFLAYHHSKESPVVAVLADLFDTLYLTEGMRGCINYNPTLAIRQLGYPMRGAPTEESLSPFLVRDFGAQNFKVIQRVHKAWESPLRKDKELRGILIEAVPESNKHENAVTRK

SEQ ID NO: 110266 - protein, 189 aa, Glycine max
  Coding DNA Sequence Number=SeqID_18581
MATASSTVREVEPVLQPALNPGRDRNTAVQALTFEGQLPPYDDYPGQDDEEGDTHLGPLQHLKDPSPHELPQPNIVRHNPTSPTPVKKFVPFMEDKGKIEALAPPPQSSRGPRQLHILGFSGFMSRAQHRHPSQVQRYPGLWISTKGRTCPKGHLSGCICRKMGAYSADEKCCPFLSRQLGQSSCSMVY

SEQ ID NO: 110267 - protein, 118 aa, Glycine max
  Coding DNA Sequence Number=SeqID_18582
MEKVTPSDPRPAPIIEKIKHDNSRKVEITFNRRNSFSSRIEASRSEYESARRSFSVRTRSIPVGLTRSESHNQFPTVNLQGLDTTSSIPRATYNQEQEDDQKSIQSPTYSSMELYDVI

SEQ ID NO: 110268 - protein, 79 aa, Glycine max
  Coding DNA Sequence Number=SeqID_18583
IMARSPDKIKSIDGSKETLKLSVRISDLWFIGTPNKSEQAEMVFVDSDVYYLLFSSLCCNLNAIQGDEIHAVCKEDQLK

SEQ ID NO: 110269 - protein, 80 aa, Glycine max
  Coding DNA Sequence Number=SeqID_18584
MAKFDPEIVLEFYANAWPTEEGVRDMRSWFWRKANSVSSVRGGTWPTISMRKPLPSCGAYRVRISPGPLQGGGCGSCAPA

SEQ ID NO: 110270 - protein, 175 aa, Glycine max
  Coding DNA Sequence Number=SeqID_18585
  Gene Ontology: Mol. function=catalytic activity; Biological process =metabolic process
  Homolog annotation: Hit_ID=A6T599; Match level="QueryCoverage=98%, HitCoverage=97%, E-value=8e-54, Identity=61%"; Hit description =Hypothetical isochorismatase family protein
  Pfam annotation: Domain name=Isochorismatase; Domain location=1-170; Score=14.6; E_value=3.1e-07; Accession=PF00857.11; Description =Isochorismatase family
MAQRVVMVVDMQNGVLATPRYDRAGRCARINQLMAAADQVIFIQHSGPDLAADSADWQIVAELEQPAGALYITKTACDSFWQTGLAAQLEQHQIESFVICGCATDYCVDTTIKVGASLGYHITVAADAHTTADRTYVSAQQLINQHNEVWADLIMPGNPVRVKTTEELLREWRAH

SEQ ID NO: 110271 - protein, 242 aa, Glycine max
  Coding DNA Sequence Number=SeqID_18586
  Gene Ontology: Mol. function=sequence-specific DNA binding; Cellular component=intracellular; Biological process=regulation of transcription, DNA-dependent
  Homolog annotation: Hit_ID=Q6D711; Match level="QueryCoverage=53%, HitCoverage=46%, E-value=1e-32, Identity=56%"; Hit description=AraC -family transcriptional regulator
  Pfam annotation: Domain name=HTH_AraC; Domain location=41-87; Score =40.7; E_value=5.3e-09; Accession=PF00165.14; Description=Bacterial regulatory helix-turn-helix proteins, araC family
  Pfam annotation: Domain name=HTH_AraC; Domain location=93-136; Score =4.5; E_value=1; Accession=PF00165.14; Description=Bacterial regulatory helix-turn-helix proteins, araC family
  Pfam module annotation: Pfam domain module=HTH_AraC::HTH_AraC; Domain location=41-87::93-136
MWQAQSALERQGALLDLLEWLRPLAQQGVARPREGAHRFDVVKAWLRDNLAEPVRLEELAALVSLSPWHFLRSFKQHFHVTPHQMLMAFRLFEAKQRLAQGESAASVAAAVGLTDQAHLTRAFAHRYGIRRDAIKSRNSVCPRGGADVGHDFCRAAADTRLSGHVAISGSLCCLWSGGAAAGVAQPAPAKTADAPGLDGGGEAVAGGQSALLRLPCQRDSAHRRTGLHHDHRYAAGGDHRHR

SEQ ID NO: 110272 - protein, 216 aa, Glycine max
  Coding DNA Sequence Number=SeqID_18587
  Gene Ontology: Mol. function=sequence-specific DNA binding; Cellular component=intracellular; Biological process=regulation of transcription, DNA-dependent
  Homolog annotation: Hit_ID=A7MPK6; Match level="QueryCoverage=49%, HitCoverage=99%, E-value=3e-37, Identity=70%"; Hit description =Putative uncharacterized protein
  Pfam annotation: Domain name=HTH_AraC; Domain location=18-64; Score =37.5; E_value=4.6e-08; Accession=PF00165.14; Description=Bacterial regulatory helix-turn-helix proteins, araC family
  Pfam annotation: Domain name=HTH_AraC; Domain location=70-114; Score =56.5; E_value=9.4e-14; Accession=PF00165.14; Description=Bacterial regulatory helix-turn-helix proteins, araC family
  Pfam module annotation: Pfam domain module=HTH_AraC::HTH_AraC; Domain location=18-64::70-114
AITLQKEQAMMQQEIIHSLTNWIDQNLDKTLSIDEVAAKSGYSKWHLQRMFRTVTKQTLGGYIRERRLTLAAEALRQTQRPVFDIAMQYGYDSQQTFSRVFRRQFSQTPTAYRHSMRRQAMVQRPRLVNFDCSEGMNSFAQRTTGECCPRFFADGYVNYQSDRHALGTAQRAMSCWFVTGLLGITLSMENVHNFMSITKEAFIQVMSQTPADWPMP

SEQ ID NO: 110273 - protein, 535 aa, Glycine max
  Coding DNA Sequence Number=SeqID_18588
  Gene Ontology: Mol. function=sequence-specific DNA binding; Cellular component=intracellular; Biological process=regulation of transcription, DNA-dependent
  Homolog annotation: Hit_ID=A7MPK6; Match level="QueryCoverage=19%, HitCoverage=95%, E-value=1e-35, Identity=71%"; Hit description =Putative uncharacterized protein
  Pfam annotation: Domain name=HTH_AraC; Domain location=432-478; Score= 37.5; E_value=4.6e-08; Accession=PF00165.14; Description=Bacterial regulatory helix-turn-helix proteins, araC family
  Pfam annotation: Domain name=HTH_AraC; Domain location=484-528; Score= 56.5; E_value=9.4e-14; Accession=PF00165.14; Description=Bacterial regulatory helix-turn-helix proteins, araC family
  Pfam module annotation: Pfam domain module=HTH_AraC::HTH_AraC; Domain location=432-478::484-528
  Subcellular localization annotation: CTP_CleavageSite=31; ConfidenceScore=5.03e-01
MPVTEISVNSRPIRKTAPSATGTLMCWPSTRLNAVKAVREMAQPIAIGRLAHSPMMREPKLATRQVTARLAFAHHPGEDVSERKAGKRLRGRVFQVKKGIMRSSGAIMAGVTLAGAGNHGGKRLAFQVVCCGAATARRGILFRCVTAAPQPVNRQKSAAGSDAAQSRARGAPAACSATLSECLYSAPRRPGAAAMAPAFCPVAQTPASSPVAASANLQHSAASNAPEFAPLPHAAPADARCPFDLIRHRQLFQQPQHPMRTGVFQMVNGNHARFLAAKGWHLDRSGALLPQAVTRIAQWTVAHRQAAATNAAVKIVAQTRQGFDAFIQLFAPVLRQRVPLLRRHALIRRHVHQAVADRRQRNPDALGNFDDCHTAQHITAVAALITAIARAADQAFAFIKVQCRYRHAAAFRHFARRQHRFRAMMQQEIIHSLTNWIDQNLDKTLSIDEVAAKSGYSKWHLQRMFRTVTKQTLGGYIRERRLTLAAEALRQTQRPVFDIAMQYGYDSQQTFSRVFRRQFSQTPTAYRHSMRRQAM

SEQ ID NO: 110274 - protein, 345 aa, Glycine max
  Coding DNA Sequence Number=SeqID_18589
  Gene Ontology: Mol. function=transporter activity; Cellular component= membrane; Biological process=transport
  Homolog annotation: Hit_ID=A8GK85; Match level="QueryCoverage=96%, HitCoverage=73%, E-value=1e-150, Identity=82%"; Hit description =Xanthine/uracil/vitamin C permease
  Pfam annotation: Domain name=Xan_ur_permease; Domain location=26-344; Score=165.5; E_value=1.5e-46; Accession=PF00860.11; Description =Permease family
MSGESRPARGKLDAWFHISARGSSVRQEVLAGLTTFLAMVYSVIVVPGMLGKAGFSPTAVFVATCLVASFGSLIMGLWANLPMAIGCAISLTAFTAFSLVLGQHISVPVALGAVFLMGLLFTLISVTGIRAWILRNLPMGVAHGTGVGIGLFLLLIAADGIGLVVKNPAAGLPVALGHFTSFPVIMALIGLAAIFGLEKRRVPGGILLTIIAISLLGLIFDPAVKWQGLFAMPSLRDASGQSAMFSLDIMGALQPVVLPSVLALVMTAVFDATGTIRAVAGQANLLYKEGQIINGGRALTTDSISSLFAGLVGASPAAVYIESAAGTAAGGKTGLTAIVVGLCSC

SEQ ID NO: 110275 - protein, 550 aa, Glycine max
  Coding DNA Sequence Number=SeqID_18590
  Gene Ontology: Mol. function=acetate transmembrane transporter activity; Cellular component=integral to membrane; Biological process=sodium ion transport
  Homolog annotation: Hit_ID=A6TGZ7; Match level="QueryCoverage=100%, HitCoverage=99%, E-value=0.0, Identity=79%"; Hit description =Cation/acetate symporter actP
  Pfam annotation: Domain name=7tm_1; Domain location=224-449; Score= -79.9; E_value=0.003; Accession=PF00001.12; Description=7 transmembrane receptor (rhodopsin family)
  Pfam annotation: Domain name=IspA; Domain location=355-524; Score= -100.8; E_value=0.079; Accession=PF04279.6; Description=Intracellular septation protein A
  Pfam annotation: Domain name=SSF; Domain location=63-469; Score =625.1; E_value=6.4e-185; Accession=PF00474.8; Description =Sodium:solute symporter family
  Pfam module annotation: Pfam domain module=7tm_1::IspA::SSF; Domain location=224-449::355-524::63-469
MKRLLSASLAIVPASVFAADAITGAVQKQATNYEAIIMFVVFVAATLGITYWASKRTRSRSDYYTAGGNITGFQNGLAMAGDFMSAASFLGISALVYTSGYDGLIYSLGFLVGWPMILFLIAERLRNLGRYTFADVASYRLQQKPIRTLSACGSLVVVALYLIAQMVGAGKLIQLLFGLDYHIAVVLVGILMVLYVLFGGMLATTWVQIIKAVLLLFGASFMAIMVMKATGFSFNRLFTEAMAVHPKGSAIMQPGGLVKDPISALSLGLGLMFGTAGLPHILMRFFTVADAREARKSVFWATGFMGYFYFLTFIIGFGAILLVGANPAFKDASGALIGGTNMAAVHLSNAVGGSLFLGFISAVAFATILAVVAGLTLAGASAVSHDLYASVIRKGQATEREELRVSKITVLVLGVVAIALGILFEKQNIAFMVGLAFSIAASCNFPIILLSMYWSKLTTRGAMVGGWLGLLTAVVLMILGPTIWVQVLGHATPVYPYEYPALFSMLVAFVGTWLFSITDHSQQGALERAKFRGQFIRSQTGVGISQGKAH

SEQ ID NO: 110276 - protein, 651 aa, Glycine max
  Coding DNA Sequence Number=SeqID_18591
  Gene Ontology: Mol. function=acetate-CoA ligase activity; Cellular component=cytoplasm; Biological process=metabolic process
  Homolog annotation: Hit_ID=Q8ZKF6; Match level="QueryCoverage=100%, HitCoverage=99%, E-value=0.0, Identity=82%"; Hit description=Acetyl -coenzyme A synthetase
  Pfam annotation: Domain name=AMP-binding; Domain location=109-547; Score=469.9; E_value=3.3e-138; Accession=PF00501.19; Description=AMP- binding enzyme
MSQIHKHPVPAAIAANALINADQYAALYQQSVDDPEAFWGEQGKILDWMTPYSKVKNTSFAPGNISIRWYEDGALNLAANCLDRHLATRGDHPAIIWEGDDASESKTLTFRELHADVCRFANVLTGLGVKKGDVVAIYMPMVPEAAVAMLACARIGAVHSVIFGGFSPEAVAGRVVDSSAKLVITADEGVRAGRSIPLKKNVDDALNNPNVTSVKNVVVFQRTGKETGWHEGRDLWWHELMAKASDQHQPVAVEAEHPLFILYTSGSTGKPKGVLHTTGGYLVYAATTFKYVFDYHDDDVYWCTADVGWITGHSYLIYGPLACGATTLMFEGVPNWPQPSRMAEVVDKHKVTLLYTAPTAIRALMAEGDKAIAGTQRSSLRIMGSVGEPINPEAWEWYYKKIGDSRCPIVDTWWQTETGGFMITPLPGATELKAGSATKPFFGVQPALVDNEGNTLDGATEGNLVIVDSWPGQARTLFGDHDRFEQTYFSTFKNRYFSGDGARRDDDGYYWITGRVDDVLNVSGHRLGTAEIESALVSHPKIAEAAVVGIPHSIKGQAIYAYITLNHGEEPSPELYSEVRNWVRKEIGPIATPDVLHWTDSLPKTRSGKIMRRILRKIAAGDTSNFGDTSTLADPGVVEKLLEEKQSITMP

SEQ ID NO: 110277 - protein, 886 aa, Glycine max
  Coding DNA Sequence Number=SeqID_18592
  Homolog annotation: Hit_ID=A0TMR4; Match level="QueryCoverage=31%, HitCoverage=15%, E-value=8e-12, Identity=30%"; Hit description =Putative uncharacterized protein
SCGVIGDLVAIVKDRCRSGGDINQRTVQRFGADGATAVERERAAVEVRHGLATAGADAARTAGGVAAIDVDIAAVAGGGGEGAARAVHRDTGAAVADADIAAVAAGRPALHAQASGIGPAEVDVAAVAELRAVASQIAGNAVLRRIEFCGGSQPRAGDRRTAVAPVSVCFCPSAIAPVALLPLRVMVVAASMLPCAPPSILTPVAPVPLTLIVALLVFTNVPPPPVPFTATAPAPEAVSVVLVPSNIAPCSMRKSVELVVRIRAIGKKTNLIAAGAEAGNGILRDVNRGVAARVHANRAVAGEVNRPVHVRCGSAATLTFHPHAKVARAAGRIGSARHVDGPGGAGGGAVTTGGQHFQAGAVNAVEVDGAAILQRTVAVSDQHADVLARHARSAAVDVDGAAVDQRGIAGTADRHPGGVLYARANHNRPVVGGAAVGQQRNAAGQPALVQGCLRHVVAQAVLRASPEVNRAAAVVGKSAAVAGEQHAGSGAARAGTVDAHVDIAAVSGLRIGIKADARHAVGQIAAGGTEVKHAIVSEITAVLHRYRRGVVAGRADAGAINTVEETAVDDAAAAVGSRRAIQRQRGAAARQFPVDGGIGPAGHAYRAIAGPYHFQRFTGGDSDLRTGAFGIDHHAATYRLRHFIRRSGADVIDNIAVGDSDRLIERAEVAGRREIASLQLAHQPVIVALQLAGIGDVEGGGFAVQRLHAKAAVIGRKVLYRQAVGHLAAGNVGRRTVKGDAVVVVPVEGAAVTDLKQRGVFGRHGPGVGAGAAIGVSLTNADIQRTAAAADVGDTRIDILIVIHVLQIRHHRAGGNRCLRHQAGGIKHLKSGVAAGSGIRHGDGEVLRTGIETCLIKVLCARRDGHLAERGVDRPVNARLKCLITG

SEQ ID NO: 110278 - protein, 408 aa, Glycine max
  Coding DNA Sequence Number=SeqID_18593
  Gene Ontology: Mol. function=drug transporter activity; Cellular component=integral to membrane; Biological process=multidrug transport
  Homolog annotation: Hit_ID=Q8ZKH8; Match level="QueryCoverage=87%, HitCoverage=80%, E-value=1e-112, Identity=59%"; Hit description=DNA -damage-inducible protein F
  Pfam annotation: Domain name=MatE; Domain location=20-181; Score =132.2; E_value=1.5e-36; Accession=PF01554.9; Description=MatE
MGLMQLFSSSDKALWRLALPMILSNITVPLLGVVDTAVIGHLDSPIYLGGVAVGTTATSFIFMLLLFLRMSTTGLTAQAFGAGDKQALARALMQPLLIALAAGLLLALLRSPASSLAATLMGGSAEVQQQAQIFIEIRWLSAPATLANLVILGWLLGVQYARAPMVLLIVGNLVNILLDLLLVLKLHWGVAGAAAATALAEYVTLAVGLRMVARVLKLRGIDFKLLKHSWRGDAARLFRLNRDIMLRSLMLQICFASLTLLGARIGPDVVAVNAVLLMFLTFTAYALDGFAYAVEACSGEAVGAKDRSRLLLIWHAACRQAGIVALLFAVIYALSGPHIVALLTSLQPLREMADRFLLWQHDHGSSRFRYHFADAAVVRESRFMAGDHGVSGAARPDAGMDVAPPLAA

SEQ ID NO: 110279 - protein, 232 aa, Glycine max
  Coding DNA Sequence Number=SeqID_18594
  Gene Ontology: Mol. function=transcription regulator activity; Cellular component=intracellular; Biological process=regulation of transcription, DNA-dependent
  Homolog annotation: Hit_ID=A8GKE3; Match level="QueryCoverage=97%, HitCoverage=96%, E-value=6e-68, Identity=57%"; Hit description =Transcriptional regulator, GntR family
  Pfam annotation: Domain name=GntR; Domain location=5-67; Score=58.3; E_value=2.6e-14; Accession=PF00392.12; Description=Bacterial regulatory proteins, gntR fam
  Pfam annotation: Domain name=UTRA; Domain location=88-227; Score =155.2; E_value=1.8e-43; Accession=PF07702.4; Description=UTRA domain
  Pfam module annotation: Pfam domain module=GntR::UTRA; Domain location=5-67::88-227
MSSKTADVIAAALCERIENGEFVTRRLPAERALSEQYSTTRITLREALGLLEAQGVIYRELRRGWFIAPPRLIYNPAHHSHFHAMALQQGRIASTEVMEAREVPAQLAIARHLQLLEGDQVYRIRRLRRIDGRAVLYVEHYLNPAFFPGLLREDLTRSLTDLYDQRYGIHYGGARFTIVPGPLPARAAPALNVASGTPGLLITRINRDQHKRVIDCDCEYWRYDALCVDVEV

SEQ ID NO: 110280 - protein, 175 aa, Glycine max
  Coding DNA Sequence Number=SeqID_18595
  Gene Ontology: Mol. function=transcription factor activity; Biological process=regulation of transcription, DNA-dependent
  Homolog annotation: Hit_ID=Q6D9I3; Match level="QueryCoverage=97%, HitCoverage=100%, E-value=7e-63, Identity=64%"; Hit description=Zinc uptake regulation protein
  Pfam annotation: Domain name=FUR; Domain location=21-142; Score=16.1; E_value=5.6e-06; Accession=PF01475.10; Description=Ferric uptake regulator family
  Pfam annotation: Domain name=HTH_5; Domain location=27-80; Score =10.0; E_value=0.038; Accession=PF01022.11; Description=Bacterial regulatory protein, arsR family
  Pfam annotation: Domain name=MarR; Domain location=26-100; Score= -3.9; E_value=0.086; Accession=PF01047.13; Description=MarR family
  Pfam annotation: Domain name=TrmB; Domain location=20-94; Score=-0.4; E_value=0.0046; Accession=PF01978.10; Description=Sugar-specific transcriptional regula
  Pfam module annotation: Pfam domain module=FUR::HTH_5::MarR::TrmB; Domain location=21-142::27-80::26-100::20-94
MLMPNLTPEKLLTQAESLCLDRGVRLTTQRAEVLRLMAEQNGSISAYDLLDQLRISEPQAKPPTIYRALDFLLEQGFIHRVESNNSYVVCHHFDEPAHTSVMLVCDNCAAVSEKHAHGVEKIIAGLADQAGFTLRHSVIEAHGLCENCAEVAACTQPGSCQHDHEVESKKKVRKG

SEQ ID NO: 110281 - protein, 327 aa, Glycine max
  Coding DNA Sequence Number=SeqID_18596
  Gene Ontology: Mol. function=NADPH:quinone reductase activity; Cellular component=cytosol; Biological process=metabolic process
  Homolog annotation: Hit_ID=Q6D0Y5; Match level="QueryCoverage=100%, HitCoverage=99%, E-value=1e-140, Identity=76%"; Hit description =Quinone oxidoreductase
  Pfam annotation: Domain name=ADH_N; Domain location=28-109; Score =75.5; E_value=1.8e-19; Accession=PF08240.3; Description=Alcohol dehydrogenase GroES-like domai
  Pfam annotation: Domain name=ADH_zinc_N; Domain location=140-285; Score=133.2; E_value=7.4e-37; Accession=PF00107.17; Description=Zinc- binding dehydrogenase
  Pfam module annotation: Pfam domain module=ADH_N::ADH_zinc_N; Domain location=28-109::140-285
MAKRIQFNQHGGPEVLHWVDFTLADPADYEVQVENKAIGINYIDTYVRSGLYPVSSLPSGLGTEAAGIVKKVGSAVSRFKPGDRVVYCQAALGAYSELHNVAEDRLVILPDSISFEQAAASFLKGLTVQYLLRQTYKVKADEIFLFHAAAGGVGLIACQWAKALGAHLIGTVGSAEKAQIAKDAGAWATINYREEDIAQRVSELTNGEKVAVVYDSVGKDTWEPSLDSLRRHGLMVSFGNASGPVTGVDLGILNKKGSLFVTRPSLFGYITNREELDRASGELFSLIASRAIQLNVPEQQKFALSDAVRAHQVLESRATQGSSLLIP

SEQ ID NO: 110282 - protein, 414 aa, Glycine max
  Coding DNA Sequence Number=SeqID_18597
  Gene Ontology: Mol. function=sequence-specific DNA binding; Cellular component=integral to membrane; Biological process=regulation of transcription, DNA-dependent
  Homolog annotation: Hit_ID=Q6D0Y0; Match level="QueryCoverage=50%, HitCoverage=97%, E-value=2e-74, Identity=65%"; Hit description =Putative membrane protein
  Pfam annotation: Domain name=AsnC_trans_reg; Domain location=68-144; Score=70.3; E_value=6.2e-18; Accession=PF01037.12; Description=AsnC family
  Pfam annotation: Domain name=DUF161; Domain location=227-308; Score =79.4; E_value=1.1e-20; Accession=PF02588.6; Description =Uncharacterized BCR, YitT family COG1284
  Pfam annotation: Domain name=DUF161; Domain location=322-403; Score =60.4; E_value=6.1e-15; Accession=PF02588.6; Description =Uncharacterized BCR, YitT family COG1284
  Pfam annotation: Domain name=Rrf2; Domain location=1-99; Score=-34.9; E_value=0.045; Accession=PF02082.11; Description=Transcriptional regulator
  Pfam module annotation: Pfam domain module=AsnC_trans_reg::DUF161::DUF 161::Rrf2; Domain location=68-144::227-308::322-403::1-99
MTQVDDYDLKILTLLQSNGRLTNQELSDLVGLSASQCSRRRINLEQANLILGYHARLSPDAVGLGMVGLIEVRLKNHTPDYEESFHRMVEQEAAIVDAFKTTGDADYLLKVAVADLAALSALISQLVAGHQSVAHVKTSVICAVFRAKRAPETEFVHESIILQQIDAHKPAIKRLSYQLDNRWHPSAATGSRRCGAFFANERHHLQRDRTMDNAVQPSRIPHTRTEDALAIVLGTLMVSFGVILLKQAGALTGGTAGVAFLISYLSPLSFGSAFFLINLPFYWLAIRRMGWEFTLKTFCAVGLVSLFTHLHPLFIHFSALNPFYATLFGNVVMGIGFIVLFRHKASLGGINILALWLQDRSGLRAGKLQMALDTCVVLASLFVVSLPMLLASIAGAVMLNLIIAMNHRPGRYFV

SEQ ID NO: 110283 - protein, 71 aa, Glycine max
  Coding DNA Sequence Number=SeqID_18598
MQMLGGRQQGGNGGGAPMGGQGGGNNNGWGQPQQPQGGGNQFSGGAQQRPQQQSAPANNEPPMDFDDDIPF

SEQ ID NO: 110284 - protein, 86 aa, Glycine max
  Coding DNA Sequence Number=SeqID_18599
MSLHVLYLYAFSGFPPGISRLLCLSLQSFKEMNGQDHLELPSGVRTKCGQQKPIKEWMQVGMGSRPTDRCPFSARNKQRTSLQDSP

SEQ ID NO: 110285 - protein, 155 aa, Glycine max
  Coding DNA Sequence Number=SeqID_18600
MEIYVVFRADYICQALTREVRGQADIPQVRQASPLTRGDLRRLRRLPLQPLTREVRGQGNTPTVIQASEPIDTWRFTSSSAQTTLQALTREVRGQADIPQVVIHASEPLNAEIYVVFGAYYLCQPLTREIYVVLRADYLCQALTREVGGQADIPQ

SEQ ID NO: 110286 - protein, 188 aa, Glycine max
  Coding DNA Sequence Number=SeqID_18601
MVIDQSLFHDLTKLPNDGVPFEGTLNDDWKFDFSAHDARQLVCTNNADMTGRLLAGSLAFESRILHYLIVRILLPRSSNLAQRSFLIGAVVIASFGYRKEHDGSWVKKGAPPADDEGNQPVEDNSSLLRKLLEKFDGLQTFVGDKFDNMELQVDMRFDAMESRITKVEEDVSFIRTCFDPPPPPPSSS

SEQ ID NO: 110287 - protein, 117 aa, Glycine max
  Coding DNA Sequence Number=SeqID_18602
RVHLLGLLTENKRGYISCGSVLVEGTSTRLFKENKGGLFQDHDENQVNWCLMTKSDENNKEDSVRKKWYIDSGCSKHMTEMYPNSQPFPQEKWTRTYATQQRQIMESVNRYEFFYSH

SEQ ID NO: 110288 - protein, 86 aa, Glycine max
  Coding DNA Sequence Number=SeqID_18603
KDAQPQAADDRSPSPPPQRDDSSSFMQNVLDKLDGLLTFVGERFDSLDSRIDVIDARFAGMDTRITQLEEDMSFICQCFDLPPPSS

SEQ ID NO: 110289 - protein, 157 aa, Glycine max
  Coding DNA Sequence Number=SeqID_18604
  Homolog annotation: Hit_ID=A5AK77; Match level="QueryCoverage=52%, HitCoverage=10%, E-value=1e-08, Identity=39%"; Hit description =Putative uncharacterized protein
MTRGNPGDLQPFDLEIDRTFHRLVRHSVHPGHSVHFEHPDHFEHSVAGDSEYSDFEHSAINFHTENMAQPPPCERTLREMDAPDFTYESLCIQYPDEGVPYVLKTGLMHLLPKFHGLAGEDPHKHLKEFHIVCSTINPPDVQEDHIFLKNFPHSLEG

SEQ ID NO: 110290 - protein, 134 aa, Glycine max
  Coding DNA Sequence Number=SeqID_18605
  Homolog annotation: Hit_ID=A6FJQ2; Match level="QueryCoverage=28%, HitCoverage=84%, E-value=1e-10, Identity=89%"; Hit description=50S ribosomal protein L5
PGDGHSLSVSGCREQTSPSGRVSGCWRMRKEKIPHQAPFAIQDAQLLGRAIGAGLFAITPAGERGMCCKAIKLGNARVFPVTTFRETCRASCINESANARGEAVCVLGALPLPRSLTRCARSFGCGERYQLTQR

SEQ ID NO: 110291 - protein, 404 aa, Glycine max
  Coding DNA Sequence Number=SeqID_18606
NNDAAGKTKGISVQQGVQLAAILSGQRVAGAERGQNVHQGLARVAVGGGQIFLQMPHQQFQRFFVTPDLMQLQRQLHRQLDVARLLLHLLLQLLDFRRVRRMLQQFNLRHQALIAGIAILQWNGRQHRFGVFAAAERDLSFGQGQADIAALLAALPGVFQQRQRFGSVAGGQQFLRLRQFQIFFLRQETLQQVADRFFRLRALEAVDRLTVFEQVDGRNGTQPELGGDHLFGVAVHLGQNELAGVFRRQFVEHRRELQAVLAALGPEVEQHRNGHRLFQRLVQPWGVDGGAPPFFNPGGRIKRCCAAANPDSGPAECGAARSWRAPAGSPGSAVWRAGFPARGAAWAEWPPAAASGAWRCRGYAPWVEIGPAPRPALETKPITELVWICALRRAATSQQHNWVT

SEQ ID NO: 110292 - protein, 362 aa, Glycine max
  Coding DNA Sequence Number=SeqID_18607
  Homolog annotation: Hit_ID=Q53MV7; Match level="QueryCoverage=93%, HitCoverage=70%, E-value=3e-07, Identity=21%"; Hit description =Transposon protein, putative, CACTA, En/Spm sub-class
  Pfam annotation: Domain name=Transposase_23; Domain location=241-311; Score=-5.5; E_value=0.0048; Accession=PF03017.5; Description =TNP1ENSPM transposase
SDFDVEIGHFAADKDSVDDTVCKMYGISKEKWTQFCQSRRDPSWENVRKKAQAVQKQNTAPHVMSRGGYEYLEKKLMDEKRKKKLEEATQSGSTDTVIDPPSPIKRHVKWKLARTKKTGDMTSEAAKEIADKIDALEEQASQEHPGRVRAVGAGITIKQYFGSASRTSSIAPEYLQQLTQQIKDQLEDSITEKVTRRLMLSLSQMQSQGLALPHEPDVGPLAARVSTKESCVDPSGNDLDTGDSYKCGLYIEEYPSRLVALGRVYEGSTTIHNIPLLHDQVKVGVEEIRDVDAPILVPTKEVKVVGQALNTFLAWPTHLVKRLSEQGAVRPAKPADRPDDEVDDPLYLMTLTIPQLFLKPLQ

SEQ ID NO: 110293 - protein, 252 aa, Glycine max
  Coding DNA Sequence Number=SeqID_18608
  Homolog annotation: Hit_ID=Q2HW90; Match level="QueryCoverage=86%, HitCoverage=41%, E-value=3e-23, Identity=32%"; Hit description =Putative uncharacterized protein
MGLVHRHKESPIVALLIFGGVLFSNVDGLVDLVAIDAFLAYHNHKESPVVAMLADLYDTFDQRCEKSSTRIVCCTPTLYVWLVLHLFRQEVRHACPLESHRSCTEKGGANWDQLLANKEGVSVNWFPRWKEGGTGVLISCGGFPNVPLMGTRGCISYNPILAIRQLGYPIRGAPLEEELAPIIARGFNNTDVEALQKVRKAWEMVQKKDKELRGSNNGPIGGYLSYPNFVRGPLLDDMRPLFGPCKVLGTHH

SEQ ID NO: 110294 - protein, 121 aa, Glycine max
  Coding DNA Sequence Number=SeqID_18609
  Homolog annotation: Hit_ID=Q3BKH8; Match level="QueryCoverage=52%, HitCoverage=82%, E-value=1e-18, Identity=71%"; Hit description =Putative uncharacterized protein
DNRLISPRAHIDGKVWHSMSALRHWGCSMFQGLGCSPIKAVRELGSERRETVRSISGVGVRALRGPFPSTRGPGRTHLWCASYRAHGKRWVAKASGSTAETAMGSLPQRGWSERSFENSRE

SEQ ID NO: 110295 - protein, 316 aa, Glycine max
  Coding DNA Sequence Number=SeqID_18610
  Gene Ontology: Mol. function=transporter activity; Cellular component= membrane; Biological process=transport
  Homolog annotation: Hit_ID=A6T924; Match level="QueryCoverage=100%, HitCoverage=68%, E-value=8e-87, Identity=53%"; Hit description =Probable guanine/xanthin permease
  Pfam annotation: Domain name=Xan_ur_permease; Domain location=1-309; Score=206.3; E_value=7.4e-59; Accession=PF00860.11; Description =Permease family
MTVKAQGGSPQAILAMIFGCNLVAALIPMLISRCITPLRKVLTPVVTGTVITLIGISLIKVSITDWAGGHNASDFGAPGNLALGALTLLVIIVLNRSHSRWARLVAVVAGIGAGCIAAALSGHLPLKPMAETHWLVLPSLLHFGFDFSWTLFVPIALVSVICVIEAVGDLTANCLISRQPLEGDGFQRRLQGGILADGLSCLLAALFSAFPNTTFAQNNGVIQMTGVASRYVGMVIGLMLLLLGIFPLVGNLLQQIPPPVLGGATLVMFGSVVAAGIRVMTQAPLGRREMLIVAVSFGIGLGVEAVPDVLKQFPPL

SEQ ID NO: 110296 - protein, 55 aa, Glycine max
  Coding DNA Sequence Number=SeqID_18611
PRILDSTPWELVGLGSSSSMDSFASWKINGSGMGKEEREETPLQGEDESRRSSPP

SEQ ID NO: 110297 - protein, 134 aa, Glycine max
  Coding DNA Sequence Number=SeqID_18612
  Homolog annotation: Hit_ID=A2Q1D6; Match level="QueryCoverage=73%, HitCoverage=15%, E-value=1e-09, Identity=40%"; Hit description =Ovarian tumour, otubain, related
MKLKVRCGGRRRQTRYAEGGGCVADMDEDEWMYEIMFEQADMDYEMKKHVVFECREDVLRWARSVAHENGFMAVILRSDTNTGSRGRTTFVLIGCERSGKYRCRKKEFIRRDTGTRKYGCPFKLRCKPLVGGEG

SEQ ID NO: 110298 - protein, 209 aa, Glycine max
  Coding DNA Sequence Number=SeqID_18613
  Homolog annotation: Hit_ID=UPI0000ECBAF8; Match level="QueryCoverage =19%, HitCoverage=48%, E-value=3e-16, Identity=100%"; Hit description= UPI0000ECBAF8 related cluster
VGLNGGFVHTAQLGANDYTELRYYSVSYEKAPRFPKGERRTGSEQESARGSFQGETPGIFIVLSGFATSDLSVDFCDARQGGGAYGKTPATRPFYADTARRSRTTERSESVSEEAEERPIRKPPLPAPDNNFTQETAMTMITNSSSVPGSAIRSSDGMQAWHWPSFYNVVTGKTLALPNLIALQHIPLSPAGVIAKRPAPIALPNSCAA

SEQ ID NO: 110299 - protein, 330 aa, Glycine max
  Coding DNA Sequence Number=SeqID_18614
  Homolog annotation: Hit_ID=Q2HW90; Match level="QueryCoverage=43%, HitCoverage=28%, E-value=6e-13, Identity=36%"; Hit description =Putative uncharacterized protein
GHEAYTPRAIFQTALPQYPIPLCLNSVYRVYCFSNPHCVFCTGIAYGFRLDPTEGPCRLLKNVRWGILLPLDVVSKKGTDSPDPRIPRLHLCHMHSIMHSSIPPMRYRSFDLHQLLSHFSKHGNKSNRQEVLPSQGQKPRYHQHQGIKAVDGTPPNASLPQDLRKDLELTIAEVSIEAIASLTNTTTSFEMLHVGDFQLVPTIEEFEEILGCPLGGRKPYLFSGCLPSLSRIATVVKDSTRGLDRVKQTRNGIAGLPRKYLEDKARDMANQEDWVPFMDVLALLIFGVVLFPNVDGLVDLAAIDAFLAYHHSKESPVVAVLADLFDIFDR

SEQ ID NO: 110300 - protein, 43 aa, Glycine max
  Coding DNA Sequence Number=SeqID_18615
MGPLESTAGAKRFRNVFREEFRKGFNRSSTFFIRSSSFFDLQR

SEQ ID NO: 110301 - protein, 94 aa, Glycine max
  Coding DNA Sequence Number=SeqID_18616
  Homolog annotation: Hit_ID=A6FJQ2; Match level="QueryCoverage=40%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARAATILRKPQMGTELEFVIMVIAVSCVKLLSAHNSTQHTSRKHKV

SEQ ID NO: 110302 - protein, 99 aa, Glycine max
  Coding DNA Sequence Number=SeqID_18617
MVHFGTFLSRLVHLGPLDDLGGKQPTRLGEQVAFGAWEAKEKGFSTLGKHISLKISEKKEKEQENQGRGASVMLLRCFRDQFHKRSSSFFVCSSSLIVL

SEQ ID NO: 110303 - protein, 72 aa, Glycine max
  Coding DNA Sequence Number=SeqID_18618
MYVWKWLRESFPQRDLRRTPWLKGPVLLPSLTAIVLGALSTSSVSRPSKDGHSTERDASSSGTMSTQISRKR

SEQ ID NO: 110304 - protein, 104 aa, Glycine max
  Coding DNA Sequence Number=SeqID_18619
MAKFDPDIVLEFYANAWVRGQWIPFDADALGQFLGYPLVLEEGQECEYGQRRNQADGFDEEAIAQLLCIPGQDFSWTATRRRVWRRLGTLWTRISPTGPWDFPH

SEQ ID NO: 110305 - protein, 399 aa, Glycine max
  Coding DNA Sequence Number=SeqID_18620
  Pfam annotation: Domain name=MAP7; Domain location=4-168; Score= -83.3; E_value=0.087; Accession=PF05672.2; Description=MAP7 (E-MAP -115) family
  Pfam annotation: Domain name=zf-CCHC; Domain location=201-218; Score =19.0; E_value=0.002; Accession=PF00098.14; Description=Zinc knuckle
  Pfam module annotation: Pfam domain module=MAP7::zf-CCHC; Domain location=4-168::201-218
MSLHSSSSVNGEGSTPKDPLYKILDELRSLKLWKEKQEIKEKGKKRVEQISQDEREKIREEERRKIMKEMKREKHASYSSHNSCKSLSEELRDYYEGRHRSHLRPHSHRRENERKPQEVNIKLPYFHVKDNEEAYLDWEIRVEQKLKRKPTLKSYGYHSYPKKDQGLGILEAAPSKPNDDKGKTIEKQPPKASMQEKTSSIKCFKCLGRGHITSQCSTKKTMIMRSQDIYSSQDEATTSPSSSESEESSEEIYPQEEGKPLMVKEECKEVSVSSKRLAKKERHFEIKTNIKEISPLKQPPHFLLCKKTLVRIATPLRLEFIPQVKELLDEGLVRKSLNPCALLVPKIGIIRHQIPKIGGMMNALGGATLICKITRAPNIFMICVHRDSLGIINMKIQKK

SEQ ID NO: 110306 - protein, 133 aa, Glycine max
  Coding DNA Sequence Number=SeqID_18621
  Pfam annotation: Domain name=G-patch; Domain location=2-43; Score =7.4; E_value=0.024; Accession=PF01585.14; Description=G-patch domain
MMVARVILGHDYEPEMGLGKNNDGMASLVDIKENHGKFGLGYKPTRIDVRRSIIERRNRGVGPQLKPQAREDPPCHIIKSFVSVGLRHEEQVAVIHDKAPQEHSDWVRPCLPDFQLGNWQVVEQPEVSMASTM

SEQ ID NO: 110307 - protein, 161 aa, Glycine max
  Coding DNA Sequence Number=SeqID_18622
  Homolog annotation: Hit_ID=A5C6V9; Match level="QueryCoverage=49%, HitCoverage=7%, E-value=4e-13, Identity=52%"; Hit description =Putative uncharacterized protein
DAGSRQARQGASAGVGGCRGWLNYAASEQIVLRVHHMRAIGAGLFAITPAGERGMCCKAIKLGNARVFPVTTLIPTGVLAEELPVPCMTVFDVSGNVLSGPIPQFSVGKCASVPSWSGNLFETDDRALPYKSFFASKILGGPILASLGEVGRSVLVPSSNS

SEQ ID NO: 110308 - protein, 75 aa, Glycine max
  Coding DNA Sequence Number=SeqID_18623
MIMRGQDIYSSQDEATLHLPLVKVKKQKGKNLTLASIATPLGFEFIPQVKKLLDEGLVRKSLNPCAFLVPKNRYY

SEQ ID NO: 110309 - protein, 107 aa, Glycine max
  Coding DNA Sequence Number=SeqID_18624
  Subcellular localization annotation: CTP_CleavageSite=88; ConfidenceScore=5.74e-01
MRRNSPASSSDTSFLPQPSLFSGRPFTGIFSFEVGIISSSCPSVIFAFPLTFTGCVGRSGGTNTRPLRVTPLSPVIVVTLADNELMPVASSFLSLGGAYLHGTMWLF

SEQ ID NO: 110310 - protein, 88 aa, Glycine max
  Coding DNA Sequence Number=SeqID_18625
STLEDPLDDTQQSKSKPPARWIVVKCNRQKGSTECGYYVMHWMLTIILGNFQNNWEMYFTDPRSLEPERLKALRNQWAKYYLKVKNET

SEQ ID NO: 110311 - protein, 156 aa, Glycine max
  Coding DNA Sequence Number=SeqID_18626
  Homolog annotation: Hit_ID=A5ANT6; Match level="QueryCoverage=62%, HitCoverage=22%, E-value=2e-15, Identity=38%"; Hit description =Putative uncharacterized protein
  Pfam annotation: Domain name=zf-CCHC; Domain location=52-69; Score =8.9; E_value=0.07; Accession=PF00098.14; Description=Zinc knuckle
MDSLITRLLRVPHLLKDENPTDGVETSAMVASRGRGSGRNSRGGRSGRGGRPHCTYCKRIGHTQETCYSLHGFPDKVAQVSKSEKAESRFSDEEYQEYLKLKSEKPSNQAQPSSVPCFSTACISQSIEGHSPWILDSGASDHISGTWDGATDWRRT

SEQ ID NO: 110312 - protein, 39 aa, Glycine max
  Coding DNA Sequence Number=SeqID_18627
MDIFEKLKWFLLVDGLSMVSMDKWINITDMEYVIASRYF

SEQ ID NO: 110313 - protein, 241 aa, Glycine max
  Coding DNA Sequence Number=SeqID_18628
  Gene Ontology: Mol. function=transporter activity; Cellular component= membrane; Biological process=sulfur metabolic process
  Homolog annotation: Hit_ID=Q1H105; Match level="QueryCoverage=98%, HitCoverage=65%, E-value=2e-96, Identity=68%"; Hit description =Sulfonate ABC transporter, periplasmic sulfonate-binding protein SsuA
  Pfam annotation: Domain name=NMT1; Domain location=1-146; Score= -83.4; E_value=0.022; Accession=PF09084.2; Description=NMT1THI5 like
LVAPWGRSGNSYLVVPANSTAKSIADLKGKRIALHRGRPWEIPFANLVQKNGLKLTDFKIVNVNPQVGAAALASGSVDAFYSLSDAYNLVDKGVGKIIWSTKNAPPDWKLMGGLWARNDFVKEHPELTQAIVTSFIKANHWAAQEAHKETYLKEYASLVQPESVVRRDYEDDSVSWRDRWSPLYDQALVDHYKRAASYARESGLIRNDINIQQLLNASFVDKALKELNLETFWAPSRIASQ

SEQ ID NO: 110314 - protein, 134 aa, Glycine max
  Coding DNA Sequence Number=SeqID_18629
  Homolog annotation: Hit_ID=A7UQU7; Match level="QueryCoverage=97%, HitCoverage=21%, E-value=7e-16, Identity=37%"; Hit description=IMP dehydrogenase/GMP reductase, putative
MTERYAWGVAALVHMYDQLNDASMSHNRQLGGYITLLQCWIYEYFPLVADSIADQEYDEDSLHACRWIVTKKTVKSIRTPAYRKRLDRLRIPDVFWIPYGEHREVRDFHVRSCYSALLRWGPVAVYYRPERVVR

SEQ ID NO: 110315 - protein, 184 aa, Glycine max
  Coding DNA Sequence Number=SeqID_18630
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
VGTGERTRELPGGNAGGRSLWKNASNAAFLRFLAFCWPFAHMFFPALSPDSVDNRITAFEKRKSAQYANRLSPRVGRFINAAGTTGFPTGKRAVSATQLIYDHDYEFELGTLSLDMISKFPTVWWAAGKRKGMQAWHWPSFYNVVTGKTLALPNLIALQHIPLSPAGVIAKRPAPIALPNSCAA

SEQ ID NO: 110316 - protein, 147 aa, Glycine max
  Coding DNA Sequence Number=SeqID_18631
  Homolog annotation: Hit_ID=Q9KHC4; Match level="QueryCoverage=34%, HitCoverage=10%, E-value=8e-08, Identity=58%"; Hit description=SocE
STLEDPPTATASNTAREAESMLQPAINLGRDRNTTVFDFTPRTAPDDLSQAPTFKGQLPPYADYPLQEDDEGEAHLGPLLPLKDPTPHELPQPNGRETCRASCINESANARGEAVCVLGALPLPRSLTRCARSFGCASGISSLKGGI

SEQ ID NO: 110317 - protein, 34 aa, Glycine max
  Coding DNA Sequence Number=SeqID_18632
MKGRRHKYVFNNNKREKPEKYLYSITHPLTTDYM

SEQ ID NO: 110318 - protein, 43 aa, Glycine max
  Coding DNA Sequence Number=SeqID_18633
MDSGSKSRGSGKIKQVNNTRELLTQFGATSPTSGGYQAREEIH

SEQ ID NO: 110319 - protein, 70 aa, Glycine max
  Coding DNA Sequence Number=SeqID_18634
MEADMEAMKEQMAAMMEAMMSVKKIMEANAVAIAATSVVAKGTRRPHPASSMNHPTSNMVGKDLGVRAAP

SEQ ID NO: 110320 - protein, 98 aa, Glycine max
  Coding DNA Sequence Number=SeqID_18635
MRPPLERATRPHLQWTTRPPLERATRPHLQRTICPPLERTTRPRLQRDTCPYLQRTTHPLFQRATRLHALAFRGLHVLAIRGLHTLTFRGLHALTGIL

SEQ ID NO: 110321 - protein, 48 aa, Glycine max
  Coding DNA Sequence Number=SeqID_18636
MRRLQSSFFHLHSAAIDLQKSKDSIDEEDPRPTSSTWSYIMWYQSIFV

SEQ ID NO: 110322 - protein, 107 aa, Glycine max
  Coding DNA Sequence Number=SeqID_18637
MTRGNPSDLQSFDSEIDRTFHRLVRHHFVPFQHPEHSVIGEFEHSMVGNFEHPDFEHYSFEHSDFEHSENMEQPPSRERTLREMAAPDFTYESLGIQYPNEDVPYVL

SEQ ID NO: 110323 - protein, 102 aa, Glycine max
  Coding DNA Sequence Number=SeqID_18638
  Subcellular localization annotation: CTP_CleavageSite=96; ConfidenceScore=5.21e-01
MTVKTSDTCSSGDGHSCLCVRRKYRIRRHSPFRLRNCWEGRSVRASSLLRQLAKGGCAARRLSWVTPGFSQSRRCKTTASAKLACLQVDSRGSPVVVEEKSQ

SEQ ID NO: 110324 - protein, 100 aa, Glycine max
  Coding DNA Sequence Number=SeqID_18639
DAGSRQARQGASAGVGGCRGWLNYAASEQIVLRVHHMRAIGAGLFAITPAGERGMCCKAIKLGNARVFPVTTLSTLEDPLMGQLQRQAFRKAYGKHLGPS

SEQ ID NO: 110325 - protein, 78 aa, Glycine max
  Coding DNA Sequence Number=SeqID_18640
VDVTYENWKATPTAQKDLIWVDIQASDSRTKKKLLQTVGKRWRQFKADLTRKWALAADQDSVDDIVCEKYDISKEKWA

SEQ ID NO: 110326 - protein, 72 aa, Glycine max
  Coding DNA Sequence Number=SeqID_18641
MEIFIQSIDPDAWNAIVKGPFIPTKEVNGEWYKSAKEIQKMLEVTHEGIVDVRRARKHTLVSEYKAFLMKNG

SEQ ID NO: 110327 - protein, 203 aa, Glycine max
  Coding DNA Sequence Number=SeqID_18642
  Homolog annotation: Hit_ID=A5BSR3; Match level="QueryCoverage=84%, HitCoverage=58%, E-value=9e-14, Identity=30%"; Hit description =Putative uncharacterized protein
  Subcellular localization annotation: CTP_CleavageSite=27; ConfidenceScore=5.75e-01
MGSPPASTPPPPSPPPPPSSDASASPSAVKRTCKALRLRSLSTRPLGAERPVVHVDPATGKADGPHKKKLRTNLGIVARDKVDITYENWKDVPTAQKDLIWEEIQQGKVGPVLPDSQRPFLGDYLEQKLLAEKTKKKLQEAAQSGSIDGVIDPPSPVRRHVKWKMARTKKTGEMTTEATKEIAEKIDSFEEQATQGSFVPHGR

SEQ ID NO: 110328 - protein, 293 aa, Glycine max
  Coding DNA Sequence Number=SeqID_18643
FAKARTPLAAKPVPFPYQNSHAVPWRYTPPREKEEEATDVSSLSAKVTNITGLSGVTRSGRVFAPPDLPVQPANVKGKGKVVEEQDGEAPHASNKDIPAKGPPEKKNGKKEVSLEEASEFLRIIQQSEFKVTPGEGPSNKPPFRQQVVWTLYRAKLCKYHGGVPGQFNRRGRAVNAVESRNRPYRSKPLRDVATPRRFIFEALQKGGVIPHSGCKEDSCLLHSGEMHDMETCLEVEELLQRMIDQGRLEVGIEGKEEQHICMQSTEGSGVVKPKPLVIYFTKSATSQKPGHPL

SEQ ID NO: 110329 - protein, 204 aa, Glycine max
  Coding DNA Sequence Number=SeqID_18644
  Subcellular localization annotation: CTP_CleavageSite=24; ConfidenceScore=5.15e-01
MAMTFSLQILGKLQKIFLILRLVVYSSYREFNSFTIVVNLVSISSMDSFSNSPILSYSGLLEAHDKKNFALEFRRTLAFSFEPFPPKPGDLLVEAPLGMNTVGTCPTTTSSRIFLSQYQGQQRLKRKLSCGVLDEILSDCVVSRASQLWRAKSSVGSSYGVLDMHAQLGSFNIEKCLARITLNMHETLGFSSPGDNIEYRNVVR

SEQ ID NO: 110330 - protein, 253 aa, Glycine max
  Coding DNA Sequence Number=SeqID_18645
MNIDASVFYELTQLSNQGVPFEGTIVDDWKFDFSSHDARRMVCTGQAEMTGRLLAGSLTLECHIMHYLIVRILLLHSSNLAQVSKEDLIVMWAFLTSRQIDWAHLVRKMHRRRLQMSVHLLLHDVILLCFSMNFSLSYEDSEHMLMTSWMGEIVEARLQEVFDDANSQAYPRPTQGDLDFKKDSSSWIIQVNIKQSKIFKTFLLPVFMIKGLRDYESLVVRHLSTKEGMSLCVSEGVKDYEIVELLSGFFGDW

SEQ ID NO: 110331 - protein, 104 aa, Glycine max
  Coding DNA Sequence Number=SeqID_18646
RHILPERKVEIYHIELDEFKAELERHNFHKRLSNLVDSSIDLALVKEFYANLYSSEGPSPKQVRVRGHLVNIDANSLNTFLETPMVLAEGHPGKILRKDLTTLA

SEQ ID NO: 110332 - protein, 164 aa, Glycine max
  Coding DNA Sequence Number=SeqID_18647
MVYAASGQHDLKVASEEMGQQTCGPTLSATKVYVRRKEVLRSNSKAQQFKKSIVDFNPASKTDPLPSLHEDSIELQCALLKEMGLTYGEDDNKAAGGLLCLWNNSIFEVNRREQGRSFLMLEGTCISNNQRMMIVNVYAPCDLVGKKALWDDLAGFAILLYLVG

SEQ ID NO: 110333 - protein, 92 aa, Glycine max
  Coding DNA Sequence Number=SeqID_18648
  Homolog annotation: Hit_ID=B0HC01; Match level="QueryCoverage=34%, HitCoverage=68%, E-value=4e-10, Identity=100%"; Hit description =Putative uncharacterized protein
MFFLRYPLILWITVLPPLSELIPLAAAERPSAASHWHDRFPDWKAGSERNAINIFQENDRSHPAQVVAAQIRTLLYKHEGCTGSVPSQRGIL

SEQ ID NO: 110334 - protein, 255 aa, Glycine max
  Coding DNA Sequence Number=SeqID_18649
  Gene Ontology: Cellular component=mitochondrion
  Homolog annotation: Hit_ID=O47882; Match level="QueryCoverage=76%, HitCoverage=58%, E-value=5e-74, Identity=69%"; Hit description =Putative uncharacterized protein orf1
MAAKTCIIPETNNKQNIMKRIGLSAVPEVLSKIEQNYDVFTITDKFRNLSLKDSSASSRQGEFLIKDLRAPDTLVGLRKLKDSLGLSLTKGSLNSNPLLKLKGISDSVSNSMESLASRVLVEVITFNEGYYGRFLILVQMGIGCTVWYGFVPGDGINMPIEGLNTLFSPIENYDTIFTNPDAHVIPGFNKMTLIEGVNNPAAPLSQAFAQDRPFMDMDIEIPDSNKSIIIGVSLGLAVAILFTFGINPCCGEVIV

SEQ ID NO: 110335 - protein, 117 aa, Glycine max
  Coding DNA Sequence Number=SeqID_18650
MVVILPKENLVVWFCSLHNRPDNYFKGIINSALKGLDDTPQPKSKAGARGIVVKCNRQKGSTECDYYVMHWMSTIILGTFRNNWETYFNDVRPLEAERLKALRIQWAQFYLKVRNQS

SEQ ID NO: 110336 - protein, 418 aa, Glycine max
  Coding DNA Sequence Number=SeqID_18651
  Gene Ontology: Mol. function=protein-N(PI)-phosphohistidine-sugar phosphotransferase activity; Cellular component=organelle inner membrane; Biological process=phosphoenolpyruvate-dependent sugar phosphotransferase system
  Homolog annotation: Hit_ID=Q2NUP1; Match level="QueryCoverage=95%, HitCoverage=58%, E-value=0.0, Identity=81%"; Hit description=PTS system N-acetylglucosamine-specific IIABC component
  Pfam annotation: Domain name=PTS_EIIB; Domain location=386-418; Score= 48.7; E_value=2e-11; Accession=PF00367.11; Description=phosphotransfer ase system, EIIB
  Pfam annotation: Domain name=PTS_EIIC; Domain location=11-289; Score =229.3; E_value=8.9e-66; Accession=PF02378.9; Description =Phosphotransferase system, EIIC
  Pfam module annotation: Pfam domain module=PTS_EIIB::PTS_EIIC; Domain location=386-418::11-289
MVPLGRRQCAGSTADQIGSAIIDNMSVLFAIGVAYGMSKDKDGAAALTGFVGFLVVTTLCSPAAVAMIQKMPVEQVPAAFGKINNQFVGILVGILSAEVYNRFSHVELPKALSFFSGRRLVPILVSFLMIVVAFILMYVWPIIFGGLVSFGEHIQKLGSVGAGVYAFFNLLLIPVGLHHALNSVFWFDVAGINDIPKFLGGAQSIANGTGIPGITGRYQAGFFPIMMFGLPGAALAIYHCSRPENRAKVGGIMLAAAFAAFFTGITEPLEFSFMFVAPVLYVIHAVLTGISVFIAASMHWIAGFGFSAGLVDMVLSTRNPLAVHWWMLIPQGLVFFVIYYVVFRFTIQKFNLLTPGRELAAGDETDGYDVNVDHSSNGESETESLARRYIGAVGGSDNLTNIDACITRLRLNVKDSAQ

SEQ ID NO: 110337 - protein, 71 aa, Glycine max
  Coding DNA Sequence Number=SeqID_18652
MENWRTALCNNLRGSRLEGGGHMNSARQLHSWVSEKSGEWRIGEQRYAITSRGSRLEGGGHMNSARQLHSW

SEQ ID NO: 110338 - protein, 27 aa, Glycine max
  Coding DNA Sequence Number=SeqID_18653
MHEYDAGMICPLGCHEEMQDTIKEYAR

SEQ ID NO: 110339 - protein, 71 aa, Glycine max
  Coding DNA Sequence Number=SeqID_18654
SFSPWFLVEPIIRLIKVILVASTQTYLPSPEVASTLDLSSFTGSGVYPDLSSFTGSGVIQKPPACIKRSAP

SEQ ID NO: 110340 - protein, 197 aa, Glycine max
  Coding DNA Sequence Number=SeqID_18655
MTLLLGNIQPSDHNSDLPLPKCQLVYAILTQMSIHVAQLIADAIYLFAGMAPTRHPLDLDKSNRALGFPALITGLCQSFGVPVAPSKRQAQGDAPQPADAPPPHQAGPAESFDTEQYLRHLVRQQAANHRAHLAEPAFYFFSVTYSGPVQGRVAWPGDWPEARAGEAPAEAPDEADEAREDEEMTDLLDFFGGSGAT

SEQ ID NO: 110341 - protein, 49 aa, Glycine max
  Coding DNA Sequence Number=SeqID_18656
MICKYLHQVLMQSYSARALDRRLQEDWAKDAREGLRVLMSLRVDFEPMD

SEQ ID NO: 110342 - protein, 217 aa, Glycine max
  Coding DNA Sequence Number=SeqID_18657
NTETFSSLTSYPELRRSEFLIGGYVGARASLLSTTPPFVAMTQELANVVICALSGDEQEPCFCRPPHKICHTDPESCDMRRQNLVIPHPFAIQTRSCPMARRDKIWSFCTLFIQGPMTAETKYLGFRTPLPFRHSRVRWHAETKFGHFAPMIRGDTLWLSAPLCHPEAAGPMTSRDQVWSFCTHDTRRYLMVIRTLLSSRGGGPDDKQRPSLVILHP

SEQ ID NO: 110343 - protein, 59 aa, Glycine max
  Coding DNA Sequence Number=SeqID_18658
MEKRQQRGLLRFLAFAGLLLTCSSCVIPDSVDNRITAFDWHDRFPDWKAGSERNAINVS

SEQ ID NO: 110344 - protein, 73 aa, Glycine max
  Coding DNA Sequence Number=SeqID_18659
MKEEQEKEKEKEEEKEEIEKKIRKMKKKNRRLMRRKRRARVRFQERKRERLLQLKARKYHIHWYLPRRIKSDT

SEQ ID NO: 110345 - protein, 242 aa, Glycine max
  Coding DNA Sequence Number=SeqID_18660
  Homolog annotation: Hit_ID=Q9X6D5; Match level="QueryCoverage=21%, HitCoverage=9%, E-value=3e-10, Identity=65%"; Hit description =Putative uncharacterized protein
MAPNPRTRAVDPHRAWMASPRAIHRKAAPQSGAARVGRDGGGDPARVQCPDEERGAPNAGTLMQRRLQPLRATAGPPTRQRWRLHGAAASTRCLRHEWFLEVGRRIGVDAAAAADHDHALAAGQADRAVLGVLEGAPGHGHAVDPGLQGGRDAEVVHRRADHHDVRGKELLEHLFSVGGFGRVRLGQRAAVKMRYWIGVKIAIIDLQAFDLLLEAGHHGGGQVAGDGVLAKHAGVEMPKAQA

SEQ ID NO: 110346 - protein, 76 aa, Glycine max
  Coding DNA Sequence Number=SeqID_18661
MDISFLHLSLIVATVATYPSAGGRRMTRGMRVPQKEYARSRHQRLFEENVGKTGKDAIYFFLSERLGSCIYARGRY

SEQ ID NO: 110347 - protein, 50 aa, Glycine max
  Coding DNA Sequence Number=SeqID_18662
MDKKITDRRMKSLRGKEIALVKVQWGTDEGDSTWELEDRMRELYPSLFIE

SEQ ID NO: 110348 - protein, 331 aa, Glycine max
  Coding DNA Sequence Number=SeqID_18663
  Gene Ontology: Mol. function=iron ion binding; Cellular component =integral to membrane; Biological process=response to stimulus
  Homolog annotation: Hit_ID=A1FRT3; Match level="QueryCoverage=89%, HitCoverage=95%, E-value=1e-121, Identity=74%"; Hit description =Putative FecR
  Pfam annotation: Domain name=FecR; Domain location=131-224; Score =131.1; E_value=3.1e-36; Accession=PF04773.4; Description=FecR protein
EQLALAEIGPPAGDQPADRARPSAARPCRIAAGAGRMSQETIAREAARWWLDAHDGDRDENAFEQWCRADPRHAAQYLHLQELWQAGAATPSLQRQQQRRQRRRLREAGIAVLLLCALGLYSRHASPPVAQVLRTAAGEIREETLPDGSHVLLSPGSEVKVRIDGQRRQLQLQRGQAWFQVAADADRPFQVHTPQGTVTALGTAFDLAVQGNSSVVTVTEHRVRVDSGNVSMLADDGEQLRFDGQATAHATTAAPGTLAWRERRLHWVSAPLADVTQGLDRWHGGHTWVVGEQLRQQPVTLLGSADGAASNRDQLATQLQVRVLRLGAGIQ

SEQ ID NO: 110349 - protein, 178 aa, Glycine max
  Coding DNA Sequence Number=SeqID_18664
WLTGKAHMTGIKGALYRRCLDALSVTDVCWMPYAGSSTVGLPLDSPSAAGELCVVPRQVAPDYMEWFFRISHPFVTWTEETVAPRHPPPPHHEEFIEPPIPEVSVATDLPTNSVVHCEGCQGMAQDLGAIAKDLERVINLRMVTEGIDLHDIMTRCLRRARGNAADESLRPRQRRRID

SEQ ID NO: 110350 - protein, 145 aa, Glycine max
  Coding DNA Sequence Number=SeqID_18665
MDLEGKGRGIYFWCRIYFGTNIYWLWKLLATPQGLGWWHSHSIETECCWLLLASSDSPKKVQNYVAHVVQDTSFVVQVEGTSTWVVVTENKRGYISCGLVLVEDTSTRLFKENKGGYIPCGSLLVKDFTSLKRNLKDRRLLGVWM

SEQ ID NO: 110351 - protein, 101 aa, Glycine max
  Coding DNA Sequence Number=SeqID_18666
MAIVATYPSVGGQRGGSRVRLPWEENAWSRHQCLFEENVEKIGKMWSTNFKRERFGSCFYAWGRREMLRQWTINDLLVLKGEKRLGVGPLTISWFLKGEIR

SEQ ID NO: 110352 - protein, 131 aa, Glycine max
  Coding DNA Sequence Number=SeqID_18667
  Subcellular localization annotation: CTP_CleavageSite=46; ConfidenceScore=5.09e-01
MKQLKRNGGGSPIIQLAKSSNSPGEVSVVTVRRKKDSGRWKLHTAVAEMKEEFPRYRTSLAIVCEYSQNQSQGIELNVQKDKGCAATKGPTPPEEEEKKKINSREQTPQAGFGVDSTNSFFQFCPLDVIIK

SEQ ID NO: 110353 - protein, 153 aa, Glycine max
  Coding DNA Sequence Number=SeqID_18668
MPPTRHPLDPDKSNRALGFSALITGLCQLFGVPVTPSKVIRPLITRAFIEKYCTPRQAQGGDPQAPDAPPPPPQADPAGSFDTEQYLRHLSQGFASFPCPTLDQFRAEVAWPGDWPEAQAGEALAGAPGDADEARMDEEMTYLLDFLGGSGAA

SEQ ID NO: 110354 - protein, 42 aa, Glycine max
  Coding DNA Sequence Number=SeqID_18669
MAGTFFLLKKQYSLEIMSGTPQMVVSEQKLDSSEPVMVLLCE

SEQ ID NO: 110355 - protein, 107 aa, Glycine max
  Coding DNA Sequence Number=SeqID_18670
MGCCSLHVSAPLGGLYSFRQQEFNPCTCRAPEGFQGPGPGKGICLGSDYISPHCWIYEHFPIVHTSVVHDAYDDGSPRACRWLTGKGSYDGDQGSSVSETFGCPECD

SEQ ID NO: 110356 - protein, 103 aa, Glycine max
  Coding DNA Sequence Number=SeqID_18671
MAPEDMEKTTFITLWGTFCYKTARPRFIMIAKPNLDQASSVDSSLQQLSPVLSRTLESDQFPLLNDPNKACIYVIKDLTITRKLISSSQNGFCFELSSLQIFT

SEQ ID NO: 110357 - protein, 39 aa, Glycine max
  Coding DNA Sequence Number=SeqID_18672
APKAVINRLTAIQRQFLWGGNREGKNIACVEAKLHGESK

SEQ ID NO: 110358 - protein, 172 aa, Glycine max
  Coding DNA Sequence Number=SeqID_18673
  Homolog annotation: Hit_ID=B0HC01; Match level="QueryCoverage=18%, HitCoverage=65%, E-value=1e-09, Identity=100%"; Hit description =Putative uncharacterized protein
MEKRQQRGLFTVLAFCWLFAHMFFLRYPLILWITVLPPLSELIPLAAAERPSAARNSYDHDYEFELGTRQSTIQDFLVQQDLDQTLEDERSTSINETEWTKIQKRVVSVIWLAVALEIKQNMWKEITQKALWEKLENIYTSKLLTNRLCLRGSSRVDLQACKLGTGRRFTTS

SEQ ID NO: 110359 - protein, 111 aa, Glycine max
  Coding DNA Sequence Number=SeqID_18674
  Homolog annotation: Hit_ID=Q51617; Match level="QueryCoverage=45%, HitCoverage=81%, E-value=1e-11, Identity=67%"; Hit description =Putative uncharacterized protein
  Subcellular localization annotation: CTP_CleavageSite=19; ConfidenceScore=5.46e-01
MTLTYKNRRITRPFVSRVSVMTVKTSDTCSSGRRSQLVCKRMPGADKPVRARQRMRKEKIPHQAPFAIQAAQLLGRAIGAGLFAITPAGERGMCCKAIKLGNARVFPVTTL

SEQ ID NO: 110360 - protein, 34 aa, Glycine max
  Coding DNA Sequence Number=SeqID_18675
VERRSPEFQESQDFRSNPFQGGGNYAILPPKGIG

SEQ ID NO: 110361 - protein, 184 aa, Glycine max
  Coding DNA Sequence Number=SeqID_18676
MATAARAVAAVRAGGLARTGGIRRLCDQRAACDERPVGDAGPGGGSVHRAVADHVIRRHLPAGDAHAAGSLAGALPGAGGPHGADQLPDAIVALRLDLQGVGAATVGQCFARGGGADRGGHLRGAVAAVGMVAAPPCLRPGRVVAARADHRRLARLAPRGGLVLCQAPPPAMAASMAPARRSVS

SEQ ID NO: 110362 - protein, 64 aa, Glycine max
  Coding DNA Sequence Number=SeqID_18677
  Homolog annotation: Hit_ID=UPI0000ECBAF8; Match level="QueryCoverage =64%, HitCoverage=48%, E-value=1e-16, Identity=100%"; Hit description= UPI0000ECBAF8 related cluster
MVMDEILSSVDGMQAWHWPSFYNVVTGKTLALPNLIALQHIPLSPAGVIAKRPAPIALPNSCAA

SEQ ID NO: 110363 - protein, 244 aa, Glycine max
  Coding DNA Sequence Number=SeqID_18678
  Subcellular localization annotation: CTP_CleavageSite=41; ConfidenceScore=5.25e-01
RPAAGRRASQQHGMDGGGTAGRLRTAAAARRRVRGADRRVRAAGLLGALRGRELQFAAADDLPLLGGVGGPRGLAADVGAGAGAVDRRGGAVLAAPAGTRAGARTGGDGRGQRRLPRLPDLHLQSVPAPEPGAAGRPRPQPAAAGPRADHSSADAVHRIRGLCRSVRIRGGGPAGGAHRCALAALDAAVDQRRLGLPDPGHRAGQLVGLLRAGLGRLVVLGPGGECQLHALAGRCGIDPFAGRH

SEQ ID NO: 110364 - protein, 180 aa, Glycine max
  Coding DNA Sequence Number=SeqID_18679
  Gene Ontology: Mol. function=helicase activity; Biological process =viral genome replication
  Homolog annotation: Hit_ID=Q2A9E0; Match level="QueryCoverage=82%, HitCoverage=10%, E-value=1e-26, Identity=46%"; Hit description =Putative uncharacterized protein
MTPYEDCQSPTNQPVINTEGYSDLGDQLIQCSQYSGIQSHIVSGLSHMLDQHNSHAKSFRMARDRLAGDQANNIKLQLIAARGKDGRVYNMPNVPEIAALIVGDFHPGSKRDIIVETQNGELQRIHELHASYPPLQYSLLFPYGEDEYRADILHRSTSSSKKRKRNRLTMREWFAYRLQS

SEQ ID NO: 110365 - protein, 94 aa, Glycine max
  Coding DNA Sequence Number=SeqID_18680
MYRLSELGIEIHSVLTRRSQWSSQPSSSPQLSSKETFILKSEAKTISEINNLGEDGDLDLNVSPKALDKLLGHLLAFKSKSNRSIKFCCFEMFN

SEQ ID NO: 110366 - protein, 219 aa, Glycine max
  Coding DNA Sequence Number=SeqID_18681
  Homolog annotation: Hit_ID=UPI00006A2D9E; Match level="QueryCoverage =99%, HitCoverage=85%, E-value=6e-17, Identity=16%"; Hit description =UPI00006A2D9E related cluster
GLHALTFRGQHALTFRGQHALTIKVLHALAFRGLHALSFRGLHVLILRVLHALTFRGLHFPGFRGLHVLAFRGLHVLAFRGLHALTFRGLHVLAFRVLQVLAFRGLHAFTFRGQHALNFNGPHALAFRGLHALTFRGLQVLAFGGLHGLTFRGLHALTLKGLQVLAFGGVHTLSFRGLHAFAFRGLHVLIFRSLTVLTLRGQHALTLKGLHALAFRGLH

SEQ ID NO: 110367 - protein, 122 aa, Glycine max
  Coding DNA Sequence Number=SeqID_18682
MVEFSPTRGIYGRCLIMIRLDYHEESGFSISGNTIAHISIVKWRISFKHQAPTRKTNVSPSCPHTSLLTVYPCSVEFKKNLFHDKMMQSYPARALDRRLQEDWDRDVREGPRVLMSLRVDII

SEQ ID NO: 110368 - protein, 184 aa, Glycine max
  Coding DNA Sequence Number=SeqID_18683
  Gene Ontology: Mol. function=ADP-glyceromanno-heptose 6-epimerase activity; Biological process=carbohydrate metabolic process
  Homolog annotation: Hit_ID=A1AHF5; Match level="QueryCoverage=100%, HitCoverage=59%, E-value=1e-100, Identity=96%"; Hit description=ADP -L-glycero-D-manno-heptose-6-epimerase
  Pfam annotation: Domain name=Epimerase; Domain location=1-110; Score=- 54.6; E_value=0.0042; Accession=PF01370.12; Description=NAD dependent epimerasedehydratase family
FIESREYEQPLNVYGYSKFLFDEYVRQILPEANSQIVGFRYFNVYGPREGHKGSMASVAFHLNTQLNNGESPKLFEGSDGFKRDFVYVGDVAAVNLWFWENGVSGIFNLGTGRAESFQAVADATLAYHKKGSIEYIPFPDKLKGRYQAFTQADLTNLRKAGYDKPFKTVAEGVTEYMAWLNRDA

SEQ ID NO: 110369 - protein, 32 aa, Glycine max
  Coding DNA Sequence Number=SeqID_18684
MFQNMFGMGNQTENYTSDEQSRRIKELMKHWA

SEQ ID NO: 110370 - protein, 128 aa, Glycine max
  Coding DNA Sequence Number=SeqID_18685
  Gene Ontology: Mol. function=ATP-dependent helicase activity; Cellular component=cytoplasm; Biological process=regulation of translation
  Homolog annotation: Hit_ID=A7QIS9; Match level="QueryCoverage=60%, HitCoverage=16%, E-value=4e-37, Identity=98%"; Hit description =Chromosome chr2 scaffold_105, whole genome shotgun sequence
MRKEKIPHQAPFAIQAAQLLGRAIGAGLFAITPAGERGMCCKAIKLGNARDVTATKGNEFEDYFLKRELLMGIYEKGFERPSPIQEESIPIALTGSDILARAKNGTGKTAAFCIPALEKIDQDNNVIQ

SEQ ID NO: 110371 - protein, 250 aa, Glycine max
  Coding DNA Sequence Number=SeqID_18686
  Gene Ontology: Cellular component=plasma membrane
  Homolog annotation: Hit_ID=A8XZZ5; Match level="QueryCoverage=71%, HitCoverage=59%, E-value=5e-15, Identity=21%"; Hit description =Putative uncharacterized protein
  Subcellular localization annotation: CTP_CleavageSite=45; ConfidenceScore=5.39e-01
FPTSNIQSCGFGMTDPLDESISCFLIRVNPWRTTRPRLQRTTRPRLQMTSRPHLRRTTRPRLERATRPRHQWAARPNLQRVAHPRLQRVTSPHLQRTSRPRLHRATCPHLQRTARPHLQRTTRPHLRRTTRPHLKRVAHPRLQRVTSPHLQRASRPRLHRATCPHHQRTARPHLRRTTRPHLWRTTRPRLERATRPRHQRAARPNLQRVAHPCLQRVTSPNFRGLHVLTFRGPHVLKLQRTTRPHLQSAT

SEQ ID NO: 110372 - protein, 159 aa, Glycine max
  Coding DNA Sequence Number=SeqID_18687
MYEYLEEERVPDLESILADFMTYQESCWQPDYDDKAEGVINLDDLLMQFKDTVESMQQAFRRTVTQISKLVDDMANTVAKEEEERIEIETNQESIFQVTTIHHQMTTEEETSVISSTPEYSCSAAAGYVRGTEKGRLELIVEDQKVSFDLFEAMKHSDM

SEQ ID NO: 110373 - protein, 302 aa, Glycine max
  Coding DNA Sequence Number=SeqID_18688
LPTDYREIEAALCIPGRGFLLNAEGHPGRILRKYLTMLAQVWSVLSYSNLAPTSHTSDLIMDRARLIFGLVSRMDMNIGALIFCQMTSIAQSNTSRLGFPALITALCRARRVVSDSLTFECLSPVINLAYIRKNWARKERTRPAELPSISAAPTPASTSAAPSVPAQVVAPPGSIPSIEQFLERVAWPGAQPSLHREDEGPTAQDESSEATILKPFMVEEEEGETQVRQEATASPERSREVASDPPTPVVDLSSPQHAADPSTPILEIPEDPTTPVLTLNTSPPATPVLHLTDEEDVQTQDT

SEQ ID NO: 110374 - protein, 83 aa, Glycine max
  Coding DNA Sequence Number=SeqID_18689
  Homolog annotation: Hit_ID=A5BTR2; Match level="QueryCoverage=96%, HitCoverage=4%, E-value=1e-15, Identity=55%"; Hit description =Putative uncharacterized protein
  Pfam annotation: Domain name=zf-CCHC; Domain location=51-68; Score =14.8; E_value=0.0088; Accession=PF00098.14; Description=Zinc knuckle
MCVQEDERLVMEMGESALLTTTCRKNKATTSQANQKGNGKIPPQLDIKKVEKCFFCKKMGDVKKNCPKLQTCLEKKERTLGIL

SEQ ID NO: 110375 - protein, 129 aa, Glycine max
  Coding DNA Sequence Number=SeqID_18690
MSDGFCGTHLQIMVRTKGLGRALGQVTGRGVGKGDRDDSDDAPQRRRPTTSARRQRVAVTADHVDESVIPAPDVQDDPMEAPAAVEDIPADTGAEAAEDEHEGFSGDPSDPSVLTLYADHVAYSVWTGE

SEQ ID NO: 110376 - protein, 106 aa, Glycine max
  Coding DNA Sequence Number=SeqID_18691
  Gene Ontology: Mol. function=transferase activity, transferring glycosyl groups; Cellular component=extracellular region; Biological process=carbohydrate biosynthetic process
  Homolog annotation: Hit_ID=Q1WU29; Match level="QueryCoverage=94%, HitCoverage=31%, E-value=1e-28, Identity=62%"; Hit description =Glycosyltransferase
PVYNVENYLAKCLDSLVNQSLQEIEIIVVDDGSSDNSGLIAQEYGQRFPERLKVWKKENGGLSDARNFAIDRATGDYIGFVDSDDYVGKTMFEEMFNLAEKHNAEM

SEQ ID NO: 110377 - protein, 246 aa, Glycine max
  Coding DNA Sequence Number=SeqID_18692
  Homolog annotation: Hit_ID=A6FJQ2; Match level="QueryCoverage=15%, HitCoverage=84%, E-value=8e-11, Identity=92%"; Hit description=50S ribosomal protein L5
MTVKTSDTCSSGDGHSLSVSGCREQTSPSGRVSGCWRMRKEKIPHQAPFAIQAAQLLGRAIGAGLFAITPAGERGMCCKAIKLGNARVFPVDSRGSPIECRGSRIFQYRKTSNIVRLEPGQSCCIGFHPVNQDQGVFLSGTKGPHTADKERGIIISGLATSLIGNQSSYPTGQHGRQATTVTSSRFELDEGTELEFVIMAVCVLGALPLPRSLTRCARSFGCGERYQLTQGGNTVIHRIRGYAERT

SEQ ID NO: 110378 - protein, 168 aa, Glycine max
  Coding DNA Sequence Number=SeqID_18693
  Gene Ontology: Mol. function=protein binding; Cellular component =nucleus; Biological process=regulation of transcription
  Homolog annotation: Hit_ID=A7QAL9; Match level="QueryCoverage=54%, HitCoverage=7%, E-value=2e-42, Identity=92%"; Hit description =Chromosome chr5 scaffold_72, whole genome shotgun sequence
ALSRDSVDNVLPPLSELIPLAQPNDRAQRVSERGSGRAPQYANRLSPRVGRFINAAGTTGFPTGKRAVSATQLIATESGERCYKTLSSVAEKNHSFDSAMRLILKFQEVSPWTTFGHVASNGAILEALEGEPKLHIIDLSNTLCTQWPTLLEALATRNDETPHLKGIL

SEQ ID NO: 110379 - protein, 119 aa, Glycine max
  Coding DNA Sequence Number=SeqID_18694
  Gene Ontology: Mol. function=phosphoprotein phosphatase activity
  Homolog annotation: Hit_ID=A5AWR0; Match level="QueryCoverage=86%, HitCoverage=10%, E-value=2e-18, Identity=41%"; Hit description =Putative uncharacterized protein
  Pfam annotation: Domain name=DUF1723; Domain location=81-119; Score =46.2; E_value=1.2e-10; Accession=PF08330.1; Description=Protein of unknown function (DUF1723)
MASSSSSSSHINIKSGPMDADVLWMQPKHVSEHVWNGEQDRKLHIRQVVPTYQGEEQIPEQIFPFLQQSGFGWIIKMGYLKLNASLISALIERWRPETHTFHMRCGECTITLHDVSVLS

SEQ ID NO: 110380 - protein, 248 aa, Glycine max
  Coding DNA Sequence Number=SeqID_18695
  Subcellular localization annotation: CTP_CleavageSite=29; ConfidenceScore=5.26e-01
MSLISSWGIRWSWRRGNATSSVRGGARPRGSMRRPSLNNILPSDHNSDLPLSKCQLVYAILTQMSVYVAQLISDAIYQFARIMPPRHPMDPEKSNRALGFPTLIMGLCQFYGVSVTPTKPIWPPINRVRHSSNRRRTGSSQPQMHRHRLYGSHHLWSPSLLTCEGWSSRCMHICSMWPTNSFYRYTLHQQSQDPNPFPWPTPEQFGATIAWPRDRPDFQTGAGPVGTLGDEGGAQDDDDMADVMDYFL

SEQ ID NO: 110381 - protein, 94 aa, Glycine max
  Coding DNA Sequence Number=SeqID_18696
MKNLKIMLKPNTAEAPQHCPLQPLHFLVGRLPPIKEKREKLDLIKERLRVVEGFGDFSFVDMAELCLVPDVVIPRISRCQISISARGLLAPRTT

SEQ ID NO: 110382 - protein, 82 aa, Glycine max
  Coding DNA Sequence Number=SeqID_18697
MLWLASLNVDYWLEVVFRQVSGKGRRVVFKLKDLSQQLLSCTLWDDYCLQFLKFLDDYEGDGPITVLLSHCRIKEAQDISSS

SEQ ID NO: 110383 - protein, 71 aa, Glycine max
  Coding DNA Sequence Number=SeqID_18698
  Gene Ontology: Mol. function=nucleic acid binding
  Homolog annotation: Hit_ID=A1D2M2; Match level="QueryCoverage=100%, HitCoverage=18%, E-value=2e-30, Identity=84%"; Hit description =Putative uncharacterized protein
MGSCFGVWSWAWDVGETPYAPPELEDDPTLPIIGYYPALIILTAVMSWVWVVVAWVGMKYFKHANISGDDT

SEQ ID NO: 110384 - protein, 92 aa, Glycine max
  Coding DNA Sequence Number=SeqID_18699
MLSVTRESRKAQCRNLPFCGRARRGSRVRFPKEEKCAETPPAFICGKHRKNRRKPVIKNIPDSGVVFTFEEGRQKRGSCSYVPSIEEEIRPT

SEQ ID NO: 110385 - protein, 109 aa, Glycine max
  Coding DNA Sequence Number=SeqID_18700
  Homolog annotation: Hit_ID=A6FJQ2; Match level="QueryCoverage=34%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVGDVLVMKLGQYDWNPSKGVPSSNS

SEQ ID NO: 110386 - protein, 135 aa, Glycine max
  Coding DNA Sequence Number=SeqID_18701
MSEIEEVQEQMKADLEAMKEQMTAMMEAMMSMRRMMEVNMAIVVAASTATKVDLTHPFGLNQVNRPVSDMVGQGGEALGSMGGLHFVQVQSKHSFPPYGLPPNYTPPNVTHALNENVDTLFPYPLRANIPTLVMH

SEQ ID NO: 110387 - protein, 163 aa, Glycine max
  Coding DNA Sequence Number=SeqID_18702
  Gene Ontology: Mol. function=endonuclease activity
  Homolog annotation: Hit_ID=A2Q186; Match level="QueryCoverage=78%, HitCoverage=33%, E-value=3e-12, Identity=26%"; Hit description =Reverse transcriptase-beet retrotransposon, putative
MVSCGHTAGGLLCVRNNNNFQVDIKIAERGFIMLEGVWLVESQRVVVANIYASCELESKRQLWQRLYLMKNQSQVQCWCLVGDFNCIKHPAERMGSTLCNADTNLIAEFNEWLAEMEVDDIPCLGKPFTWVRPNGSCGEGLLGSSRVDLQACKLGTGRRFYTS

SEQ ID NO: 110388 - protein, 171 aa, Glycine max
  Coding DNA Sequence Number=SeqID_18703
MAQPPPRERTLREMVAPDFTYESLCIQYPDEDVPYVLKTGLIHLLPKFHGLAEGVAKDWLYYLAPWSFANHHTDLCPSMQQPRAIEQPEAYAENIYNRPPQPQQQNQPQQNNYDLSSNRYNPGWRNHPNLRWSSPQQQQQQPTPSFQNAAGPSRPYIPPPIPQQQQPQKQP

SEQ ID NO: 110389 - protein, 103 aa, Glycine max
  Coding DNA Sequence Number=SeqID_18704
MVICPFCRRLSVFRLRLLQSPVAIQRQSSLMARRDKYGHLPLLSKTQYLSTETIAVSICYSETIEFDNMQRQIWSSTPFVEDLMSFDRDYCSLSLPSRDKQVR

SEQ ID NO: 110390 - protein, 235 aa, Glycine max
  Coding DNA Sequence Number=SeqID_18705
MTRRDQYGHLLPLSKTQCLTTETTLVSLRHLETASLMTRRDQYGHLLPLSKTGRLSTETTLVSPFLHPETIKFDGTQRHFMIIRTFVIQRQSSPIARRDNSWSFTTFDIQRLASTLTRKDQYGQMHPFVEDSTSIDRDYFSLTSSSRDNQVRWHAETNHGHPHPFPHPETIKSDGTWRHFMVICTFGIQRQSSPITHGDNSWSFATFVIQRQASLLTCSSIWSSTPFRRRFNVYR

SEQ ID NO: 110391 - protein, 89 aa, Glycine max
  Coding DNA Sequence Number=SeqID_18706
MFLVFNSALKGLDDTPQPKSKAAARWIVVKCNRQKGSTECGYYVMHWMSIIILGSFRNNWETYFNDVRPLEAERLKALRIQWAQYYLKV

SEQ ID NO: 110392 - protein, 210 aa, Glycine max
  Coding DNA Sequence Number=SeqID_18707
  Homolog annotation: Hit_ID=UPI0000ECBAF8; Match level="QueryCoverage =19%, HitCoverage=48%, E-value=3e-16, Identity=100%"; Hit description= UPI0000ECBAF8 related cluster
QLGANDYTELRYYSVSYEKAPRFPKGERRTGSEQESARGSFQGETPGIFIVLSGFATSDLSVDFCDARQGGGAYGKTPATRPFYGSWPFAGLLLTCSFLRYPLILWITVLPPLSELIPLAAAERPSAATDNNFTQETAMTMITNSSSVPCFCYDHVAGMQAWHWPSFYNVVTGKTLALPNLIALQHIPLSPAGVIAKRPAPIALPNSCAA

SEQ ID NO: 110393 - protein, 53 aa, Glycine max
  Coding DNA Sequence Number=SeqID_18708
MKNGGKSSRNRPRKRYGREKREVVAAQLAQASWVASTKRHQLLLEDPGRPKWS

SEQ ID NO: 110394 - protein, 165 aa, Glycine max
  Coding DNA Sequence Number=SeqID_18709
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=40%, HitCoverage=65%, E-value=3e-33, Identity=100%"; Hit description=LacZ protein
MFFRALSLILWITVLPPLSELIPLAAAERPSAARNSYDHDYEFELGTLAVAKGDEARVDGGIGFVCELLGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 110395 - protein, 244 aa, Glycine max
  Coding DNA Sequence Number=SeqID_18710
  Homolog annotation: Hit_ID=Q6WAY6; Match level="QueryCoverage=79%, HitCoverage=34%, E-value=5e-10, Identity=26%"; Hit description =Putative uncharacterized protein
KEGRIKILSSCEGCPNVPLMGTRGCINYNPVLAIRQLGYPMRGAPLDESITPFTARGFSDHNARDRELRGSSNGIIGGYHKWLRVRTQGLDWLPNLKTVRDDEVKASEESDEVQALKAELERVRVVEEKFKSIAIKVSNSKLQALEELSETEGNMWAVIDECKEKLNLAATHEQRLEDEYAKISAESEARERVIDSWHQEATMWTDRFALTLNRSQELPRLLAKAKAMADTYSAPKKIHGLLSY

SEQ ID NO: 110396 - protein, 84 aa, Glycine max
  Coding DNA Sequence Number=SeqID_18711
MIMRGQDIYSSQDEATISPSSSESEEAKGEESSEEIYPREKGQPLVAKEKCKETHASIATPLGLEFIPQVRKFLDEGLVSKSLK

SEQ ID NO: 110397 - protein, 259 aa, Glycine max
  Coding DNA Sequence Number=SeqID_18712
  Homolog annotation: Hit_ID=Q2HW90; Match level="QueryCoverage=90%, HitCoverage=61%, E-value=3e-26, Identity=29%"; Hit description =Putative uncharacterized protein
MGTNQNSKRFYQVKVKSLDVTSLKELGRLMGPLQKQAFRKVYGKILDLTVAEVFTEAVVSLAQYYDQPLRCFTFGDFQMLPTFEEFEEILGCPLGGRKPYLFFGFLPSLSKIAAVVGDSAREDMASQEKWGPFADILALLIFGVVLFPNVDSLVDLAAIDAFLAYHHSKESPVVAILADLFDTFDRSAINWFPRWKEGKEGVLFSCGNYPNVPLIGTRSCINYNPALAIRQLGYPMREAPTEGSLSPFLVKDLDAQGLK

SEQ ID NO: 110398 - protein, 57 aa, Glycine max
  Coding DNA Sequence Number=SeqID_18713
MGSSLAMGYSFRFDVCVCCEGGVKGDEGWFCWSKEVVVVVVDMRVVEIMVVVEEYGQ

SEQ ID NO: 110399 - protein, 65 aa, Glycine max
  Coding DNA Sequence Number=SeqID_18714
MSRASSSSAFVLPRNTQDLEFLSLLVPSLLDKAPSLGPYGRLSSPTPGEVPHLRRLHSPSDPFFA

SEQ ID NO: 110400 - protein, 37 aa, Glycine max
  Coding DNA Sequence Number=SeqID_18715
MASYGDLKKQRNPLMKKIQGLQAPHEATSCGIKSIFI

SEQ ID NO: 110401 - protein, 88 aa, Glycine max
  Coding DNA Sequence Number=SeqID_18716
FVDDVMRDLYEEGFMPNYYWWTNHSEELPQFPPIVFQGSYYESGGQRKELNPYEQMIIDHVGPSIGQYIEQECVIETKCMEENPNPEA

SEQ ID NO: 110402 - protein, 199 aa, Glycine max
  Coding DNA Sequence Number=SeqID_18717
  Gene Ontology: Mol. function=tRNA (uracil-5-)-methyltransferase activity; Biological process=tRNA modification
  Homolog annotation: Hit_ID=A8GL74; Match level="QueryCoverage=96%, HitCoverage=52%, E-value=1e-100, Identity=95%"; Hit description=tRNA (uracil-5-)-methyltransferase (EC 2.1.1.35) (tRNA(M-5-U54)- methyltransferase)
  Pfam annotation: Domain name=tRNA_U5-meth_tr; Domain location=1-199; Score=286.6; E_value=4.8e-83; Accession=PF05958.2; Description=tRNA (Uracil-5-)-methyltransferase
MTFGTAREQLRDDLRAQGFDLQLIGRASKTKIMLDQDYVDEVLPVAGRDMIYRQVENSFTQPNAAMNVQMLEWALAVTAGSKGDLLELYCGNGNFSLALARNFERVLATEIAKPSVAAAQYNIAANHIDNVQIIRMAAEDFTQAMNGVREFNRLKGIDLSGYNCETIFVDPPRSGLDEETVKMVQAYPRILYISCNPET

SEQ ID NO: 110403 - protein, 45 aa, Glycine max
  Coding DNA Sequence Number=SeqID_18718
MEMQWKTKEKRKGPVTRTISKRLQEDWARAAEEGPRVLMNLRVDF

SEQ ID NO: 110404 - protein, 217 aa, Glycine max
  Coding DNA Sequence Number=SeqID_18719
  Homolog annotation: Hit_ID=Q6WAY6; Match level="QueryCoverage=98%, HitCoverage=34%, E-value=5e-21, Identity=32%"; Hit description =Putative uncharacterized protein
MARIAKVVKILVQELDRVKQNRNGVVRILRKHLEEKAKTLEDQGEWASFFDVLELLVFGVFLFPNVDGLVDLVAIDAFLAYHHSKESMVIAVLADAYDTFDRRCEKSGARIVCCMPALYVWLVSHLFRHESRPVCPLQGHCVCAERGKANWEQLLASMVGASINWFPRWKEGRAGVLSSCEGFSNVPLMGTRGCINYNPVLAIRQLGYPMRGAPSEE

SEQ ID NO: 110405 - protein, 179 aa, Glycine max
  Coding DNA Sequence Number=SeqID_18720
  Subcellular localization annotation: CTP_CleavageSite=41; ConfidenceScore=5.41e-01
MVESYKKRKGSSSTTAAAGHRRQGTSRDTTAPIPPSISSPRSSTLFSSDDQRQRYYSQFCNRVILDPKYLDLEFFDGETFDCYQVFQNSALTDFMSLELPYFPELVKVFYNNLKIQDGIIYSEVHNIPIIIDQSLFFSLTKLPNQVVPFEGTLVDDWKFDYSSHDARRMVCNDQADMTD

SEQ ID NO: 110406 - protein, 167 aa, Glycine max
  Coding DNA Sequence Number=SeqID_18721
VTASAERRYQILSSSVAVVRPPLQELCSTPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATGIL

SEQ ID NO: 110407 - protein, 284 aa, Glycine max
  Coding DNA Sequence Number=SeqID_18722
  Gene Ontology: Mol. function=aspartic-type endopeptidase activity; Biological process=proteolysis
  Homolog annotation: Hit_ID=Q0ZCD6; Match level="QueryCoverage=89%, HitCoverage=37%, E-value=3e-18, Identity=28%"; Hit description =Integrase
MERSMIDAPSGGALGDMTPVEARNLIEKMASNSQQFSARNDGIVLRGVHEQSGVNEQPEAYAANIYNRPPQQQNQQQQNNYDLSSNTYNPAWRNHPNLRWTSPPQQQQHVPSFQNAIGPSKLYVPPPIQQQQSQQRQQATEAPPQPSIEELMNQAQSQNSKKLPSQTVQNPKNVSAISLRYGNQIQVPPPVSAPATEPVKLHSTPEKEDEIVAQKGKLPNKNFHAGGPSSSNSDLSKVEGNIPLLDAIKQIPRYAKFLKELCTHKRKLKGNERISMGKNVSVLI

SEQ ID NO: 110408 - protein, 117 aa, Glycine max
  Coding DNA Sequence Number=SeqID_18723
  Gene Ontology: Mol. function=calcium ion binding; Cellular component =spindle pole; Biological process=regulation of light-activated channel activity
  Homolog annotation: Hit_ID=P27164; Match level="QueryCoverage=72%, HitCoverage=46%, E-value=1e-40, Identity=96%"; Hit description =Calmodulin-related protein
  Pfam annotation: Domain name=efhand; Domain location=42-70; Score =39.0; E_value=1.8e-08; Accession=PF00036.23; Description=EF hand
  Pfam annotation: Domain name=efhand; Domain location=79-107; Score =40.0; E_value=8.8e-09; Accession=PF00036.23; Description=EF hand
  Pfam module annotation: Pfam domain module=efhand::efhand; Domain location=42-70::79-107
MDFILSGFLTFVTFCGYFCCCITTKELGTVMRSLGQNPTEAELQDMINEVDADGNGTIDFPEFLNLMARKMKDADSEEELKEAFRVFDRDQNGFISAAELRHVMSKSWGEADGRGGG

SEQ ID NO: 110409 - protein, 99 aa, Glycine max
  Coding DNA Sequence Number=SeqID_18724
MEFGDGTCIVLRDKRNLCNKGDRGWKRSALNAAATMLSTSFNVNVTSDNVKNCIKLWRLWYGIVSDILDQSGFDWDGTKHTITIENENAWNQYCTVIIL

SEQ ID NO: 110410 - protein, 51 aa, Glycine max
  Coding DNA Sequence Number=SeqID_18725
MDTCLRVIGDPMNGVQWVTTKLGGGHNPLFEDSPSECGCGTATVRYGLISK

SEQ ID NO: 110411 - protein, 117 aa, Glycine max
  Coding DNA Sequence Number=SeqID_18726
  Subcellular localization annotation: CTP_CleavageSite=40; ConfidenceScore=5.06e-01
MVWKADPSGFYSTKSAYSLLMTFNRPVPQRRILQTIEACNAHKKFSIETKWGTMMGSYPFSEEQPIPVGWEEILIEVAAEILADPSFSRQETSLSMLCSIRENEKLITSYYLGSEYN

SEQ ID NO: 110412 - protein, 88 aa, Glycine max
  Coding DNA Sequence Number=SeqID_18727
  Homolog annotation: Hit_ID=UPI0000ECBAF8; Match level="QueryCoverage =46%, HitCoverage=48%, E-value=1e-16, Identity=100%"; Hit description= UPI0000ECBAF8 related cluster
  Subcellular localization annotation: CTP_CleavageSite=32; ConfidenceScore=5.21e-01
MAGWFLVMPSQPMNAIKQLKRIGQKLNNFAFGASTGMQAWHWPSFYNVVTGKTLALPNLIALQHIPLSPAGVIAKRPAPIALPNSCAA

SEQ ID NO: 110413 - protein, 137 aa, Glycine max
  Coding DNA Sequence Number=SeqID_18728
MVAGNRTLEKPREDWSEEERRLVQYNLKAKNIITSALGMDEYFKVSNCKSAKDMWDTLQEHKMELSQPTLLRASEARLTGASSKGGKCAESPPTFICGKRRKNRRKPVIKNIPDLGVVFTFEEGISTSHVCPKGQQP

SEQ ID NO: 110414 - protein, 119 aa, Glycine max
  Coding DNA Sequence Number=SeqID_18729
  Homolog annotation: Hit_ID=A4DID9; Match level="QueryCoverage=36%, HitCoverage=38%, E-value=7e-11, Identity=79%"; Hit description =Putative uncharacterized protein
HVWGLTPAQCRKVKEVGDLMTGEPTTEAPVNGGRNYNGPKGKEGLLLGGPEPSVRYHSGRARILTLCQDLRAEGQSQAEGSLTARPTRRAGTKVGLSDPTVPSGRAVAQRIKVTLGITG

SEQ ID NO: 110415 - protein, 175 aa, Glycine max
  Coding DNA Sequence Number=SeqID_18730
MASMMDAMLGMRQLMEKNAATAAAVSSAVEEDPTLPAIAHHPIPNVVGQERSTLGHISNPHLGYNQVAYPYGLPPNYIPPVIRDDADHVPPPILEGEPLQQSDEVHEDRREHAVATCPFAGGRRVTRGKRVPRKEYARSRHQRLFEENVGKTGKDVIYELLSERLGSCIYARGRY

SEQ ID NO: 110416 - protein, 107 aa, Glycine max
  Coding DNA Sequence Number=SeqID_18731
MCMMRLSAFNEYGSGVIDIFIGNVCHIGWCIVGRPDGGIGFTLAIALVAATVTALAFIIFFMLIMASIIVVICSFMASMSAFLYSCTSSTSPITLVLARVRKGVEDA

SEQ ID NO: 110417 - protein, 219 aa, Glycine max
  Coding DNA Sequence Number=SeqID_18732
  Pfam annotation: Domain name=Transposase_23; Domain location=134-204; Score=0.7; E_value=0.00099; Accession=PF03017.5; Description =TNP1ENSPM transposase
SFEEQATQGSFVPHGRQGCLAATIGRLEHPGRVRAVGAGVTIKQYFGSAPRTSRSASSLPLDELQQLTQQIRDQLEESITEKVMRQVMASFNQLQSQMQSQGLAVPPEPLVGPSGPRVSTKGSCVDPSRNDPETGDSDKCGLYIEADPVRLVAMGRVYEGSTVVHDTPLLPGQVKMSVEEVTDADAPVHVPTDEVSLVGQTLHTFLASLTHLVKSLSQQ

SEQ ID NO: 110418 - protein, 111 aa, Glycine max
  Coding DNA Sequence Number=SeqID_18733
  Gene Ontology: Mol. function=helicase activity; Biological process =viral genome replication
  Homolog annotation: Hit_ID=Q2R1R7; Match level="QueryCoverage=99%, HitCoverage=6%, E-value=9e-22, Identity=49%"; Hit description=AT hook motif-containing protein, putative
MMFVFTFAGIKLDKSINETRGPPTIRIQGQPCHRIGSLLPMPGKQPKFAQLYIFDMQNEVENRINTTSQHAAIQPHIVSTLSQMMDDHNFHAKSFRMARDRLTDSQLDNVN

SEQ ID NO: 110419 - protein, 49 aa, Glycine max
  Coding DNA Sequence Number=SeqID_18734
MRKRTLPEGRKADSIRGAEPMEKRQQRGLFTVPGLLLAFCSHVLSCVIP

SEQ ID NO: 110420 - protein, 135 aa, Glycine max
  Coding DNA Sequence Number=SeqID_18735
  Homolog annotation: Hit_ID=A5AQM5; Match level="QueryCoverage=99%, HitCoverage=14%, E-value=9e-07, Identity=28%"; Hit description =Putative uncharacterized protein
  Pfam annotation: Domain name=zf-CCHC; Domain location=63-80; Score =28.5; E_value=2.5e-05; Accession=PF00098.14; Description=Zinc knuckle
GIALKALSLIQEESDKEGLIDLDEDDDLSLFVKRFNKFLRIRGNQRRPNFKPKRRTEDSSFAPKCYECNQPGHLRVDCPIIKKRMEKFEKKNFSEKKVKKAYITWDYNDMESFEDSENEEINLCLMAKSYESDEE

SEQ ID NO: 110421 - protein, 78 aa, Glycine max
  Coding DNA Sequence Number=SeqID_18736
  Homolog annotation: Hit_ID=A6FJQ2; Match level="QueryCoverage=48%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLVMDMEEDSEMPLILGRTFMNTTKILVNVYDDK

SEQ ID NO: 110422 - protein, 105 aa, Glycine max
  Coding DNA Sequence Number=SeqID_18737
MASSSSSSSSIQIKSDPIDGDVLWMESKHVSEHVWNEELDRKFAHPTSCPDLSRSRRNTRGNYSSASTIRMEARNPYISHEMQRECTITLQDVSVLLGLRVDGHH

SEQ ID NO: 110423 - protein, 598 aa, Glycine max
  Coding DNA Sequence Number=SeqID_18738
  Gene Ontology: Mol. function=secondary active sulfate transmembrane transporter activity; Cellular component=integral to membrane; Biological process=sulfate transport
  Homolog annotation: Hit_ID=A7YGH1; Match level="QueryCoverage=87%, HitCoverage=99%, E-value=1e-114, Identity=71%"; Hit description =Sulfate transporter
  Pfam annotation: Domain name=STAS; Domain location=439-572; Score =91.5; E_value=2.7e-24; Accession=PF01740.12; Description=STAS domain
  Pfam annotation: Domain name=Sulfate_transp; Domain location=182-389; Score=219.1; E_value=1e-62; Accession=PF00916.11; Description=Sulfate transporter family
  Pfam module annotation: Pfam domain module=STAS::Sulfate_transp; Domain location=439-572::182-389
METNNACTMHSHCIEMSMEVHQVVPPPHKSTLQKLKGRLKETFFPDDPLRQFKGQPLKRKLILGAQYVFPILQWGPKYNLKLFKSDLVSGLTIASLAIPQGISYAKLASLPPIVGLYSSFVPPLVYAVLGSSKDLAVGPVSIASLVMGSMLHQEVSPTTDPILFLQLAFTSTLFAGLFQALLGILRLGFIIDFLSKAILIGFMAGAAIIVSLQQLKSLLGITHFTNQMGLIPVMTSVFHNIHEEGIAVGRTFAALKNYKVDGNKEMMAIGFMNVVGSFTSCYVTTGAFSRSAVNNNAGAKTAVSNVVMSVTVMVTLLFLMPLFQYTPNVVLGAIIVTAVIGLIDLPAACNIWKIDKFDFVVMMTAFLGVLFISVQGGLALAGLSTKRFSSVGIWLSRDGNAIDQVGLSTLKILLQITRPKTVMLGKIPGTDIYRNLDQYKEAVRIPGFLILSIEAPINFANITYLNERTLRWIEEEEDNIKEQLSLRFLVLEMSAVSAVDTSGISLFKELKATLEKKGVEARKLNSDILLLYTSWYLVLVNPLAEVIEKLKKADEANDFIRADNLFLTVGEAVASLSSAMKGQSSTITEGAHTIVSHN

SEQ ID NO: 110424 - protein, 200 aa, Glycine max
  Coding DNA Sequence Number=SeqID_18739
MEATLSHGFETDDPVPIEPEVSYMCDTEAWITTFHQVVMPTLSVRPGLVKGLVPSQLTLHWGCRALWDIRIHLEGRLLFNSLNIKASQVGIRAGSAVRRHRPPLSPPSSSPARPGLGSPEKRDQNPAKRAVIGASTRLHARLQLRVSSGACSSRAAVPSSESCSSCSSSLVGTSWLHSKWWFSVLTSLCGSLCLVLPFFR

SEQ ID NO: 110425 - protein, 132 aa, Glycine max
  Coding DNA Sequence Number=SeqID_18740
  Gene Ontology: Mol. function=hydrolase activity
  Homolog annotation: Hit_ID=A7P2G3; Match level="QueryCoverage=97%, HitCoverage=37%, E-value=2e-47, Identity=68%"; Hit description =Chromosome chr1 scaffold_5, whole genome shotgun sequence
MSIPLRLYANYLSFTSLTFSTSLDWTNIGRLHCLLPWWEDATVDFMTSGGYNVASQIEKVKQKTLIIWGENDRIISNKLAVRLHCELADAIIRQIPDCGHLPHVERPDSVVKFIVEFVQSKTNTEKECVSPV

SEQ ID NO: 110426 - protein, 103 aa, Glycine max
  Coding DNA Sequence Number=SeqID_18741
MDIGINLGLNVPQDEPITQHDDFSIISWNIKGAIGCTTKCHFWKSPDYSPMFIQKAIGHSRGIWVLSNRNDITFTLVDSMPQCISFSANKLNSQWVARPSMSF

SEQ ID NO: 110427 - protein, 596 aa, Glycine max
  Coding DNA Sequence Number=SeqID_18742
  Gene Ontology: Mol. function=metal ion binding; Cellular component =Golgi apparatus
  Homolog annotation: Hit_ID=A7P2I7; Match level="QueryCoverage=100%, HitCoverage=100%, E-value=0.0, Identity=65%"; Hit description =Chromosome chr1 scaffold_5, whole genome shotgun sequence
  Pfam annotation: Domain name=DUF248; Domain location=101-591; Score =455.1; E_value=9.3e-134; Accession=PF03141.7; Description=Putative methyltransferase
  Pfam annotation: Domain name=Methyltransf_11; Domain location=227 -322; Score=22.8; E_value=0.00061; Accession=PF08241.3; Description =Methyltransferase domain
  Pfam annotation: Domain name=Methyltransf_11; Domain location=454 -552; Score=8.3; E_value=0.014; Accession=PF08241.3; Description =Methyltransferase domain
  Pfam module annotation: Pfam domain module=DUF248::Methyltransf _11::Methyltransf_11; Domain location=101-591::227-322::454-552
  Subcellular localization annotation: CTP_CleavageSite=79; ConfidenceScore=5.44e-01
MRSSWLKKQSFVIGHKPPLNWLILFLISLLALIAVLSSSSSPLSSSKKNSSRRTTVESLIYTSYRRIEEQAAVDYLELRAVSSAGGARQKEVGLCRKERENFVPCHNVSANLVAGFKDGEEFDRHCEVYKGTEKCLVRPPKEYKAPLQWPAGRDVIWSGNVKITKDQFLSSGSMTKRLMLLEENQIAFHAEDGTIFNSVKDYTRQLAEMIGLGSDTELPQAGIRNILDINCGFGSFGAHLLSLKIMAVCIAAYEATGSQVQLSLERGLPAMIGNFISRQLPYPSLSYDMVHCAQCGIMWDEKNGMFLVEVDRVLKPGGYFVLTSPTSRPQGSSREKKRIMANPIEGLTQQLCWTLLAQQDETFIWQKTADIDCYASRKLPTIQVCKADDTQSYYRPLLPCIRVQPEEFYEDFQYWRSAVNNYWSLLTPLIFSDHPKRPGDEDPLPPYNMIRNVMDMSANFGGLNAALLEEKKTVWVMNVVPARASNALPLILDRGFAGVTHDWCEPFPTYPRTYDMLHAYGLISHLSSERCSMVDLFLEMDRILRPEGWVILSDTIGAIEMARMLAAQVRWDARIIDLQNGSDQRLLVCQKPFVKK

SEQ ID NO: 110428 - protein, 69 aa, Glycine max
  Coding DNA Sequence Number=SeqID_18743
MESQFITTSIAQMDYQYVLHGHGYLSHRGTSTHLSLPKNDHRQSFPTHSLILKAYPTWSPTNTRDPLII

SEQ ID NO: 110429 - protein, 86 aa, Glycine max
  Coding DNA Sequence Number=SeqID_18744
  Pfam annotation: Domain name=RVT_2; Domain location=1-85; Score= -185.5; E_value=0.019; Accession=PF07727.5; Description=Reverse transcriptase (RNA-dependent DNA pol
WLFKRKEGVEGVQSARFKARLVARVFTQKEGIKDLGHGKKIIGIEIPRNRKEKVLYLSQVDLPQKGLGKIQFKGSKASYHFPSTTL

SEQ ID NO: 110430 - protein, 296 aa, Glycine max
  Coding DNA Sequence Number=SeqID_18745
  Homolog annotation: Hit_ID=Q2HSY3; Match level="QueryCoverage=47%, HitCoverage=61%, E-value=6e-07, Identity=26%"; Hit description =Nucleic acid-binding, OB-fold, subgroup
MSRKENIIFELHTKKGTWKIVVRINDMWHVNKHNGRKAIEMVFMDQMGAKIGATFSRELFVEFESRLHCGSAYVIQNIKVVENHSEYKEAEHPEILPGVYVITSFTDIIVEGAPRDTLVVIKCKTINPTYKVTVKLRDNSYDSCANCTTTFDPLKLGSTCRSCHNQVTYTVPSGDEVKVFPPCVDELLRKTWALRFKYSVQIRQSFVLDVTEDEDIIHTIRSTISLQDEPSIEKGKDVVAETSSLDFHPTLGMMQASLELVGLGSSSSMDSFASWKMNCSGMKKGRERGDATSRRR

SEQ ID NO: 110431 - protein, 110 aa, Glycine max
  Coding DNA Sequence Number=SeqID_18746
MNFRKYFFRKLMIQIPEEVVPEVSSETTSSGIAHTNFRKNFFRNGTLVDCPSEHQFAESLQKFQIACSPWPMFVDYVKDTWIIPHKEKFITAWTNKGYISSLGSKKSTTK

SEQ ID NO: 110432 - protein, 271 aa, Glycine max
  Coding DNA Sequence Number=SeqID_18747
  Homolog annotation: Hit_ID=A2Q323; Match level="QueryCoverage=61%, HitCoverage=33%, E-value=2e-13, Identity=32%"; Hit description=IMP dehydrogenase/GMP reductase, related
  Pfam annotation: Domain name=DUF1723; Domain location=147-196; Score =48.6; E_value=2.3e-11; Accession=PF08330.1; Description=Protein of unknown function (DUF1723)
MSDGFCGTHLQIMVGTRRLGRALGQVTRRGVGRGDHDDSDDAPQRRRPTASARRQRVAATADHVDDLVIPDLDVQDDPMEAPAAVEDIPADAGALRISLRDFRVERPELKLSSHGRKVHSLGRPTPAIEGLIAGTGLSPLIACSVDTGDQGLLSAFVERWHRETSSFHLPVRELTITLDDVSSLLHLPVIGDFHAFEPLHVDDAVQMLVDLLMMSPESTRAETYISADAKQVIGQLRLVHIFFTCWVALCLLTRVQPMSMLSTWRPFVTSV

SEQ ID NO: 110433 - protein, 454 aa, Glycine max
  Coding DNA Sequence Number=SeqID_18748
  Homolog annotation: Hit_ID=Q2A9D9; Match level="QueryCoverage=54%, HitCoverage=52%, E-value=1e-09, Identity=21%"; Hit description =Putative uncharacterized protein
MWHVNKHNGRQAIDMVLMDHTVISMFFSFSGFGCKDWRNSMEVDRPEIPPNVHVITAFADIISGVAPRDTLVDVVGVVAEVIERKTVNPAYRVTMKLRDNSDAEIIMTVWEEYVVQLDDAIEKNHFVRKPLVLMLTFAKIKEPKDKYPLSVQNIKHGSKLYVNTDMAEIQQFRDRLRVPFYAGGVTDEGTISQSQSNQHSQRNSAEKFLHNAQMVSFGEISRLRQDCYCLTVATVDEVMIDTPWSHDSCPYCTTTFDPLKIGAACCSCQNQVTHTVPRYKLVVKMEQNGEKANFHLWDATCIKIFSKTVDECRQELIASCDEIKVFPACVDELLGKTWAVRFKYRFQMCQSFVLDVSEEEHHIQALTSTLGLQDELSIGKSPAVGATTSSQDYHPTIGDEIMTLILLLLADYDPGKTAFVTPVKRMCDQQGSSEFESDEYAPYELSTNKHIKAE

SEQ ID NO: 110434 - protein, 236 aa, Glycine max
  Coding DNA Sequence Number=SeqID_18749
MVRNNIVFMMLLVIISTRWKFMKMESKKKRTAPSRPLEAYDSSHFVFEEAWDRYQTNVSLRNVLPERNVELAQSHYDEFLHGLERRQWHCHLTQEMENPIDMALTPMVLKVGEHYAEYSRYCHTYPDHQAIASKLYVSGGVFVLNAKGPLEDPKEGSDHPDSNLECPIAIVVFFLLRSTILDRPHVGKLASGVAWPEVQPSLVGEGGDAFDAPDPDAEADASAEIDSNYVADVTFA

SEQ ID NO: 110435 - protein, 148 aa, Glycine max
  Coding DNA Sequence Number=SeqID_18750
  Homolog annotation: Hit_ID=UPI000065F7CF; Match level="QueryCoverage =78%, HitCoverage=15%, E-value=8e-07, Identity=34%"; Hit description =Homolog of Homo sapiens "Leucine-rich repeats and IQ motif containing 1
GYTPSPWVLVTLTVERTTRPRLERTTRPHHQRAACPYLQRTTCPRLERATRPHLGTTRPHHQRAACPHLQRTTCPRLERATRPHLGGLHVLTIRGLHALTSRGLHVLALRGLHVLTLGTSYPHRQRATRPHLERTTRPHHQRAARPHL

SEQ ID NO: 110436 - protein, 145 aa, Glycine max
  Coding DNA Sequence Number=SeqID_18751
  Pfam annotation: Domain name=PB1; Domain location=20-91; Score=5.1; E_ value=0.074; Accession=PF00564.15; Description=PB1 domain
MASRNENVPVIVYYNAYVVDCDEGVEFKGGNNILISMRRGMTFNVLKTKIQRKMSLNQAVTISDDEDIDGMFDVYNRHQCLSGFQLLIQYEQQPFSTANVETTIQSPQIHETPYTNYYTQTCHEGPSSYTPIPYTTTNDYYVPHF

SEQ ID NO: 110437 - protein, 114 aa, Glycine max
  Coding DNA Sequence Number=SeqID_18752
MEKERGEEGVGSGRMAVENERFQLSSAHRNLPIHMDRVSLLPYRVSGSSSSILYKQGLDDADMDVLVPTCRDVVRPNSHPKMSLSYCIYYFLSFAYCTLQLSMHVCFQGHLLRH

SEQ ID NO: 110438 - protein, 58 aa, Glycine max
  Coding DNA Sequence Number=SeqID_18753
MLSVLALPRVSSFEFHLHWSARYTFLSSGLELLHNEVPRIVLSMMIDTFRALKTLHMF

SEQ ID NO: 110439 - protein, 97 aa, Glycine max
  Coding DNA Sequence Number=SeqID_18754
  Homolog annotation: Hit_ID=Q2MGR2; Match level="QueryCoverage=68%, HitCoverage=32%, E-value=3e-19, Identity=70%"; Hit description=SGS; HSP20-like chaperone
  Pfam annotation: Domain name=Siah-Interact_N; Domain location=1-57; Score=3.1; E_value=0.045; Accession=PF09032.2; Description=Siah interacting protein, N terminal
MAQDLALDLEELRRLHSIAKRPRTLSLLSSEIRNLEKLSSEEASAQIPAPISTGTKVAPSPALKYAALASFSWDQDSDKVKRRNKAICEGRPAMAVP

SEQ ID NO: 110440 - protein, 152 aa, Glycine max
  Coding DNA Sequence Number=SeqID_18755
  Gene Ontology: Mol. function=transcription regulator activity; Cellular component=nucleus; Biological process=regulation of transcription
  Homolog annotation: Hit_ID=A7Q723; Match level="QueryCoverage=86%, HitCoverage=25%, E-value=2e-26, Identity=51%"; Hit description =Chromosome chr5 scaffold_58, whole genome shotgun sequence
MLDEVINYVQSLQRQVEFLCMKLAFVNNRLDFSVESLMSKDILQSINSLAHPIFPIDSSAPPFNGQHPHPNPTVHNNIPNGTMTHNSVDPLDKGLCQNLGMHLPHLNGFNEGGSQDKAQRYFFLHAGLQAGTRYYYKCGNSSILALSQEHLF

SEQ ID NO: 110441 - protein, 134 aa, Glycine max
  Coding DNA Sequence Number=SeqID_18756
  Homolog annotation: Hit_ID=A5C5K2; Match level="QueryCoverage=37%, HitCoverage=3%, E-value=2e-07, Identity=42%"; Hit description =Putative uncharacterized protein
MDSKIDSILEGLAHLTLPPPISPKSSPPSSPLPRSYMKLDVPQFDGQDPLGWIFKIIQFFDYQCIPDNERLTIVSFYMEGLTLCWPSKLDLLRPSMMTPTTPYSSSNRRAPSTITFLNLSDWLIGRSGLLTPFF

SEQ ID NO: 110442 - protein, 201 aa, Glycine max
  Coding DNA Sequence Number=SeqID_18757
MALRLIWETTEGAAGGGGVCICDQGTTCHHSGNITLGHGGGQAGELEWSGNCNDGQAVCPPEGGQAPPLGAEKLVAGPEPRGGVRGSDQKRNNSTNFKPPEDHHKTKAQIATQVLAASPSKMEKNPLRYIHWYHDKAAPSMDGGGWPGEMVEGEGAVIVASRSKRDSIWDPPPTYPWLPVVCDAPASEKEGRSDQLIENCK

SEQ ID NO: 110443 - protein, 65 aa, Glycine max
  Coding DNA Sequence Number=SeqID_18758
MKREKDARWCNHAGRRGSQGKRRDVGRHDSWGMIARWLVGKAKCTTSLTSPSTEADTDKSVDFVD

SEQ ID NO: 110444 - protein, 76 aa, Glycine max
  Coding DNA Sequence Number=SeqID_18759
MSRKQTCRRGRGALRRSWWRCGGRRRRGGGRRRGVVWVCGGGRGLWKRTRRGRKEGEEEGEEEDEKGEPRELGVVD

SEQ ID NO: 110445 - protein, 169 aa, Glycine max
  Coding DNA Sequence Number=SeqID_18760
  Gene Ontology: Mol. function=lipoic acid binding; Cellular component =glycine cleavage complex; Biological process=glycine catabolic process
  Homolog annotation: Hit_ID=Q2MGQ2; Match level="QueryCoverage=100%, HitCoverage=100%, E-value=9e-73, Identity=79%"; Hit description=2 -oxo acid dehydrogenase, lipoyl-binding site
  Pfam annotation: Domain name=GCV_H; Domain location=45-165; Score =232.8; E_value=7.7e-67; Accession=PF01597.10; Description=Glycine cleavage H-protein
MACRQLWASRAASYLRISVFHRSFSNAVSGDLSGYVATDQVLNDLKYADSHEWVKVDGNSATVGITDHAQDHLGEVVYVELPEVGATVTQGEGFGAAESVKATSDINSPVSGKVVEVNEKLTSSPALVNTSPYKDGWIIKVEMSDSGELNNLMDSEKYSKFCEEEDSNH

SEQ ID NO: 110446 - protein, 88 aa, Glycine max
  Coding DNA Sequence Number=SeqID_18761
MMPELETKFMYKTIGFINEKLIFIGVECEPSMLYVLTGIQFGNILYISSREALKRVYGLYPNRPNGIWLCEHRDHPTPRRIVVTLNEI

SEQ ID NO: 110447 - protein, 126 aa, Glycine max
  Coding DNA Sequence Number=SeqID_18762
  Gene Ontology: Mol. function=protein binding
  Homolog annotation: Hit_ID=A2Q144; Match level="QueryCoverage=72%, HitCoverage=7%, E-value=6e-45, Identity=95%"; Hit description =Protein NAP1 , putative
MSSSSSRRADEWFEKCPNLITSLIKGCRWDPNDPTIGFLLDGMDHLCCLVRKYIAAIRGYSLSYLSSCAGRIRFLLGTPGMVALDIEASLKGLLQQIVHHLENLPKPQGENISAITCDMSVCGTSE

SEQ ID NO: 110448 - protein, 636 aa, Glycine max
  Coding DNA Sequence Number=SeqID_18763
  Gene Ontology: Mol. function=unfolded protein binding; Cellular component=chloroplast; Biological process=cellular protein metabolic process
  Homolog annotation: Hit_ID=Q2MGR4; Match level="QueryCoverage=92%, HitCoverage=91%, E-value=0.0, Identity=76%"; Hit description=GroEL -like chaperone, ATPase
  Pfam annotation: Domain name=Cpn60_TCP1; Domain location=72-621; Score=477.2; E_value=2e-140; Accession=PF00118.15; Description=TCP -1cpn60 chaperonin family
  Subcellular localization annotation: CTP_CleavageSite=48; ConfidenceScore=5.31e-01
MARTNDIANKIVVRRFWFTTSISNAKPPPFRWNQTVAFGVRKTPRFVVCAGPKKILFGKECREALQAGIDKLADAVSLTVGPKGRNVILSESGNLKVINDGVTIARSIELSDAIENAGAILIQEVASKMNELAGDGTSTAIILARAMIKSGLLAVAFGANPISLKKGMEKTVKELVKFLKERSVPVEGREHIKAVASISAGNDEYVGNLIAEAMDKIGSDGVISIESSSSSETSVIIEEGMKFNKGYMSPHFITNQEKSIVEFDWVKVLVTDQKISNVKEIVPLLEKAMQLNAPLLIIAEDITKQVLETLVVNKMQGLLRVAVVKCPGFGGAKKALLQDIALMTGADFLSGDLGLTLDCATSDQLGTALKVRITCNETTIIADPSLKAEIQARISQIKKDLSETDNANLSRKLSERIAKLSGGVAVIKGLSNMGHCEKSIIKGDFASNNNENPNATDYSSSLVNMISEPILDVLVGAHTELELEDRKLRIEDAKNATFAAISEGIVPGGGATYVHLLDLIPTIRNSMEDLDEQIGADIVAKALLEPAKSIATNAGVDGDIVVRKTRTHDWRTGYNAMTGTYEDLLNAGVADPSRVARCALQSAVSVAGVILTTQAILVDKIKKPKPPVPLVPGITP

SEQ ID NO: 110449 - protein, 116 aa, Glycine max
  Coding DNA Sequence Number=SeqID_18764
  Gene Ontology: Mol. function=nucleoside-triphosphatase activity; Cellular component=intrinsic to membrane; Biological process=innate immune response
  Homolog annotation: Hit_ID=Q5JBT4; Match level="QueryCoverage=100%, HitCoverage=10%, E-value=2e-37, Identity=68%"; Hit description =Candidate disease-resistance protein SR1
MDPSDVRRWKGSYGEALAKHEERFKFNHNMEKLQQWKMGLYQVANLSGYHFKDGAGYEYEFIGKIVERVSSKINHATLYVADHPVGLESQVLEVRKLLDDRSDDGVQMIGIHRMGG

SEQ ID NO: 110450 - protein, 205 aa, Glycine max
  Coding DNA Sequence Number=SeqID_18765
  Gene Ontology: Mol. function=electron carrier activity; Cellular component=chloroplast; Biological process=electron transport
  Homolog annotation: Hit_ID=A2Q293; Match level="QueryCoverage=80%, HitCoverage=100%, E-value=7e-61, Identity=70%"; Hit description =Cytochrome c, monohaem
  Pfam annotation: Domain name=Cytochrom_C; Domain location=110-193; Score=8.3; E_value=0.033; Accession=PF00034.12; Description =Cytochrome c
MAEVKDFKIQLQGAAEGRKGRLAVTAEGRKFSSYYIGTNEMKIASLISGCNDYTHLLSIKEHVMREEKPIPTTRKSEVKFLKSLTRLVAAFLVLSPICSIPVSSAQTVDIQRGTTLFRQACIGCHDAGATLFTKDLQRNEVDTEEAIYRVTYYGKARMPGFGKECMPRGQCTFGARLEDEDIKTLAEFVKLQADQGWPSIETKEE

SEQ ID NO: 110451 - protein, 412 aa, Glycine max
  Coding DNA Sequence Number=SeqID_18766
  Gene Ontology: Mol. function=sugar binding; Cellular component =integral to membrane; Biological process=innate immune response
  Homolog annotation: Hit_ID=A2Q295; Match level="QueryCoverage=86%, HitCoverage=56%, E-value=9e-66, Identity=71%"; Hit description =Galactose-binding like
  Subcellular localization annotation: CTP_CleavageSite=55; ConfidenceScore=5.13e-01
MGASQSQEELQSQRQFQQHQHPNELTRRESLLLSPAASNNTKQFSNSTKVVDNVTAANSTNTNCFMLNARALSITWAENPDYWTWVQDKDESGTMIELPNLKMVCWLEVHGKFDTRKLSLGILYQVSFIVMLKDSAQGWEVPINVRLVLPGGKKQQHKENLNEKLRECWIEIPVGEFVASEKDVGNIEISMYEYEGGKWKTGLIIQGIAIKPKNETNQSQHHQQPHELTRRESWLMSPAGNSKYFKNSTKAIDNVTSANNTNSFMVYARSLSITWAENPNYWKWVQHKEASGTMTELAKLKMVCWLEVHGKFDARKLLPGIPYQVLFIVMLKDSAQGWEVPINFRLVLPGGKKQEHKENLNKLRESWIHIPVGEFVASEKDVGNIEISMYEYEGGMWKTGLIIQGIVIKPKN

SEQ ID NO: 110452 - protein, 792 aa, Glycine max
  Coding DNA Sequence Number=SeqID_18767
  Homolog annotation: Hit_ID=A2Q297; Match level="QueryCoverage=100%, HitCoverage=100%, E-value=0.0, Identity=74%"; Hit description =Putative uncharacterized protein
MESSEEEDDFPSIESIIPQSKVDSLYQSHTEKGIRKLCCELLDLKDSVENLCGNMHSKFLAFLRNLSWKMRNKLKKLKLLKYCPAVEVKHELIELQKHISAQGILVQDLMTGVCRELEEWNQSSNDVAEIQQEPELPELLEPLPNERNDQKILFLETIDVLLAEHKFEEALEALDAEEINSAELKGSGNNSSDDVSLYKSSLLERKAMLEDQLVGIAEQPSVSFPELKTALNGLIKLGKGPLAHQLMLKFYQSHLQKRIEALLPSSSLCPETFPSTLSKIVFSVISLTIKESALIFGDNPVYTNRVVQWAEWEIEYFVRVVKENAPLSETVSALRAASISIQASLNYCSILESQGLKLSKLLLVLLRPSVEEVLESNFRRARRVVLDMAECCPLSPQFASSLSAIASSSSSMLVESGMRFMHIVEEILEQLTPTVSLHFGGNVLNRILQLFDKYMDALTRALPGPSDDDNLPELKEVALFRAETDSEQLAILGIAFTILDELLPNAVLSRWMLQSESKAKEPNSGATENVTFNTNASVELKEWRKHLQHSFDKLRDHFCLQYIVTFIYSREGKTRLNAHIYLSDNREDLYWDSDPLPSLPFQALFAKLQQLATVAGDVLLGKEKIQKMLLARLTETLVMWLSDEQEFWGALEDNSAPLKPLGLQQLILDMHFTVEIARFAGYPSRHIHQIASAITARAIRTFSARGIDPQSALPEDEWFVETAKSAINKLLLGASGSEASDTDEDHIIVHHDEVVSDSDTVSSLSSTESTESFASASMAELDSPSNLSDPDN

SEQ ID NO: 110453 - protein, 109 aa, Glycine max
  Coding DNA Sequence Number=SeqID_18768
MRTKQGDANWNDMQRAERTSGKVNEDDKGKSSVEGAVRQKFQQNERDNLVCDNADDRKQKNGTRKKYPKPELNRRNNLLFISTIEHTCGREDMAKQHMGGKTEESCDVQ

SEQ ID NO: 110454 - protein, 267 aa, Glycine max
  Coding DNA Sequence Number=SeqID_18769
  Gene Ontology: Mol. function=sugar binding; Cellular component =integral to membrane; Biological process=innate immune response
  Homolog annotation: Hit_ID=A2Q295; Match level="QueryCoverage=86%, HitCoverage=83%, E-value=9e-80, Identity=65%"; Hit description =Galactose-binding like
MGASESHEKLQSQQPQPQSQHVQHQQPQPQLHEPTRRRESSLLPPDQGNTKASKDRTKAVVDNNATMMPVKSLKGLPIPHNYEHILKSNADSPVDKSLLDKLYAGKYWVEKKSNGNCFMLYARALSITWAENPNYWKWVQHKEESGSMIELAKLKMVCWLEVNGKFGTGMLSPGILYQVSFIVMLKDSAQGWELPINVRLVLPGGKKQQHKENLMEKSRESWIEILVGEFVASEKDVGEMEISMYEHEGGMWKTGLVIEGVAIKPKN

SEQ ID NO: 110455 - protein, 348 aa, Glycine max
  Coding DNA Sequence Number=SeqID_18770
  Gene Ontology: Mol. function=serine carboxypeptidase activity; Cellular component=extracellular region; Biological process =proteolysis
  Homolog annotation: Hit_ID=A7P3L9; Match level="QueryCoverage=39%, HitCoverage=31%, E-value=1e-48, Identity=69%"; Hit description =Chromosome chr1 scaffold_5, whole genome shotgun sequence
MGNWSEATDARNKVLKMLQSMTGLDTLYDYTRKTPYEDDLVEQFLSIAEVKKALGINESFAYESCSDVVGDVLHADVMKSVKYMVEYLLSMSKVLLYQGQHDLRDGVVQTEVWVKTVKWEGIVEFLNSERKIWKVNGEHARIETIFEAEKEHEVATLSLLFSPLSNPRKSINHPSTKQAQSSKPSLIPHRPFSLHHHSSSFKSTISANPLHAPLSLAPHRPRDPSNATAPVTLPMPPPSVTPPSSGFATTSASSIMSASSPPTTPSLSSLSTALTPLTTASRHPASTRPAPTGSPSSLTLSQTSTAASRRAAPISSCASGSPRLCERSSPRRCILSLARERRGRNCWK

SEQ ID NO: 110456 - protein, 798 aa, Glycine max
  Coding DNA Sequence Number=SeqID_18771
  Gene Ontology: Mol. function=nucleic acid binding; Cellular component= nucleus; Biological process=DNA replication
  Homolog annotation: Hit_ID=Q9C8B2; Match level="QueryCoverage=63%, HitCoverage=88%, E-value=5e-19, Identity=21%"; Hit description =Putative uncharacterized protein F10O5.9
MSGKENLISELHPRKGSWKIAVRITDMWDVKKHNGRQAIEMVFIDQMGVKIRATLWQELFPEFQPKLSLGCSYLIQNIKVVDNQSEYKEVERPEILANVHVITKIADIISGIALRHTLVDVVGVIAEVIERKTVNPAYRVTVKLRDNSDAEILMTLWEDYALQLDDVIEKNHFKREPLVLMLTLAKIKDATDKYPLSVQNIKNGSKLYVNSDDIAEIRKFRDSLCVPFYVGGLTEEGSGSQSQYTSNSQRGDRDKFLHNAQMVRLGDISRLREDCFCLTVATVDEVLIDTPWSYDSCPNCTTTFDPLKIVGVCRSCQNQVSHTVPKYKLVVKMEHNGEKANFYFWDATCIKMFDKTAEECRQELIAGGDEIKVFPECVDDLVGKTLAVRFKFRVNMRQSSVMDVSEEEHHIQTLTFKLGLQDVQTIGKSPASCAETSSGYYHPTPSLSQSADYDPGNTAFITLAKRLSGEQATNEFDSEDTTAYIVIVVLYTCVISEVDKPGSASGPMTALVDKPLYDSGLMTPYDGNVYTYTKSLSYKVLELVPKQKHLRAPMFLIIHLGDCHHLGDCHHILEKGGPPKFLGCTVIYQFQTAFHVDRNYIEVPSKYHQQWAPDYPPNVLFDYNGHKQIIQIRKDNNRYYFADRLKQFRRELNIYEGVMVYFMAPNNNTTFHLHFTPPLERQTCGRPHSSTKNYVFTIDITQPMISNATPLLLPPEALNLVGPSSLYMTIQRSSGRRLIWSMSMDNGIRCMAAPWYRFLMDNNVMAGDEVAFYFRPNQHVWELILRKQLIWEDEGQSH

SEQ ID NO: 110457 - protein, 125 aa, Glycine max
  Coding DNA Sequence Number=SeqID_18772
  Subcellular localization annotation: CTP_CleavageSite=35; ConfidenceScore=5.51e-01
MTTPPSSPPPPPSDAASQSPFTLKRTRKATYLRSLATRVVGVERPLVHVDPETENADGPHKKKLRTYLGIVARDNVDVTYENLKQVPTAQKDLISEDIQAEFDIPKASNLRKKKKILQTVRERWR

SEQ ID NO: 110458 - protein, 393 aa, Glycine max
  Coding DNA Sequence Number=SeqID_18773
  Gene Ontology: Mol. function=transferase activity, transferring glycosyl groups
  Homolog annotation: Hit_ID=A7Q7M7; Match level="QueryCoverage=85%, HitCoverage=59%, E-value=1e-134, Identity=71%"; Hit description =Chromosome undetermined scaffold_60, whole genome shotgun sequence
  Pfam annotation: Domain name=DUF246; Domain location=70-382; Score= -173.4; E_value=0.00016; Accession=PF03138.5; Description=Plant protein family
MGGGGGTVKSLTCKFVFLLVTLLILRALLVPPSPGFGGVVEWSNFVYIRNHSPSFGIGVRQDKFLEVPQIVWGLNNQKIAFARACLTARRMNRILLMPSLSASLFYKEINLLQPISFDKVFQFDKFNQLCSGFVQLGQYSDLSNQTRVLEMQKGSGRKWTLERDLDQLREHSKGEFDEHEVIRIVGKNPFLWHDHWPVKDYAKVFECLVLIDEIGQEADRVVSRIRAVGRETQSNSESMELDNNDSSSFQPLPYVAVHMRVEIDWMIHCKKLEQRLNTNQICSSKKEIMERVSNIKGLKTPSVVYLAVADKLLQNSSVLEGWEEGFLPYEKNKLGVDGIYKKYPYLIQSAIDYEVCLRADIFVGNSFSTFSTLIVLERTQKMITMGINMCGKD

SEQ ID NO: 110459 - protein, 102 aa, Glycine max
  Coding DNA Sequence Number=SeqID_18774
MAAVTMPYFTIEPTHLQREVSWSLHRRMPCWRRTIQPASSIVMQVGGCSICGGTQESGACMTHDDISKEVNYMASPNRQVFHLGGYSGYQQGGNFSHNQGQG

SEQ ID NO: 110460 - protein, 61 aa, Glycine max
  Coding DNA Sequence Number=SeqID_18775
MDIEEDVEILLILGRPFMLTTNCVVDMGKAKHSIDRSVCSKMNEIENEIAQIVKAKKLQDP

SEQ ID NO: 110461 - protein, 252 aa, Glycine max
  Coding DNA Sequence Number=SeqID_18776
  Gene Ontology: Mol. function=nucleic acid binding
  Homolog annotation: Hit_ID=A7Q7N3; Match level="QueryCoverage=85%, HitCoverage=32%, E-value=8e-35, Identity=36%"; Hit description =Chromosome undetermined scaffold_60, whole genome shotgun sequence
  Pfam annotation: Domain name=PAZ; Domain location=146-231; Score=7.9; E_value=0.0003; Accession=PF02170.13; Description=PAZ domain
  Subcellular localization annotation: CTP_CleavageSite=51; ConfidenceScore=5.24e-01
MHYNVEVKAKAPPPKNNRPPKKISKQSPFNPQSISMHYSVVPLPEETFTVDVSKGEDERPVSYLVPLTLVSRLELRKLRDYLSGSDLVVKENPLKQCVSLRRCFFPMNPPLRKKDLNHGIMAIGGFQQSLSLLLRDCPCAWTIRFCPFGRSCRRQVEHVLIGLKVNVKHRKTKQKYTITRLTPKDIPALDFGGNKTNFVPMELCELVEGQRYPKENLDKYAAKDLKGMSVAPPRVRQSTIQAMVNSEDGPCG

SEQ ID NO: 110462 - protein, 105 aa, Glycine max
  Coding DNA Sequence Number=SeqID_18777
MRCWRSLLTVVFLENLGFHFSGSRHHLVYERGEVWKVCYFLHVWITIVVGRWNVNIFASVGLHEIEEEEWGWDVDIMSYIDFKKLINSVRYKHSSAYAIGIPKKH

SEQ ID NO: 110463 - protein, 220 aa, Glycine max
  Coding DNA Sequence Number=SeqID_18778
  Gene Ontology: Mol. function=helicase activity
  Homolog annotation: Hit_ID=A2Q378; Match level="QueryCoverage=47%, HitCoverage=6%, E-value=8e-19, Identity=44%"; Hit description =Putative uncharacterized protein
MNKGYDRVTAIMVHDDNGTVPHANTLNDEIKEYLDCRYISPCESTWRIFGFPIHGRKPFVERLQFHLLGQHSILYQDHDDIDDLLSNPSIYESKFIAWMNTNQAFVEEDQSHLKISEQLMVLNILHIEKQVLLWVFLQDDREFIAAIQEAKDWGLAPYLRNLFALLLLTELHIDDSNLMNLVLLEVEKLLQANQRSLKDYPSMPYPENANLLIHADNDLI

SEQ ID NO: 110464 - protein, 104 aa, Glycine max
  Coding DNA Sequence Number=SeqID_18779
MDLKEGCTYVMHNFRVSKNDEWYRVCDHPYKLTFIGVTVVRQCELDDLPFKKTSLVSLTRLSFVIFHPEQSISITADHDALIGLPLTPTKRQPFNECDDEARSS

SEQ ID NO: 110465 - protein, 65 aa, Glycine max
  Coding DNA Sequence Number=SeqID_18780
MPRRLSNSSKGVQYYTHVFEEKEGNLRRAEKGPWGTTTPHAIYNMEKGIGIDYKINQLLINKETK

SEQ ID NO: 110466 - protein, 59 aa, Glycine max
  Coding DNA Sequence Number=SeqID_18781
MERCQIQRDVPNYFRIVIEILIEVDHLQDVPGPYIQIKGANKDAVAAAGSGSNKYFMDV

SEQ ID NO: 110467 - protein, 48 aa, Glycine max
  Coding DNA Sequence Number=SeqID_18782
METYAKYEDTFSKSGTERKKKEEILKQAQSNRGAKRASGAKRATNCRR

SEQ ID NO: 110468 - protein, 136 aa, Glycine max
  Coding DNA Sequence Number=SeqID_18783
MVYHATEGNYLHFGYGVSCYKLGNNGKVQLAYNSSENSGKAAEMLFLLTSGEEYLHHGKLNAYEVALGGRFNNINIGDLKLFERMNMGKKVGPQSYYDHPYTPTSPIVELNWLYYEVFSFESWTQALSIIHKHLCK

SEQ ID NO: 110469 - protein, 53 aa, Glycine max
  Coding DNA Sequence Number=SeqID_18784
MAPPKEISTIIYHNGHIADDPVRGSVAAMETILQNPQLNSAEFYVVTDLIPQP

SEQ ID NO: 110470 - protein, 76 aa, Glycine max
  Coding DNA Sequence Number=SeqID_18785
MASLVSVSNSLMLLAIRACSPKIAIKTGDMQKAYVAGAFSVQARLQVLFSEKGELQLPLASCLQVATPIGDLGQKK

SEQ ID NO: 110471 - protein, 86 aa, Glycine max
  Coding DNA Sequence Number=SeqID_18786
MRIGNLHNPYRLIVNSYELNILKIKIYGEVWVLMPTVKTTPPTRMVKMNGGMNRAEKLRAAQQEGRKLKCQVGNGCREGMLYFNFK

SEQ ID NO: 110472 - protein, 558 aa, Glycine max
  Coding DNA Sequence Number=SeqID_18787
  Gene Ontology: Mol. function=oxidoreductase activity; Cellular component=extracellular region; Biological process=electron transport
  Homolog annotation: Hit_ID=A7P0D6; Match level="QueryCoverage=96%, HitCoverage=98%, E-value=0.0, Identity=69%"; Hit description =Chromosome chr6 scaffold_3, whole genome shotgun sequence
  Pfam annotation: Domain name=Cu-oxidase; Domain location=169-308; Score=191.8; E_value=1.7e-54; Accession=PF00394.13; Description =Multicopper oxidase
  Pfam annotation: Domain name=Cu-oxidase_2; Domain location=387-530; Score=122.7; E_value=1.1e-33; Accession=PF07731.5; Description =Multicopper oxidase
  Pfam annotation: Domain name=Cu-oxidase_3; Domain location=42-159; Score=174.7; E_value=2.4e-49; Accession=PF07732.6; Description =Multicopper oxidase
  Pfam module annotation: Pfam domain module=Cu-oxidase::Cu-oxidase _2::Cu-oxidase_3; Domain location=169-308::387-530::42-159
MAFLDVRKKIMGRVWTWTMALMLCLMAASVRSEDPYIYYTWKVTYGTIAPMGVPQQGILINGQFPGPEINSTSNNNVVINVFNNLDEPLLFTWHGVQHRKNSWQDGTLGVQCPIAPGTNYTYHFQVVKDQIGTYFYYPTTGLQRAIGGFGGLRIFSRLLIPVPYADPADEYWVLIGDWFGKSHTALKQKLDSGRSIGRPVGVHINGKNGGLEPLYTMEPGKTYKYRICNVGLKDSLNFRIQGHPLKLVETEGSHVVQNNYDSLDVHVGQCYTVLVTADQEPKDYFMVASTRFTKKVLTATRVIRYSNGVGPASGGLPPAPQGWAWSINQFRSFRWNLTASAARPNPQGSYHYGQINITRTIKLVNTVSRANGKLRYGLNGVSHVDTQTPLKLAEYYGVADKVFKYNLISDSPDTAFPDLTVAPNVINATFRDFIEVIFENPGKVIQSYNLDGYSFFALAVEPGKWTPEKRKNYNLLDAISRHTIQVFPNSWAAIMLTFDNAGMWNLRSEMAENRYLGQQLYVSVLSPNRSLRDEYNLPETQLLCGIVKDMPKPPPYSS

SEQ ID NO: 110473 - protein, 314 aa, Glycine max
  Coding DNA Sequence Number=SeqID_18788
  Gene Ontology: Mol. function=asparagine synthase (glutamine -hydrolyzing) activity; Cellular component=cytoplasm; Biological process=asparagine biosynthetic process
  Homolog annotation: Hit_ID=A7P2E6; Match level="QueryCoverage=60%, HitCoverage=31%, E-value=6e-87, Identity=81%"; Hit description =Chromosome chr1 scaffold_5, whole genome shotgun sequence
  Pfam annotation: Domain name=Asn_synthase; Domain location=15-232; Score=40.3; E_value=8.6e-10; Accession=PF00733.12; Description =Asparagine synthase
MADWLLVTGREAGKLSDRRLGNKCVGVPVEEPVLDMFTTKTNTGELHRWRLVEIDADLSDLVFETSHVMSLINPANTYMDLNIGIALWLAAGGDGWVSDANTYDNDGNHVRIKYKSNAKILLVGSGADEQCAGYGRHRTSYRRGSWLGLHEEMRLDMQRIWRRNLGRDDRCIADNGKEARFPFLDEDVIRLLLNIPLWEVANLDQPSGIGDKRILREVAELLGLYEAAVLPKRAIQNTVVPFVQQFKFYTLLVHLCTGTILPFPFMLDVNRVLLLLGCIEELKFWFKNCKGIKSEEFWKQSSSKSGIGWQRNDS

SEQ ID NO: 110474 - protein, 170 aa, Glycine max
  Coding DNA Sequence Number=SeqID_18789
MTKENHFATKGDIKKALLLKQSFYLLLPRETSLSTAIPLELEVIPQVKELLDKCLVRKSLTPCALLVPKISIMRHRIPMIGGMMNVLSGTTLFYKITHASNTFMIDIHRDSLGSDQVVPTNPKRIKFIPEWPTLPSVEGRCLEFQEPLDLRSNPFQGGGNDAILPPKCIR

SEQ ID NO: 110475 - protein, 82 aa, Glycine max
  Coding DNA Sequence Number=SeqID_18790
MPFCGHARARLTGALSKGGKMRGVATNVYLWKTSEKPKETGLWEFYGSITGVLETLKSYFSTKRGVWWPPSSPRRAQLDKAS

SEQ ID NO: 110476 - protein, 48 aa, Glycine max
  Coding DNA Sequence Number=SeqID_18791
VEEKSPEFQESRDLRSNPFQGRGNDAILPARALDRRLQEDWAKIKRRP

SEQ ID NO: 110477 - protein, 110 aa, Glycine max
  Coding DNA Sequence Number=SeqID_18792
EDEYTDFQEEIARRRWMPLVTPMAKFDPEIVLEFYANAWPTERECETCARGKANSMSLARGGTGPTGSMRRPLPSCYAHRGRISPGLQQEGGCGSCAPNVDDTAAQQYLA

SEQ ID NO: 110478 - protein, 105 aa, Glycine max
  Coding DNA Sequence Number=SeqID_18793
  Subcellular localization annotation: CTP_CleavageSite=83; ConfidenceScore=5.43e-01
MSPDFTGQDAIMVQKMMLVFRGVNGLVSPGNPACTRLHGSGRQKVQRTMLVSARQRARLPLGLTKGAGNHNGNPAYHLTSLVRTTKGAEDDVSRLDSSTGSFAPG

SEQ ID NO: 110479 - protein, 328 aa, Glycine max
  Coding DNA Sequence Number=SeqID_18794
MAHGCQETRLRFRGLFGVGLGRSQGLGLRTRLADIHPVTTPGHRTCFGRIGMGLAAHPARAGTFRSQPEFQNERCELARRLLDRMQDVLAVVFLDALQQARCILFGLLPADSEQRLQVTGNEREAEGSVCRTARLIDHGGQVVGDFGQALFQMTSPGHLAAQPPMPDGVHQQRSEQHQQQRHAPARHAGPVEPVAIFDGQPVAAQGLALAWGHLQQQAVESSGQGGMAALDSQHQLIVEASRCGHLQAPREAAAQQMVNHGQIAYIGIGVAIDQALQGLFRAARRDDPGLRCLLQHIATHTLRIGQQHPPALQVGQAQQRRAVTLGIL

SEQ ID NO: 110480 - protein, 221 aa, Glycine max
  Coding DNA Sequence Number=SeqID_18795
MEEGVRDMRSWVRGQWIPFDADAIGQLLRYSLVLEEGQECEYGQRRNRSDGFDEEAIAQLLCIPGQDFARTAAGRRVRIMRTNMTTLPQIWMTLLLSNILPTDHNSDLPLPKCQLVYAILTRMSIHVAQLIADAIYIFAGMAPIRHPLDPDKSNRALGFPALITGLCQSFGVPVAPTKVIRPPITRAFIEKYCTQRQAQGGCSTGRGRATTTSSGWPGWVI

SEQ ID NO: 110481 - protein, 116 aa, Glycine max
  Coding DNA Sequence Number=SeqID_18796
MEVKQNFAQVQKNACVWLAVESLVQNEFWMFASISQRSKCRLIHYRLPLERIDGDPVLRETRIWATWEYVSSVGGGQQGMVGLCAHCGCGSLLCTIARPLPSTTCDGVPHNSTGLR

SEQ ID NO: 110482 - protein, 327 aa, Glycine max
  Coding DNA Sequence Number=SeqID_18797
  Gene Ontology: Mol. function=transmembrane receptor activity; Cellular component=membrane; Biological process=signal transduction
  Homolog annotation: Hit_ID=Q9F5N1; Match level="QueryCoverage=95%, HitCoverage=44%, E-value=1e-105, Identity=67%"; Hit description =Methyl-accepting chemotaxis protein McpU
  Pfam annotation: Domain name=DUF745; Domain location=52-230; Score= -109.1; E_value=0.086; Accession=PF05335.4; Description=Protein of unknown function (DUF745)
  Pfam annotation: Domain name=MCPsignal; Domain location=91-313; Score= 294.2; E_value=2.5e-85; Accession=PF00015.12; Description=Methyl -accepting chemotaxis protein (MCP) signaling domain
  Pfam module annotation: Pfam domain module=DUF745::MCPsignal; Domain location=52-230::91-313
STLEDPPKDAADTQFAVDQLAKGLDRLADGDIAYRIETPFVAHLDTLRNNFNGSVANLNDALRAVGENARGIDAGANEIRSAADDLSKRTEQQAASVEETAAALEEITTTVKDSSNRAEEVGHLVARARDGAEKSGAVVRQAVTAMNEIERSSGEITNIISVIDEIAFQTNLLALNAGVEAARAGEAGKGFAVVAQEVRELAQRSAKAAKEIKALITTSGEHVRSGVTLVGETGRALEVIVTEVQEINRHIAAIVESSREQSVGLQEINTAVNTMDQGTQQNAAMVEQSTAASHSLAKEAASLNQLLSRFNLADGTSTSRSSVAPAA

SEQ ID NO: 110483 - protein, 121 aa, Glycine max
  Coding DNA Sequence Number=SeqID_18798
  Homolog annotation: Hit_ID=A5AJA0; Match level="QueryCoverage=66%, HitCoverage=19%, E-value=2e-23, Identity=56%"; Hit description =Putative uncharacterized protein
  Pfam annotation: Domain name=zf-XS; Domain location=69-109; Score =3.7; E_value=0.077; Accession=PF03470.5; Description=XS zinc finger domain
MGRADPVSCQCKITRTNLTLDRPLRLPTPTIYTFTKIKGRFKFFEKVFAEDGDLRRYYDNNHKEGDFYCLVCGGIGNKVWKRFKDCIGLIQHSTAILRTRRKRAHRAYAQVIYKVVGWDID

SEQ ID NO: 110484 - protein, 119 aa, Glycine max
  Coding DNA Sequence Number=SeqID_18799
  Homolog annotation: Hit_ID=A5AZG1; Match level="QueryCoverage=77%, HitCoverage=29%, E-value=2e-07, Identity=32%"; Hit description =Putative uncharacterized protein
  Pfam annotation: Domain name=zf-CCHC; Domain location=77-94; Score =21.5; E_value=0.00084; Accession=PF00098.14; Description=Zinc knuckle
MKEGIGHILDLTPIGEKMKESLKRKSTSKSYGSHSYPKKDQGQGILGVRPSKPKDDKGKTIEKQSLKASMQEKTNSMKCFKCLGRGHITSQCPTKKTMIMRAKTFIVAKMRLLLHFSSK

SEQ ID NO: 110485 - protein, 220 aa, Glycine max
  Coding DNA Sequence Number=SeqID_18800
  Gene Ontology: Mol. function=tetracycline:hydrogen antiporter activity; Cellular component=integral to membrane; Biological process=response to antibiotic
  Homolog annotation: Hit_ID=Q39AI2; Match level="QueryCoverage=100%, HitCoverage=55%, E-value=1e-51, Identity=50%"; Hit description=Drug resistance transporter Bcr/CflA subfamily
  Pfam annotation: Domain name=MFS_1; Domain location=10-220; Score =8.0; E_value=0.01; Accession=PF07690.7; Description=Major Facilitator Superfamily
MPRLSFILTVAMLSAFGLIASDVYLPAMPSMAREFGVADWQMPQTISFYLLALAIAQLTYGPLSDRNGRRPVLLAGIGLYIVGSVGCALSDSYNGFLAWRMLEAVGAAAGLVVGRALIADTCDKRACAKVYAVIYPLVSLSPALAPALGGHLAAAFGWRADFLFVVAFGVVALLMVMTLLPETLPVAARTRTSPFAGFSHVLRDRTFRRYTLVVCAIYCA

SEQ ID NO: 110486 - protein, 31 aa, Glycine max
  Coding DNA Sequence Number=SeqID_18801
MEPTTWSSPASAPDRVCKLTIKKENHVSNDV

SEQ ID NO: 110487 - protein, 86 aa, Glycine max
  Coding DNA Sequence Number=SeqID_18802
  Subcellular localization annotation: CTP_CleavageSite=36; ConfidenceScore=5.06e-01
MRLSHEVLKVTVELSSSLSSARLSAQLALSSNPLTRAKREGSAKREGSAKHNGTMPKAQNSTAHHSAYFGKRALEPARGAAFGEIP

SEQ ID NO: 110488 - protein, 71 aa, Glycine max
  Coding DNA Sequence Number=SeqID_18803
MPQQPMLFCEVFDVWGLEYLKQLLVIKEPIFATGQCMPCLKSTGWCTGYPHHTTPRPMDRQKFLTGKSSEF

SEQ ID NO: 110489 - protein, 220 aa, Glycine max
  Coding DNA Sequence Number=SeqID_18804
LNAFLETPVVLAEGESLLAYSRYCRMPTDIREIEAALCIPGRGFILNAEGHPGRILRKDLTTLAQVWSVLSYSNLAPTSHTSDLTVDQARQITSMAQSNSSRLGFLALITALCRTKGVASDSLVFERLNPVINLTYIRKNCWNPDDPTIIIRGARRPRARPAEAPSTLAAPHLASTSVAPPSARIAIAPSTLAPANFQRFEAMLRSIHQGQIILLQSLQL

SEQ ID NO: 110490 - protein, 166 aa, Glycine max
  Coding DNA Sequence Number=SeqID_18805
MQSQIQSQMQSQGLALPLEPLVGPSGNDHETGDSDRCSLYIKVDPARLVALGRVYEGSTVVHNTPLLPDQVKALHTFLAWPTHLVKSLSQQVAVSPAKPPPKPDPEVDDPLYLMTLTIPKLFLRPYQVTWDATMLGVFNPNFPLYIKHEDLSEIAHGGQCLSISVL

SEQ ID NO: 110491 - protein, 213 aa, Glycine max
  Coding DNA Sequence Number=SeqID_18806
MSHKAQNSSFFILFHLHQLKLPKTPPNGITIEEVKGACDFTRSHWNSKPRNTQSADISNSSLHIISYVVFLGRTTYPFISMKLPFYPELVKSFYSNLEIQEDTLIFKVYGIKMVIDQSLLFELTQLSNDSVPFEGTLDDEWKFDFSVSDARWMVCTNQVDMTRRLLASSLAFECRIMHYLIVHILLPRSSNLAQVSEEDLIIMWVFLTGRQID

SEQ ID NO: 110492 - protein, 100 aa, Glycine max
  Coding DNA Sequence Number=SeqID_18807
  Homolog annotation: Hit_ID=Q2QRT1; Match level="QueryCoverage=42%, HitCoverage=5%, E-value=2e-08, Identity=66%"; Hit description =Retrotransposon protein, putative, Ty3-gypsy subclass
MGSKWTLRKSRPSKNGPLQKVWEILGASMEQAFALLQKKLTKAPDLALPNVSKTFELECDASGVGIGVYCYKVGTLLLILVKNFIVPPSTTPPMIKSFMP

SEQ ID NO: 110493 - protein, 230 aa, Glycine max
  Coding DNA Sequence Number=SeqID_18808
  Homolog annotation: Hit_ID=Q84VI1; Match level="QueryCoverage=100%, HitCoverage=32%, E-value=2e-69, Identity=65%"; Hit description =Envelope-like protein
MDKKIRSIVSSILKDASVPDAEKDVPTSSTLNVSVPDVEKDVPTSSAPNAEVLPSPSEEESSEEEDQATEETPAPRAPEPAPRAPEPAPGDLIDLEEVESDEEPIANRLAPGIAERLQSRKGKTPIKRSGRIKTMAQKKSTPITPTSSRRSKVTIPSKKRKEISSSDSDDDVELDVSTSKKAKKSGKKVPGNVPDAPLDNISFHSIGNVEKWKYVYQRRLAVERELGRDA

SEQ ID NO: 110494 - protein, 154 aa, Glycine max
  Coding DNA Sequence Number=SeqID_18809
  Homolog annotation: Hit_ID=Q84VH5; Match level="QueryCoverage=79%, HitCoverage=18%, E-value=2e-44, Identity=71%"; Hit description =Envelope-like protein
MATSPKETSAPGSPSVPSSPHQEQPEFNIQPIQIIPGQASVPEKLVPRRQQGVKIAEHPSLATSPREVDTEMDKKIRSIVSSILKDASVPDAEKDVPTSSTPDVAVPEADEDVPTSSTPNVSVPDAEKDVPTSSAPNAEALPSPSEEESTEEED

SEQ ID NO: 110495 - protein, 192 aa, Glycine max
  Coding DNA Sequence Number=SeqID_18810
MSSPSEDYTSSPSEDSTSLPSEDYTSSPSEGYAPSPSEGYMSSPSKDFISSPSKDYTSSPSEDYKSSPSEDFTSSPSKDYSSSPSEDYTSSPSEGYAPSPSEGCMSSPLEDYKSSPSEDFTSSPSEDYTSSPSEDYKGLLVLAIRGLHVLTFRRLHALAFRGRHVLAFGGLHTPSPLEGYAPSLLEGSTSAP

SEQ ID NO: 110496 - protein, 70 aa, Glycine max
  Coding DNA Sequence Number=SeqID_18811
MVRIREEACRNLPFGKRAMRDSRVRVPRKEYARSRHQRLFEESVGKTGKDVIYEFFVKGCFPLLLRIPQL

SEQ ID NO: 110497 - protein, 79 aa, Glycine max
  Coding DNA Sequence Number=SeqID_18812
MLAAAAVAALLSINLFIPSVATYLSAGGRRETHGMRVPRKEYARSRHQRLFEENVGKTGKDAIYELLSERFGSCIYARG

SEQ ID NO: 110498 - protein, 42 aa, Glycine max
  Coding DNA Sequence Number=SeqID_18813
MKMLLIPHDVSSIGASESRRKRERRRHFKEMSLEEAHHHRRP

SEQ ID NO: 110499 - protein, 165 aa, Glycine max
  Coding DNA Sequence Number=SeqID_18814
  Homolog annotation: Hit_ID=B0HC01; Match level="QueryCoverage=19%, HitCoverage=68%, E-value=4e-10, Identity=100%"; Hit description =Putative uncharacterized protein
MEKRQQRGLFTVLAFCWPFAHMFFLRYPLILWITVLPPLSELIPLAAAERPSAASHWHDRFPDWKAGSERNAINETAMTMITNSSSVPFLKQSSELMFTGEHVVGEVVAGEVVAGEGEVLEVLPGAALRRDLAEEEVVVEVKVTEEEHGSDRERNFQIQSHKDRI

SEQ ID NO: 110500 - protein, 245 aa, Glycine max
  Coding DNA Sequence Number=SeqID_18815
RTVIIVIKRKECVLRCPYQTRAKARVMSEIEEVQEQMKADMEAMKEQMTTMMEAVMSMRKMMEVNTATVVVASTTTGLDPTHPSSIKQASHPVPDMNKHSFPPYGLSPNYTPPNVVHTHNFAPIPIESQQPQFGQAHVSQPMEETHEAPRDHNLVNFEPHLGYAAEGQAFCSVPLTNTLGGPQYRPQPQTLHFEVGRAPSAMVERERFDHIEERLRAIEGGGDYAFADMAELCLVPDVVILSEVQ

SEQ ID NO: 110501 - protein, 186 aa, Glycine max
  Coding DNA Sequence Number=SeqID_18816
  Homolog annotation: Hit_ID=A6FJQ2; Match level="QueryCoverage=20%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFATDYKIKSIGGMCILIQMWAWERCTTLAPKRTPPVIQNKPLGHRWLQRGNQHIENDDLIVFRRKLDIMKRHEFLWEPYTATVMSSLPPICLVGSV

SEQ ID NO: 110502 - protein, 218 aa, Glycine max
  Coding DNA Sequence Number=SeqID_18817
  Homolog annotation: Hit_ID=Q1RU80; Match level="QueryCoverage=49%, HitCoverage=83%, E-value=1e-12, Identity=38%"; Hit description =Putative uncharacterized protein
MGELTSTLDDVSSILHLPVVGDLHVFQPLHVDDAVQMLVDLLMVSAETARAKTGQCHGPYVLRDLSQTGRYAWGVTTLVHMYDQLNDASISSSRQLDGYITLLQCWIYEHSPSVAESTADQDYDEDSPRACRYCNEEDREEHTYSVVQGAPGSTPDSGCLLDPIWGALTGPGLAFDFMLFWSPALGSCCCLLPTREGRAVVWIHTDHSCSACRFMGVI

SEQ ID NO: 110503 - protein, 54 aa, Glycine max
  Coding DNA Sequence Number=SeqID_18818
MEMAGQVRAVPPTVVAGQGERECVGTANSGCGTGGERGLYVFLKSLHTYVHVNE

SEQ ID NO: 110504 - protein, 223 aa, Glycine max
  Coding DNA Sequence Number=SeqID_18819
ASALLTFNCTGSDCENSPCFSWRKRQLEPLRAYMYCSADAHRAQAPRQQCRVDQVGDAQRQVEAFGHQVRDAERHGRGQADLAAQAGGLFRDLGLDRFAFFEDAGGALQRGVAGFGQGHAARGAVKQHGLHLGFQPRDGLGPWPGTRTIAQPSRSGSLFMMILAKKVAWMIAAGYVTNKNARGRPGRKQPGHGDHAKNGKDAIPRCGLSGEGRIHNMPIPTDD

SEQ ID NO: 110505 - protein, 379 aa, Glycine max
  Coding DNA Sequence Number=SeqID_18820
  Gene Ontology: Mol. function=transcription factor activity; Biological process=regulation of transcription, DNA-dependent
  Homolog annotation: Hit_ID=A3TG14; Match level="QueryCoverage=39%, HitCoverage=75%, E-value=1e-18, Identity=41%"; Hit description =Putative RNA polymerase ECF-subfamily sigma factor
  Pfam annotation: Domain name=Sigma70_r2; Domain location=226-294; Score=42.0; E_value=2.1e-09; Accession=PF04542.5; Description=Sigma -70 region 2
  Pfam annotation: Domain name=Sigma70_r4; Domain location=323-372; Score=7.7; E_value=0.047; Accession=PF04545.7; Description=Sigma-70, region 4
  Pfam annotation: Domain name=Sigma70_r4_2; Domain location=317-372; Score=28.4; E_value=2.7e-05; Accession=PF08281.3; Description=Sigma -70, region 4
  Pfam module annotation: Pfam domain module=Sigma70_r2::Sigma70 _r4::Sigma70_r4_2; Domain location=226-294::323-372::317-372
DILGAAYAAAVLSALRVWAERGAGRGTPETVLQEALGLIHDLPWAGSIGRPAGRIGTAACHDPGRRYACDARRGQGRSAAPGEGLASGGVERIARSPARLDNPDRSYTYTSPTWGQCEIRYSGWDTHNPLTQPQVDRIIDDWFANTDVEAAAAPYVAEHLAAIESDQAASDEPTADPRTPDLNAWFAHDQALSEALHEELKANGIDTGRGWHAVSRRSEDAALIAAVEASATDLLAYLSRRVGPDDAADLLGETMVIAWRRVRRLPGDPEGARMWLFGVARGTLLNHARGERRRWALADRIRSRSAEGLTSAPADAGAEVRDAIARLDPVLAELVRLVHWDGFSLTDAARLLGIPASTARGRYQKAKPSSRCAEHGGSL

SEQ ID NO: 110506 - protein, 104 aa, Glycine max
  Coding DNA Sequence Number=SeqID_18821
MPKKKGKYGEGMNEKVKVILWMNALLEPKLLNPRKTINCWQPNPITSLESPSDFSFLTISIGFDDKIYPSEKEAKPNLSQIWGRYYQGMKAKCLRKRAVWRRNE

SEQ ID NO: 110507 - protein, 239 aa, Glycine max
  Coding DNA Sequence Number=SeqID_18822
GSGTVLQPAINLGRDRNTTGFNRRYSPQAYPYGLPPDFIPRTGLDDLSQVPTFEGQLPPHADYPLQEDDEGDAHLGPLLPLKEPAPHELPQPNIVRHVPSPSTPVKELIPIAKDKGKIDLLEERLRAVEGLGNYSFSDLADLCLVERPTAQVVPPKTEREMITIMVDTLPTFYYEKLIGYMPANFADLVFTGERIESGLRKGKFEYASNAAQTTIEEPQWWAHGKRKEIPTRSPPPQHG

SEQ ID NO: 110508 - protein, 116 aa, Glycine max
  Coding DNA Sequence Number=SeqID_18823
  Gene Ontology: Mol. function=intramolecular transferase activity, phosphotransferases
  Homolog annotation: Hit_ID=A7PHN3; Match level="QueryCoverage=78%, HitCoverage=19%, E-value=2e-25, Identity=65%"; Hit description =Chromosome chr17 scaffold_16, whole genome shotgun sequence
MCLCYCHHLFAKAIINSLYVLGIPLIRYAAEDRCGVVVKGANQSGNIAGTCPLKDNDILLTTRALDDSNEVRNTIAVVNELSKEMRQILLSHPANPKCAPGGKNIASVVLLGDSGI

SEQ ID NO: 110509 - protein, 67 aa, Glycine max
  Coding DNA Sequence Number=SeqID_18824
  Homolog annotation: Hit_ID=A6FJQ2; Match level="QueryCoverage=56%, HitCoverage=84%, E-value=3e-11, Identity=92%"; Hit description=50S ribosomal protein L5
MQLRRRSQLSMRKEKIPHQAPFAIQAAQLLGRAIGAGLFAITPAGERGMCCKAIKLGNARVFPVTTL

SEQ ID NO: 110510 - protein, 20 aa, Glycine max
  Coding DNA Sequence Number=SeqID_18825
IKTGGVTSKKARKIEEKKKI

SEQ ID NO: 110511 - protein, 139 aa, Glycine max
  Coding DNA Sequence Number=SeqID_18826
MSLPSAVHVFSIIKCEASDDWEARYSVVFQIGSFAKYKKKEEVEMTVVIAKRAGRTKSVSYLCFPLISDESPEMSQKSKGSRLARSVKFRNVAEVEKRGVQIATRPTWALQKIPPEGCCFWRKQPWSPGRAGRQASPLF

SEQ ID NO: 110512 - protein, 37 aa, Glycine max
  Coding DNA Sequence Number=SeqID_18827
MNWQNNEYKGCGGGGGEEENLVPNYTTYENSFAEEYP

SEQ ID NO: 110513 - protein, 109 aa, Glycine max
  Coding DNA Sequence Number=SeqID_18828
  Subcellular localization annotation: CTP_CleavageSite=70; ConfidenceScore=5.39e-01
GGNPARLGELSDNLLPPFPINRQREAVPNGFPPFFTVLHPFFVRSSFFNRSFLLSAPGLAPDPGGGPSMREQPEEEAIAQLLCIPGQDFTRAAAKRRVQIMHTNMITLT

SEQ ID NO: 110514 - protein, 32 aa, Glycine max
  Coding DNA Sequence Number=SeqID_18829
EKMKNKKVAVASVSLNEVYALSEQHPLSKALA

SEQ ID NO: 110515 - protein, 134 aa, Glycine max
  Coding DNA Sequence Number=SeqID_18830
  Subcellular localization annotation: CTP_CleavageSite=67; ConfidenceScore=5.31e-01
MDDPTITFPGTPPPPSASVPAPSGTSAQSSELTVPMLQSLHHGLCLVMQSIHNLAQHRPIISMEDFTAQVAWLGVQPSPLGGSEASAAQEPQPQPEATPETTPRFTSHYTGLGGLRGGGWRCRHRLCSRHGSST

SEQ ID NO: 110516 - protein, 59 aa, Glycine max
  Coding DNA Sequence Number=SeqID_18831
MRLLLHLPLVKVKTQKGKNIVKKSTHKKKDNLKWLRRSVRRRIISNWAWIRNWAEPAWT

SEQ ID NO: 110517 - protein, 245 aa, Glycine max
  Coding DNA Sequence Number=SeqID_18832
  Subcellular localization annotation: CTP_CleavageSite=44; ConfidenceScore=5.21e-01
MTPVRKYNSRTFHLKVRRSRLFRFFRRFPQINVGGNSARIPFVEHASRESRVALPPKGLMDLAVIDAFLSFHHGKESPVVGILTDMYDTFDQRCEKSGARIICCTSTLYVWLVSHLFRHEGRPVCSLQGYCSCAEKGKANWDQLLASMEGASVNWFPRWKEGRTENLSSCEGFQNLGYPMRGAPSEESIVPFIAWGFNDPNARVLQGVRKAWDAVPRMDKELRGNSNGIIGGYRKWLRVHTRGLD

SEQ ID NO: 110518 - protein, 68 aa, Glycine max
  Coding DNA Sequence Number=SeqID_18833
  Homolog annotation: Hit_ID=O64438; Match level="QueryCoverage=54%, HitCoverage=15%, E-value=7e-12, Identity=83%"; Hit description=ARG10
MFCLFQHITRCFYSTVVGGLRCYENPKNKITAIRAEEEKIWGSFFKVILELKKLDLNIHYVTRIASCN

SEQ ID NO: 110519 - protein, 62 aa, Glycine max
  Coding DNA Sequence Number=SeqID_18834
VVRRSAWNVCKLLTSSASLGKVEGVYPKCWLVVAKERPLLVIKDGIVIGLTFEVLGFVLIWR

SEQ ID NO: 110520 - protein, 74 aa, Glycine max
  Coding DNA Sequence Number=SeqID_18835
  Homolog annotation: Hit_ID=UPI0000ECBAF8; Match level="QueryCoverage =55%, HitCoverage=48%, E-value=1e-16, Identity=100%"; Hit description= UPI0000ECBAF8 related cluster
MNSMKNGIKGATGTNTKSRPAGMQAWHWPSFYNVVTGKTLALPNLIALQHIPLSPAGVIAKRPAPIALPNSCAA

SEQ ID NO: 110521 - protein, 27 aa, Glycine max
  Coding DNA Sequence Number=SeqID_18836
GREWRIALSNHYAWLQTRGWRMHEREN

SEQ ID NO: 110522 - protein, 148 aa, Glycine max
  Coding DNA Sequence Number=SeqID_18837
VDSRGSPGSSNGIISGYHKWLRVRTQGLDWLPNLNTVRDDEVKASEESDEVQALKAVLERARVVEEKFKSIAIKAIIDKCKEKLNLAATHEQRLEDEYAKISAEREESRTSPISSQGQSNGGHLLRPQGDPRTSLLLSAYDRLNGPYD

SEQ ID NO: 110523 - protein, 102 aa, Glycine max
  Coding DNA Sequence Number=SeqID_18838
  Subcellular localization annotation: CTP_CleavageSite=38; ConfidenceScore=5.73e-01
MATQSNSPPPPPPSTGVASHSSSPPLKRTRKASRLRLLATRPVGAERPLVHVDPVTGKTDGPHSKKFRTYLGIVARDKVDVTYENWKHVPITQKDLIWEDIQ

SEQ ID NO: 110524 - protein, 169 aa, Glycine max
  Coding DNA Sequence Number=SeqID_18839
  Pfam annotation: Domain name=MEA1; Domain location=1-162; Score= -38.3; E_value=0.04; Accession=PF06910.2; Description=Male enhanced antigen 1 (MEA1)
  Subcellular localization annotation: CTP_CleavageSite=40; ConfidenceScore=5.34e-01
MEKGNVGGNRGGPIRSYSSSRTVTWDLGNKGTTAKTRETNSSSESNSVKSTGAYRGRPFSRLSNAEFQERVEKGLCYRCDGKFGLGHICPNNQFQDLILGEGQDGEDEKEEGARNEKQLQIVKQQQIPITPTKPYTVEVGDGRKISVKESARILNCRSKAWKSSRLICL

SEQ ID NO: 110525 - protein, 114 aa, Glycine max
  Coding DNA Sequence Number=SeqID_18840
MTKIQGLKEEKIYSNIYKEERTQPWSTGSEIYPGIHENPKAFFRSSSPILLESSIQYPCGVGLHHNFSLGCPILAHHISRISKLNNGSSREIQMIITFNSDVRFRRIPYRDARN

SEQ ID NO: 110526 - protein, 139 aa, Glycine max
  Coding DNA Sequence Number=SeqID_18841
MAQPKPSAGLRENLTNMLSLIMPSCISINKSLSPLILSHVLAFNLVLASCPHPKNGKNTIKAFHRALGGRTFGYQQQENGGNVACPIILEHNLGLRPSPTTPQFKKAKHKFAPNCLTELVKLCTIQSIKGINGKLETKG

SEQ ID NO: 110527 - protein, 217 aa, Glycine max
  Coding DNA Sequence Number=SeqID_18842
  Pfam annotation: Domain name=Transposase_23; Domain location=151-214; Score=-12.5; E_value=0.028; Accession=PF03017.5; Description =TNP1ENSPM transposase
MCLMHATLEEQTRQGTFVPYGREDILSTAIRRPDHGGRARAAGSGVTISQYFGRAARGSSCSSGLISQVQLDEIIGGLQEQWKNEILVLKDELKEQIILEMSQRGSLIPTHIQLDTHVLGARVSTKGSNAEIVVNPCLPNDVAPVKPPMGLYVQRQDSIELVALGKTYDRGSTIHNVAYADDVIRVSVEQVIDGDAEVPFPTLEIKCVRQALHTFIA

SEQ ID NO: 110528 - protein, 117 aa, Glycine max
  Coding DNA Sequence Number=SeqID_18843
  Homolog annotation: Hit_ID=A7QGE6; Match level="QueryCoverage=70%, HitCoverage=13%, E-value=4e-32, Identity=79%"; Hit description =Chromosome undetermined scaffold_91, whole genome shotgun sequence
MQPYIAALKFCHLTGNVNQTACVLDIKCSPVEPIFVSAAASGGAGSNYIDNLGFASLTVWNMKTWKAMTVLPLGEDPPAITSLCFNHNGKILAASAVDGMIHMFGILNFVHLIVSLV

SEQ ID NO: 110529 - protein, 191 aa, Glycine max
  Coding DNA Sequence Number=SeqID_18844
  Homolog annotation: Hit_ID=Q5CDC4; Match level="QueryCoverage=14%, HitCoverage=21%, E-value=2e-07, Identity=100%"; Hit description =LacOPZ-alpha peptide from pUC9
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPGGQHETHGSIFQGRGTELEFVIMVIAVSCVKLLSAHNSTQHTSRKHKV

SEQ ID NO: 110530 - protein, 91 aa, Glycine max
  Coding DNA Sequence Number=SeqID_18845
MNEDQWAYYSAMSEEVDMDFQDEEDCGVNEAHVDCSDAFNSSQVFATREDVLKWARTVAHENGFVAVIMRSDTYTGNRGRTLFVLIGCERS

SEQ ID NO: 110531 - protein, 80 aa, Glycine max
  Coding DNA Sequence Number=SeqID_18846
  Homolog annotation: Hit_ID=A2Q2J0; Match level="QueryCoverage=47%, HitCoverage=3%, E-value=9e-09, Identity=71%"; Hit description=RNA -directed DNA polymerase (Reverse transcriptase); Ribonuclease H
MVDTLATLASMFQLTPHGDLPYIEFRCHGRPTYCCLVKEEQNGPFVVKKAFSGEALVLTNMDDEELPSPVNANVVKRYYA

SEQ ID NO: 110532 - protein, 42 aa, Glycine max
  Coding DNA Sequence Number=SeqID_18847
MPSFRDLEQKWAPKVEALLGNNGGGRKEKATFSASVGASFRK

SEQ ID NO: 110533 - protein, 215 aa, Glycine max
  Coding DNA Sequence Number=SeqID_18848
MFQEDGPNVKTNPLAIHGGPAVNAVEECGPRRPKQMKVVTSRRFILKTLCEVGIICFDGGKGDTCFIQSGAAHEVETCPVAEDLLQGIMDQGRFEVGGTSKGEQHVCMQSVDKSPSKPKPLVIHFTRDAATQKPQGFQPIPGKKPIHFPYKSDKAVPWRYAPQKPDGRKDESIGDDLSSTKVTNISGMSSMTRSGQIFVAPDPLVQSKDTKGKAK

SEQ ID NO: 110534 - protein, 173 aa, Glycine max
  Coding DNA Sequence Number=SeqID_18849
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
  Subcellular localization annotation: CTP_CleavageSite=63; ConfidenceScore=5.19e-01
GAELWKNASNAAFLRFWPFAGFCSHVLSALSPDSVDNRITAFEKRKSAQYANRLSPRVGRFINAAGTTADNNFTQETAMTMITNSSSVPLCDKDKGLWWVEGDTLKTGSQQMGSVTSRPAGMQAWHWPSFYNVVTGKTLALPNLIALQHIPLSPAGVIAKRPAPIALPNSCAA

SEQ ID NO: 110535 - protein, 203 aa, Glycine max
  Coding DNA Sequence Number=SeqID_18850
MKSSINTSMQFSKKSLKILIMHLWKVPGALHGIGKSAKGAGECGLFLILRSNSDFHITRKTIKETIVRFTCQAFKHMVNEWQGKMVLFGNLVQPPIIDADSLTVLHPSRNQLLLLIFYEGKAGFLRDYRDETHPLAIGDTINDSNLQKLGYLLLHYIKNHRAVGSVFLFPCMAIYRKSHLVQGKLAQASCLLRAEACPGEWLA

SEQ ID NO: 110536 - protein, 249 aa, Glycine max
  Coding DNA Sequence Number=SeqID_18851
MEETHGMPHRNLADFEPCLGYATEGQAVGGIPLQNTLEGPQCHPQPQPSHSTVVKNPPCYGKNGKEERLRAIEGGKDYAFANLEELFLVPNIITPPKFKVLDFDKYKGTTCPKNHPKIIGTILIWFRIGCNYRTCAKRETIIVMVDTLSVFYYGKWWATHLQSFEDLVFASERIDVGPKRGKFDHPTRTTEKTGANKEGEKEGETHAVTAIPIQPSFPPTQQCHYSANNHPSPYPPPSYPQWPSLNQPQ

SEQ ID NO: 110537 - protein, 29 aa, Glycine max
  Coding DNA Sequence Number=SeqID_18852
ETINLHGNDSSFWATQLLMVVSSTDWVSN

SEQ ID NO: 110538 - protein, 187 aa, Glycine max
  Coding DNA Sequence Number=SeqID_18853
KTFLSQKLLKAVEKWEEDKKCQGQSFVNNETDSDDTDKGDEYIFRQKLFSTIDKENSDTDSTEDLLEKIDLQEFYEKEINFNNALEINSKIDETKSLVSFPKSYKGLMADAFGTSSNFTPQFDYSMEDYQMRFAPREKIIAPEDLALGDNIKSKGKRLPIEPTFNMSSLLLNIGSVNPQLLPNYIEQ

SEQ ID NO: 110539 - protein, 202 aa, Glycine max
  Coding DNA Sequence Number=SeqID_18854
  Gene Ontology: Mol. function=protein transporter activity; Cellular component=type II protein secretion system complex; Biological process=protein secretion by the type II secretion system
  Homolog annotation: Hit_ID=A0U211; Match level="QueryCoverage=93%, HitCoverage=81%, E-value=1e-84, Identity=85%"; Hit description =Prepilin-type cleavage/methylation
MIAIAILAVVAILAWRGLDQIMRGRDKVASAMEDERVFAQMFDQMRIDARRAATDDEAGQPAIGVAGNTLQIVREFDVPGAAPRLQVVRYRIAGGRVVRYASPPIDDANRLHDVLKDSSVDGWSRVALMGGVGAIDAKLYVPRVGWTTNLQTANDALAQNNDALKVPQIGNAPPARAVTGLQVSIGATSLRVPVTRIFLVGE

SEQ ID NO: 110540 - protein, 87 aa, Glycine max
  Coding DNA Sequence Number=SeqID_18855
MSQDHKVEEDVTIIRDCLDLLRHHHQIVIIKKGEIVEAMTSKVILMMPKNHELSKFHRFKNQVSRIKIQEFKIQEFKNQVSRIKIQE

SEQ ID NO: 110541 - protein, 95 aa, Glycine max
  Coding DNA Sequence Number=SeqID_18856
  Subcellular localization annotation: CTP_CleavageSite=53; ConfidenceScore=5.74e-01
MGKEKQTAETSGRPVRGSSGSSGRTFSGKFPRRSGSARLPEFFPMNHFFRKTPGKTSSGNFPEEVVHPEEFRKTRTSGRSFKFPEDLSGRTPSSG

SEQ ID NO: 110542 - protein, 169 aa, Glycine max
  Coding DNA Sequence Number=SeqID_18857
  Gene Ontology: Mol. function=RNA-directed DNA polymerase activity; Biological process=RNA-dependent DNA replication
  Homolog annotation: Hit_ID=A5B6M9; Match level="QueryCoverage=35%, HitCoverage=14%, E-value=5e-09, Identity=45%"; Hit description =Putative uncharacterized protein
MSHHSSSVNGEGTSHKDPLSRILDELSSLKLWKEKLERKEKGKERVEINQDEREQIRKEERRKIMKEMKREKHVSYSSHDSCKSLSEELSNYYRGHHSSHTKHHSQIKETDRRPQEVNISLPYFHGKDNVEAYLDWEMKVEQLFVCHHINEERKVPLATHSFQGYALYW

SEQ ID NO: 110543 - protein, 51 aa, Glycine max
  Coding DNA Sequence Number=SeqID_18858
MCNWMHCTLAQIAISNQWKGYLAKISYKAPAESCMTEKRSHLSHARGVRQL

SEQ ID NO: 110544 - protein, 115 aa, Glycine max
  Coding DNA Sequence Number=SeqID_18859
  Homolog annotation: Hit_ID=A8P6U5; Match level="QueryCoverage=21%, HitCoverage=40%, E-value=2e-07, Identity=96%"; Hit description =Putative uncharacterized protein
MPPTVPVNHYSDPEGQHNRIRILWCYPMLMYTERRLALSTLISSKITAAAGTRLALQWILVKGFRLYSFQLPDSMSPVLLFIVTTSPCQDWVICAPAAFLGCGSRFSGSLSGIEP

SEQ ID NO: 110545 - protein, 116 aa, Glycine max
  Coding DNA Sequence Number=SeqID_18860
MEAMMSMKKIMEVNAAAIAATNTIAKVYLTPPYGLNQINPSTSDMVGLEGEELEGTGGPHLVRKTSMPSHHMACLPTIHHPMWRTLPMRMSMTPLPYSLRADNLIMYMSLNPWGDT

SEQ ID NO: 110546 - protein, 139 aa, Glycine max
  Coding DNA Sequence Number=SeqID_18861
  Homolog annotation: Hit_ID=A6FJQ2; Match level="QueryCoverage=27%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPTSFYKKASGWKPHHSPTPLGSPFTISSDSEDSSDEFLRKLDEEAAKQRGRKM

SEQ ID NO: 110547 - protein, 219 aa, Glycine max
  Coding DNA Sequence Number=SeqID_18862
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=Q67GW6; Match level="QueryCoverage=55%, HitCoverage=29%, E-value=2e-66, Identity=98%"; Hit description =Photosystem II CP43 protein
  Pfam annotation: Domain name=PSII; Domain location=102-219; Score= -167.6; E_value=0.001; Accession=PF00421.10; Description=Photosystem II protein
  Subcellular localization annotation: CTP_CleavageSite=55; ConfidenceScore=5.09e-01
MVTANRFWSQIFGVAFSNKRWLHFFMLFVPVTGLWMSALGVVGLALNLRAYDFVSQEIRAAEDPEFETFYTKNILLNEGIRAWMAAQDQPHENLIFPEEETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFG

SEQ ID NO: 110548 - protein, 94 aa, Glycine max
  Coding DNA Sequence Number=SeqID_18863
MGSSLAYDNGIWGEPYRLFAAKFLFVGVFLACAKGIAFVDNWVVGKEEVCYWLSKDIVGFGGKLGRTGMAVTAWVSPSSSPSLFAPVFSVVLVG

SEQ ID NO: 110549 - protein, 155 aa, Glycine max
  Coding DNA Sequence Number=SeqID_18864
  Homolog annotation: Hit_ID=A0ST23; Match level="QueryCoverage=29%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPHGHKDILNTSMGTELEFVIMVIAVSFGKPVVPAALMNRPTRGERRFAYWALFRFLAH

SEQ ID NO: 110550 - protein, 47 aa, Glycine max
  Coding DNA Sequence Number=SeqID_18865
PFTKRKPRAKRIPVHELSHESHTLSAQPLHLRLIHSAKLAMAKLSLI

SEQ ID NO: 110551 - protein, 115 aa, Glycine max
  Coding DNA Sequence Number=SeqID_18866
MNSWGSRLNGGGGMNSASQTIHGAPDSMVEDARTRLAINSWGSGLDGGGCMNDNQLMGLRIRFDGGGCMNGNQLMELRIRFNGGGCTNSAWQSIRGATNSMVEDALTTINSWGSE

SEQ ID NO: 110552 - protein, 180 aa, Glycine max
  Coding DNA Sequence Number=SeqID_18867
  Gene Ontology: Mol. function=transporter activity; Cellular component= membrane; Biological process=transport
  Homolog annotation: Hit_ID=A1B6F1; Match level="QueryCoverage=64%, HitCoverage=34%, E-value=1e-16, Identity=39%"; Hit description =Transport system permease protein precursor
  Pfam annotation: Domain name=FecCD; Domain location=14-176; Score= -156.9; E_value=0.00022; Accession=PF01032.9; Description=FecCD transport family
MTSKITLIFAAALLLAAILIFDLVVMAAEMPLAEIAATLWRGEADTYQQSVLLYQQIPRSLIAIYVGATTAVSGCVLQGLVRNPLASPATLGLNTGATLFVIAGALVFDFSPEVQGLAALAGAGFGFAACFFVARLAGRSNDPRGSVAHSCRCAGFDAADRRDQCPASLQPLTPRRIPDL

SEQ ID NO: 110553 - protein, 60 aa, Glycine max
  Coding DNA Sequence Number=SeqID_18868
  Subcellular localization annotation: CTP_CleavageSite=29; ConfidenceScore=5.09e-01
MSRRSSTRQFPSRKSGGHGRTKSDPLGASSSHIATTWPSSPRPALIKLLLIWQGGLPSSS

SEQ ID NO: 110554 - protein, 82 aa, Glycine max
  Coding DNA Sequence Number=SeqID_18869
QVIEVTSSEEDPKEDPEELPPEPAVDALDFLEGDEDPLLEVDSPEDAMSASEEDSTEESGPGEMATSGGSSSYRYSGYLCSG

SEQ ID NO: 110555 - protein, 168 aa, Glycine max
  Coding DNA Sequence Number=SeqID_18870
DIYSSQDEATTSPSSSESEEAKGEKSSEEIYPQEEGQPLVVKEKCKEVSVSSNSLAKKETHFTIKTNINETFPLRQPPHFLFCKKTLASIATPLGLEFIPQVKKLLEWAQNSDQGVPMNPKRIKVILEWPTPPSVEGRSPKYEEPRDLRSNPFQGGGNEAILPRKGIG

SEQ ID NO: 110556 - protein, 53 aa, Glycine max
  Coding DNA Sequence Number=SeqID_18871
MKQKASEARLMGALSKGGKMRGVTTSVYLWKMSEKPKETGQNENSKFGSCIYV

SEQ ID NO: 110557 - protein, 137 aa, Glycine max
  Coding DNA Sequence Number=SeqID_18872
  Gene Ontology: Mol. function=chlorophyll binding; Cellular component =integral to membrane; Biological process=photosynthetic electron transport
  Homolog annotation: Hit_ID=Q2MI75; Match level="QueryCoverage=76%, HitCoverage=27%, E-value=2e-47, Identity=69%"; Hit description =Photosystem II P680 chlorophyll A apoprotein
  Pfam annotation: Domain name=PSII; Domain location=1-137; Score= -207.1; E_value=0.088; Accession=PF00421.10; Description=Photosystem II protein
VDSRGSPGITNSWGGWNITGGTITNPGIWSYEGLYGPGIWVSDPYGLTGRIQSVNPAWGVEGFDPFVPGGVASHHIAAGTLGILAAFVVAGTMWYGSATTPIELFGPTRYQWDQGYFQQEISRVGAGLAENPSLSEA

SEQ ID NO: 110558 - protein, 54 aa, Glycine max
  Coding DNA Sequence Number=SeqID_18873
MENWRTALRNNFAGLQTRWGSEKRGEWRIGEHRYAITSRGSRLDGGGYMNSARQ

SEQ ID NO: 110559 - protein, 129 aa, Glycine max
  Coding DNA Sequence Number=SeqID_18874
MVGYTPSSFADLVFTSEMIEDEKEGETYVVTTILIRPSFPPTQQCHYSANNNPSHYPPPSHPQRALKRKVQGLIDMGWLKFEENRVIFNFHRKWVLAIGLFAQATCAPEFGLPRPFNQRLLVLRVGGAA

SEQ ID NO: 110560 - protein, 113 aa, Glycine max
  Coding DNA Sequence Number=SeqID_18875
MMMKDNYRLKGTLLSFRVFWTSSMDSKPMLVKGLMLWNDKWTCDSMQWTQGSQRIVIIKKEEIVEAMTSKIILMMSKNQELSKFQRFKNQVSRTNKIHIQDSRFKNQEKTQSR

SEQ ID NO: 110561 - protein, 220 aa, Glycine max
  Coding DNA Sequence Number=SeqID_18876
MHEGQGDGRQSRQQDKVCAGGMGAAVCQLHAQPQYQHRQDRRSCRRDKAGAPTGIHVPLRPKKGQWEQGNDGREVAKDRSVDRVQQVESRDEQCRADRQRQQPEAGGCLGRHSPSMQVDHQHRHRHQQCRSQNDPIQAIGVDHRNAQRCEVRILAQQQVGPQTGRDDQQRRCPDTCGQEELIQRELTRYEAAGSIGGGQHKTDRTDPEAQLNCLLESVQA

SEQ ID NO: 110562 - protein, 222 aa, Glycine max
  Coding DNA Sequence Number=SeqID_18877
  Homolog annotation: Hit_ID=UPI0000503967; Match level="QueryCoverage =86%, HitCoverage=82%, E-value=3e-07, Identity=28%"; Hit description =UPI0000503967 related cluster
  Subcellular localization annotation: CTP_CleavageSite=41; ConfidenceScore=5.27e-01
MNYVFVHASSTFEFGAMRSDCSVQFSILNPFSETMNCVFVHASSTFEFGATRSDCLVQFSILNPFSEPMNCVFVHASSTFEFGAMRRDCLVQFSILNPFSEPMNCVFVHASSTFEFGAMRSDCLVQFSILNPFSEPMNCVFVHASSTFEFGAMRSDCLVQFSILNPFSEPMNCVFVHASSTFEFGAMRSDCLVQFSILNPFSEPMNCVFVHASSTFEFGAMR

SEQ ID NO: 110563 - protein, 193 aa, Glycine max
  Coding DNA Sequence Number=SeqID_18878
  Homolog annotation: Hit_ID=Q9KHC4; Match level="QueryCoverage=22%, HitCoverage=8%, E-value=2e-07, Identity=67%"; Hit description=SocE
DAGSRQARQGASAGVGGCRGWLNYAASEQIVLRVHHMRAIGAGLFAITPAGERGMCCKAIKLGNARVFPVTTLIPNCPKFGVSRYKVKDDDECSSDENTKKGPPAKVLWYLPIIPSRETCRASCINESANARGEAVCVLGALPLPRSLTRCARSFGCGERYQLTQRRNRKKAALLAFFHRLRPPDEHHKIDAQ

SEQ ID NO: 110564 - protein, 262 aa, Glycine max
  Coding DNA Sequence Number=SeqID_18879
  Homolog annotation: Hit_ID=Q6WAY6; Match level="QueryCoverage=60%, HitCoverage=30%, E-value=4e-07, Identity=29%"; Hit description =Putative uncharacterized protein
LSMWGWFHTFFSKKVGPPIRYKEGRIRILSSCEGCPNVLLMGTRGCINYNPVLAIRQLGYPMREVPSDESIMPFIAWGFSDHKREGTPRSSQGMGCGTVRDDEVKASEESDEVQALKAELERARVVEEKFKSIAIKGSNSKLKLRRVKGIITGQRHDLKDELKVCLRSKRNLSQQLSKTEGNMWAIIDKCKEKLNLAATHEQRLEDEYAKISAESEAKERESRISPIASQGQSNGGHLLCPQEDPQTSQLLSTYDRLNGPYD

SEQ ID NO: 110565 - protein, 103 aa, Glycine max
  Coding DNA Sequence Number=SeqID_18880
  Subcellular localization annotation: CTP_CleavageSite=39; ConfidenceScore=5.16e-01
MDPAGGQPAANPAAEQPSNVPSGASTSGWRSFEEGVLLESSNESSEASVNQQPVIPELEPPLLDDNTRRAELAVRLRANWWGIAYNERILDSFVRSQLAIERT

SEQ ID NO: 110566 - protein, 166 aa, Glycine max
  Coding DNA Sequence Number=SeqID_18881
  Homolog annotation: Hit_ID=Q652R5; Match level="QueryCoverage=30%, HitCoverage=20%, E-value=2e-14, Identity=72%"; Hit description =Putative uncharacterized protein P0603C10.50
  Subcellular localization annotation: CTP_CleavageSite=50; ConfidenceScore=5.00e-01
STLEDPRQLIRQVSAQLGTVTQLPVHPASPVLLTKNGPLGALDSMARLNRAAAPSYLFKSFAPIPKSDERFARQYRCGPPPEFPLASPRSGIVHHLSGPDRYALTRTLHRRSGSVGGATHRGIPPISFLAPYGFTRPLTRTHVRLLGPCFKTGRMGSPQADARSAQ

SEQ ID NO: 110567 - protein, 239 aa, Glycine max
  Coding DNA Sequence Number=SeqID_18882
VRQPAHDELVRAQQLLAVDAQVLAAGVGAARDHQAPGQERRHVAGPAGLDRQARQVHVLAFPDDLLAGRALDVLRAHVPQGRLQHRHLGQRIAQALGRLGLAQRGQQFADVAQRADVVGAHAARHPRGRAEQVGQHRHPGRLAVVQGLFEQQGRALGAQHAVGNLGHFQARRDRRGDAFELAHAFKLGEEVSKVAVFHYRSRLFGYILGRKRGAWPKECTNILPNHCASAPSTWALGIL

SEQ ID NO: 110568 - protein, 132 aa, Glycine max
  Coding DNA Sequence Number=SeqID_18883
MVVKIIKNMQLPNLFPTMRMVIVEDCLWAMVQVEVRDNNNMAGLCGLSKGFGLGILIIPTVATGMESSATTLLPIFFSFTSTLHLLLSIMTTMMMDSTVDSMRKLIGDGALMLPTEQYPLRSGISLSFDILT

SEQ ID NO: 110569 - protein, 236 aa, Glycine max
  Coding DNA Sequence Number=SeqID_18884
  Gene Ontology: Mol. function=motor activity; Cellular component=cell projection
  Homolog annotation: Hit_ID=UPI00016621D1; Match level="QueryCoverage =88%, HitCoverage=40%, E-value=3e-16, Identity=32%"; Hit description =UPI00016621D1 related cluster
GPLGTSTLTFRGIYVLVIRGLHALTFRGLHVLAFRGLHALTFRGLHVLAIRGLQVLAIRGLHVLAFRGLHVLAIRGLHALTFRGLHVLAFRGLHALIFRGLHVLAFRGLHVLAIRGLHALTFRGLHVLTFRGSWLHALTFKGLHALIFRGLHVLAFGGLHSLVFRGLYVLPLRGLHFLAFRGLHVLAFRGLQVPLFRRLHALAFRGRHVLAFGGLRSPSPFEGYASSLSVGSISTP

SEQ ID NO: 110570 - protein, 152 aa, Glycine max
  Coding DNA Sequence Number=SeqID_18885
  Homolog annotation: Hit_ID=Q9KHC4; Match level="QueryCoverage=28%, HitCoverage=8%, E-value=1e-07, Identity=67%"; Hit description=SocE
DAGSRQARQGASAGVGGCRGWLNYAASEQIVLRVHHMRAIGAGLFAITPAGERGMCCKAIKLGNARVFPVTTLSTLEDPLIPFDLTNLSTNLLLNWSYLRMSRETCRASCINESANARGEAVCVLGALPLPRSLTRCARSFGCGERYQLTQR

SEQ ID NO: 110571 - protein, 74 aa, Glycine max
  Coding DNA Sequence Number=SeqID_18886
MRLVKRLLSLLRLLRSQGPTCFARMLQPYEINIGLKEQSNPVTPKAYTPKSPSEPLPPDSGPTPKIILAHRHCS

SEQ ID NO: 110572 - protein, 133 aa, Glycine max
  Coding DNA Sequence Number=SeqID_18887
MALPLPPLLLAITITDHLKHPQHRFLLPCHPHDQVQNIPVVINQSLFFSLTKLPSQGVPFEGTIVDDWKFDYSSHDARCMDVDGQWIRKQDLPLPIPDERTPSPPLQRVDSSSLLTEVLKNFVVVVIIKKWEN

SEQ ID NO: 110573 - protein, 108 aa, Glycine max
  Coding DNA Sequence Number=SeqID_18888
  Homolog annotation: Hit_ID=A6FJQ2; Match level="QueryCoverage=35%, HitCoverage=84%, E-value=3e-11, Identity=92%"; Hit description=50S ribosomal protein L5
MTVKTLTHAAPGDGHSLSVSRCPGADKPRQGASAGVGGCRGWLNYAASEQIMRKEKIPHQAPFAIQAAQLLGRAIGAGLFAITPAGERGMCCKAIKLGNARVFPVTTL

SEQ ID NO: 110574 - protein, 136 aa, Glycine max
  Coding DNA Sequence Number=SeqID_18889
  Subcellular localization annotation: CTP_CleavageSite=67; ConfidenceScore=5.43e-01
SWLLHLARLLFLLLLLLLSSPPPPPLDASASSSTMKRTRKAIRLRFLSTRPPGAERPMVNIDPATNKADEASDSRRKKKLLKTVGERWRQFKSDLTRKWALAADQDGVDDTVCEKYDISKEKWAQFCQTHRDPSWE

SEQ ID NO: 110575 - protein, 201 aa, Glycine max
  Coding DNA Sequence Number=SeqID_18890
  Gene Ontology: Mol. function=protein transporter activity; Cellular component=type II protein secretion system complex; Biological process=protein secretion by the type II secretion system
  Homolog annotation: Hit_ID=A8AIN8; Match level="QueryCoverage=86%, HitCoverage=26%, E-value=6e-68, Identity=76%"; Hit description =Putative uncharacterized protein
  Pfam annotation: Domain name=Secretin; Domain location=9-135; Score =27.7; E_value=1.1e-09; Accession=PF00263.12; Description=Bacterial type II and III secretion system protein
MCRYCPAPRPPAVTTSLIRLNVKPSVPKLKIVPQINDGDMIHLKIEQEVSSVDASATTDASLGPTFNTRTINNEVMVHSGQTVVLGGLMENVNKQNVSKVPLLGDLPLVGQLFRYTSQDTSKRNLMVFIHTTVLRDDDNYSAATKEKYDQIRARQQQRMEEQKLGIIENSDNPVLPALLPQSRSTPVGTTASSSTRNPFKE

SEQ ID NO: 110576 - protein, 49 aa, Glycine max
  Coding DNA Sequence Number=SeqID_18891
MATIALLSRYGRWCLASGVHQTGFVADLGATFVDDWVFLAGRVVGNEKD

SEQ ID NO: 110577 - protein, 97 aa, Glycine max
  Coding DNA Sequence Number=SeqID_18892
MKDIELVEEEQAQIGANPSSETSNKSENYKEEARNATQKHKPKKVESVNTDAEAFAEPLEHTKKRDTGHQSVSLENKAGDSTVLKIGNSGKVVINKT

SEQ ID NO: 110578 - protein, 115 aa, Glycine max
  Coding DNA Sequence Number=SeqID_18893
MTRGNPGDLQPFDPKIDRSFHRLVRHSVHPSHSVHFEHSEHSVEVNSEYSDFQHSTTNFHTENMAQPPPRERTLREMAAPDFTYESLCIQYPDEGVPYVLKTRLIHLLSKFHGLA

SEQ ID NO: 110579 - protein, 237 aa, Glycine max
  Coding DNA Sequence Number=SeqID_18894
  Gene Ontology: Mol. function=nucleoside-triphosphatase activity; Cellular component=intracellular; Biological process=transport
  Homolog annotation: Hit_ID=A8GAT5; Match level="QueryCoverage=95%, HitCoverage=95%, E-value=1e-81, Identity=69%"; Hit description=ABC transporter-related protein
  Pfam annotation: Domain name=ABC_tran; Domain location=27-206; Score =170.9; E_value=3.3e-48; Accession=PF00005.18; Description=ABC transporter
  Pfam annotation: Domain name=SMC_N; Domain location=3-209; Score= -103.5; E_value=0.00049; Accession=PF02463.10; Description =RecFRecNSMC N terminal domain
  Pfam module annotation: Pfam domain module=ABC_tran::SMC_N; Domain location=27-206::3-209
  Subcellular localization annotation: CTP_CleavageSite=89; ConfidenceScore=5.43e-01
MISLRQLAIGYGVTPLFPPLSGQFSAGSLTAVVGVNGAGKSTLLKTLAGLLPPLGGSLSFSGGKPPRRAYLPQQAELDRQFPIAVSDLVAMGCWPQSGMFGGMNSRAASQVNEALANVGMSALARSPVGELSGGQLQRVLFARLLVQPAPLILLDEPFTGIDSATTQILLQAIAQLHRQGKTVIAVLHDMSMVAEHFPQVLLLTPQACHWGAAERVLEQVPRYHAAERQPDLRAVAP

SEQ ID NO: 110580 - protein, 77 aa, Glycine max
  Coding DNA Sequence Number=SeqID_18895
YLKKIDIFLKEPKTSLSGKFSGGGRRIGFGLSTGTGVQQWIPGTATPLAGGIFFNQDRHFSGRRAPQLLYPEVGLVD

SEQ ID NO: 110581 - protein, 119 aa, Glycine max
  Coding DNA Sequence Number=SeqID_18896
MHKALRANAPLPYPQLITLFLRHFQIPLDDEPFVQVKRSFAIGAGAVTSFGYRKDWNGQWLKKDVLPPQDERTPSPPPQRDDSALMIEVLSELRGLRDHQFQNIGGDGHHQKGGDCRSK

SEQ ID NO: 110582 - protein, 193 aa, Glycine max
  Coding DNA Sequence Number=SeqID_18897
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
RTTERSESVSEEAEERQYANRLSPRVGRFINAAGTTGFPTGKRAVSATQLIYDHDYEFELGTQHLPMQRSKAMGQEMVKFKLPLSKVFVATTIIWYTTTALLVGDKKRINTHSNDSMETLLVKKDIILFLEDIKINVSVRGMQAWHWPSFYNVVTGKTLALPNLIALQHIPLSPAGVIAKRPAPIALPNSCAA

SEQ ID NO: 110583 - protein, 70 aa, Glycine max
  Coding DNA Sequence Number=SeqID_18898
MMTNKHDEACHTCRKTRINWFSRVDIIYNVNGGNNQYMKSNNTQAGTLISPVPILKACVDEAKKLGKRLF

SEQ ID NO: 110584 - protein, 75 aa, Glycine max
  Coding DNA Sequence Number=SeqID_18899
  Homolog annotation: Hit_ID=A6FJQ2; Match level="QueryCoverage=50%, HitCoverage=84%, E-value=3e-11, Identity=92%"; Hit description=50S ribosomal protein L5
MTVKTSDTCSSRRRSQLSMRKEKIPHQAPFAIQAAQLLGRAIGAGLFAITPAGERGMCCKAIKLGNARVFPVTTL

SEQ ID NO: 110585 - protein, 157 aa, Glycine max
  Coding DNA Sequence Number=SeqID_18900
MRKRTLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLTLKIRSKKRFSNKKLKLPYVSYALPGIL

SEQ ID NO: 110586 - protein, 62 aa, Glycine max
  Coding DNA Sequence Number=SeqID_18901
MGNFPSRPIPEFTPIPMTYEDLLPSLIYQHPFPKWYDPDATCAYHGKTLGHSTEKCLALKYK

SEQ ID NO: 110587 - protein, 124 aa, Glycine max
  Coding DNA Sequence Number=SeqID_18902
MSQHISVTVVDSRSGKSQFETESYIKSWMQSSKRNVYLGAYLNVGHWQMVVIVPKEHLVVWFCSLHNRPDNYLKGIINSALKALDDAPQPKSKAPASVIDKKEYFNDARPLEPKRLKALWIQWA

SEQ ID NO: 110588 - protein, 35 aa, Glycine max
  Coding DNA Sequence Number=SeqID_18903
MVTFYGCNLSMFQNMFGMGNKTENYTSDELSPRIK

SEQ ID NO: 110589 - protein, 175 aa, Glycine max
  Coding DNA Sequence Number=SeqID_18904
  Pfam annotation: Domain name=Transposase_23; Domain location=26-96; Score=13.4; E_value=4e-05; Accession=PF03017.5; Description =TNP1ENSPM transposase
MQSQGLVLLSEPEGSCVDPSGNNPDTGDSEKCGLYIEENPPRLVALGRVYEGSTTVHNIPLLHDQVKVGVEQVKDADAPILVPTDEVILVGQALNTFLAWLTHLVKHLSEQGAVGPAKPADRPDHEVDDPLYLMTLTIPQLFLKSLQASDRDKYASGEFRCVWIPRAIVLWAITI

SEQ ID NO: 110590 - protein, 156 aa, Glycine max
  Coding DNA Sequence Number=SeqID_18905
RTTHPHLQRATRPRLQRTTRPHLQKATRPRLYIATRPHLRGLYVLTFRGLHILTFRGLHVLAFRGLHVLTFRWLHALTFRGLLVLTFRGLHALAFKGLHVAQLISNVIYYLQGSRPQDTQWTRRSPTGPWGLQLWLWASVSPTGCPSRQQGHTIVT

SEQ ID NO: 110591 - protein, 152 aa, Glycine max
  Coding DNA Sequence Number=SeqID_18906
  Gene Ontology: Mol. function=aspartic-type endopeptidase activity; Biological process=DNA integration
  Homolog annotation: Hit_ID=A5AHJ1; Match level="QueryCoverage=98%, HitCoverage=65%, E-value=2e-16, Identity=30%"; Hit description =Putative uncharacterized protein
MQIFIEAIDLNIWEAIELGQHIPIIIDVSTSTTTQKPRDKWTEEDRRRIQYDLKAKNIITSALGIDEYFRVSNYTNAKEMWDTLQLTHEGTTNVKREWKPKVTAISKSKDISSVSLATLFGKLQKHEMELQRLNQNEENDKKKRSILLKPHH

SEQ ID NO: 110592 - protein, 148 aa, Glycine max
  Coding DNA Sequence Number=SeqID_18907
MEITPGNQFNKDQGGPSNRPIQQGPNIFQRTTKLEETLTQFMQVTMSNYKSTESALKDLEVHVGQLAKRITDKSSNSFVANTEKNPKEECKAMMTRSKRFVEAEDEDSVVSKKEAVEKKSAEVPYPVVPSKKEKDRHLASDRGRTRIK

SEQ ID NO: 110593 - protein, 121 aa, Glycine max
  Coding DNA Sequence Number=SeqID_18908
MGRNVSTLIGKSVPRIPEKCKDPDVVIHLANRSVAYFAGFIEDVLVQNESEFESGSDFLGVVPLDVEFLESEYTNHVARSTYTSELLYEVQAEEPSSSPTLVPPTVHPPPTPELKPLPATL

SEQ ID NO: 110594 - protein, 95 aa, Glycine max
  Coding DNA Sequence Number=SeqID_18909
MTTLTWMTLLFSNILPSDHNANLPLQMIAPTRHTVDPKKSNRALGFPALVTGLCSPIGCPFPPARSRHPDIGKDRACKTPSGPEEVQQGLGVVKL

SEQ ID NO: 110595 - protein, 118 aa, Glycine max
  Coding DNA Sequence Number=SeqID_18910
MRDGKRSSYIIGIGVNVGLGGKFLIALEPVPKWALPAGRAGVEAVAWGASMWMGAGALVCTGSELEEFPARAKKLGPTWALQNIPPEGCCFWRKQPGSPGRAELAWASWAATTSPILL

SEQ ID NO: 110596 - protein, 438 aa, Glycine max
  Coding DNA Sequence Number=SeqID_18911
  Gene Ontology: Mol. function=helicase activity; Biological process =viral genome replication
  Homolog annotation: Hit_ID=Q337N5; Match level="QueryCoverage=99%, HitCoverage=31%, E-value=2e-74, Identity=34%"; Hit description =Expressed protein
MIESQKLNYVRQNQQELRVDKYINLNVCNNGPETHGNEKGRRIILLSSFVGSRRYMEQLYFDGMPIGGHIGFPDLFLTLTCNPTWQKIQRRVRKYNLRLDDCPDVVSRTFKIKLTHLMNDLKSGHVFGTILGFVYTIEWQKRGLPHAHILIFLHPSNKYLNLEDIDNIISTEIPNKDTHLELYELVSKHMIHGPCGLPNRRTPCMLDGKRIRFFLKKFQQATIVDNDVFQFIGKETMDIWLKRMVFITTKCMLEDICIPNACIGLYFHLENQQVVYWKDIEQIGSILSKKIVKESMFTTWMDSNQRYSQGRDLTYAQYLSKFVYVARRRCWQPRKQGYTIDRLIWVPCSTEDLFYLRMMLSSAKGPKSYKEIRTVENVMYGTFREACFTKGFLGNYQEFIGALREANTWGSAHFLRKLFVKLLFMNTMDIPQYVWEQT

SEQ ID NO: 110597 - protein, 361 aa, Glycine max
  Coding DNA Sequence Number=SeqID_18912
MGLIIPQDYDEEVANRSIEGQRALRLTPKTFDQNPQKLFLKYMRIFLSFDKFLPQHAPFISREVGPAWFTDYFPAVDPDNEEEVNEIWSFYLNPQILSCRTGVQSNYLGLVGYQPNLVSRQFGLSQIRPKSLFEDPRDVIRGANLSEKTFKNFLKISLDENYNLHPFEFNHSHFCTIGFVTWWEKYYSGRSVGDTTIMISRLESGFTQPTVENIRSNLQARGKTIMTKKIAETSRADVRPKKPTGVKIQEWKQEEKSHKKDDSTETTTTSKRSKRVVIEFDEEKDASLISNEEEERPLVRKRKSPETSTKSADQTEAGDFQAQMPKKKKKVKQIEPEPSVTVEGGEPVRKKKKKTKSSKEQ

SEQ ID NO: 110598 - protein, 17 aa, Glycine max
  Coding DNA Sequence Number=SeqID_18913
DVTQPIPLHIHFSTPPA

SEQ ID NO: 110599 - protein, 147 aa, Glycine max
  Coding DNA Sequence Number=SeqID_18914
  Gene Ontology: Cellular component=ribosome
  Homolog annotation: Hit_ID=Q1SL03; Match level="QueryCoverage=91%, HitCoverage=38%, E-value=4e-10, Identity=23%"; Hit description =Ribosomal protein S2; Nucleic acid-binding, OB-fold
  Pfam annotation: Domain name=DUF223; Domain location=49-145; Score= -13.3; E_value=0.052; Accession=PF02721.5; Description=Domain of unknown function DUF223
MARIDDKIKSIDGSKETLKLAVRITKLWFVGTPGRSEQAEMIIVDSDPLVRYFYDSQGDQIHVVCKQDQLKTWKMDLKEGCTYVMHNFRVSKNDGQYRVCDHPYKLTFIEVTVVRQCELDGLPFKNYRFADFSDVVASQLQSGLLVG

SEQ ID NO: 110600 - protein, 106 aa, Glycine max
  Coding DNA Sequence Number=SeqID_18915
MTHSTEDVRRTMQGMFAVHRPSMYAFNSPNTGVLQGVHKAWELVRKKDKELRGSGNGAIGGYHRWLKAIAQGLDWLPRLRATKEVEFEASKEGEEVQVLRTELGKA

SEQ ID NO: 110601 - protein, 28 aa, Glycine max
  Coding DNA Sequence Number=SeqID_18916
MAAELGQQMMELSTLVTRAAHDKSSDLL

SEQ ID NO: 110602 - protein, 81 aa, Glycine max
  Coding DNA Sequence Number=SeqID_18917
MQNMGYLSIVSRVQIIVSMMSLQGYLNIFESHYHNILYFNDQDDDQSHKVVDADYVADFFFPLKNFDLVLQTNMVHRTVVK

SEQ ID NO: 110603 - protein, 93 aa, Glycine max
  Coding DNA Sequence Number=SeqID_18918
MPISPNRCIGWDRAHKTPSGPEEVQQGPGVSSSGYGPLSVIQGAHSPCKESLSQRHPVDPEKSNRALGFPALVTGLYSPTGCPFPPARSCHHR

SEQ ID NO: 110604 - protein, 147 aa, Glycine max
  Coding DNA Sequence Number=SeqID_18919
MTRGNPGDLQPFDPEIDRIFHRLVRHSVHPDHSVHFDHFKHSEYSVAGDSEYSNFEHSTTNFHTVNMAQPPPRQRTLREMVAPDCTYESLCIQYPDEGVPYVLKTGLIHLLPKFNGLAGEDPYKHLKEFHIAFSTMNPLMSKKIISF

SEQ ID NO: 110605 - protein, 219 aa, Glycine max
  Coding DNA Sequence Number=SeqID_18920
MGYVKIKSVAKAKKHQKVPIMSIMGLKNYFGVEGKFDESHSTGEEKKASVRQNPPIMEELGNLSFNLQFLSMQLSIGSCCISGWKKGNTGEGGALNRRCGFFLGRDQPIIQSYNIRRWIIIFLNNQNKREFGSARMVLVSATKVERILGVTRPTEKAVASGGSNLARLGELGGKLLPYFAINRGRNEGGKGSTFLALLILSKLLRKIVSVKKIQAEALP

SEQ ID NO: 110606 - protein, 29 aa, Glycine max
  Coding DNA Sequence Number=SeqID_18921
MTLTRPSCFGINEALGLNLELGLDLKRAD

SEQ ID NO: 110607 - protein, 178 aa, Glycine max
  Coding DNA Sequence Number=SeqID_18922
SAKRNIPRLSARKNPEEDELYRVSRERKVQVPESFERFCYVKICRDQSWKQELEPVMYDYHEKERAPDLESYQWESFRQSEYHNKAEGVLNMDDLLMQFKDMVESIQQAFRRTETQISKLIDDMTNAVARKEEERTEIETHQESICQVTSLHHQLTNEEETPKVSNTPEYPYLAIVGY

SEQ ID NO: 110608 - protein, 131 aa, Glycine max
  Coding DNA Sequence Number=SeqID_18923
MVVILPKENLVVWFCSLHNRPDNYLKGIINKSVLFFNTFALALISNINILMFIVFNSALKGLDDTPQPKSKAGAKWIVVKCNRQKESTECGYYVMHWMTTIILGCFRNNWEMYFNDVRPLESDTLKAFHIQ

SEQ ID NO: 110609 - protein, 86 aa, Glycine max
  Coding DNA Sequence Number=SeqID_18924
  Homolog annotation: Hit_ID=A6FJQ2; Match level="QueryCoverage=44%, HitCoverage=84%, E-value=3e-11, Identity=92%"; Hit description=50S ribosomal protein L5
TSPSGRVSGVRMRKEKIPHQAPFAIQAAQLLGRAIGAGLFAITPAGERGMCCKAIKLGNARVFPVDSRGSPQDFGSRLVPMARHDT

SEQ ID NO: 110610 - protein, 51 aa, Glycine max
  Coding DNA Sequence Number=SeqID_18925
MAPMVWHLQSSFFLLIPLHDLQEAKDSLMKNIQGLQAPHGATSCGIKSIFV

SEQ ID NO: 110611 - protein, 30 aa, Glycine max
  Coding DNA Sequence Number=SeqID_18926
MDDNDMDSSEDSENEVVNLSLMAKSHESLK

SEQ ID NO: 110612 - protein, 53 aa, Glycine max
  Coding DNA Sequence Number=SeqID_18927
VKGRSPEYKEPRDLRSNPFQGGGDDAILPPQGYWIEDSKRIRLEMLKKALGIS

SEQ ID NO: 110613 - protein, 105 aa, Glycine max
  Coding DNA Sequence Number=SeqID_18928
MGVELGSMVEEAVEGKVGVGEAEALMYGEDVWLGKVVGVCWGIWLTTPRGAADVTVWLGEQVQYEKHGPSNDKGERSGRVRRGPSPQCAYAFFRPHHSDGGCEGR

SEQ ID NO: 110614 - protein, 208 aa, Glycine max
  Coding DNA Sequence Number=SeqID_18929
YGISKEKWTQFCQSHRDPSWEAIQKQNIALHMLSYGDYEFLENKLMEEKKKKQLEEAAKSESTNTVIDPPSPIRRHVKWKMARTKKIGQMTSEAVKEIADKIDSLEEHTSQGSFVAYGRQDVLTAAIGRCHDQTILWTGSKDLLHVFVHGSQRSKVADTKNQGPAGRVGPSAACVSTKEGFVDPSGNDPDMGDSKKCGLYVEENTPRP

SEQ ID NO: 110615 - protein, 54 aa, Glycine max
  Coding DNA Sequence Number=SeqID_18930
MARTCSPLKVRACNPLKIDCPFERGDNSCNLILSFFANLFGNFLRVCVLFDLVT

SEQ ID NO: 110616 - protein, 146 aa, Glycine max
  Coding DNA Sequence Number=SeqID_18931
  Homolog annotation: Hit_ID=A6FJQ2; Match level="QueryCoverage=26%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLEFDKSKQNENKNARNTMWTTKGTWNESKSLVRGEVVAAQLAQASQVASSRSNSLLEEYSGGPKWAW

SEQ ID NO: 110617 - protein, 30 aa, Glycine max
  Coding DNA Sequence Number=SeqID_18932
MMHMRKVLSYPNFVREPLLDDMRPFFGPCE

SEQ ID NO: 110618 - protein, 86 aa, Glycine max
  Coding DNA Sequence Number=SeqID_18933
  Subcellular localization annotation: CTP_CleavageSite=29; ConfidenceScore=5.09e-01
MTSVETFAMARCHTLISSGDHPFLGYDPRSTTSRKKTSIVTKFVKFRNVTEKESPKTKQGVYLVKMGVQIAIRPTWSFQDVPPDGG

SEQ ID NO: 110619 - protein, 186 aa, Glycine max
  Coding DNA Sequence Number=SeqID_18934
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGGSPSSTISDCLVCIGPEKYDKGNSFSSCRHAGDGMQAWHWPSFYNVVTGKTLALPNLIALQHIPLSPAGVIAKRPAPIALPNSCAA

SEQ ID NO: 110620 - protein, 281 aa, Glycine max
  Coding DNA Sequence Number=SeqID_18935
MVISPGATRPAQGRRVYRFLGGGHHWSTEDIVFEFYANAWPTEEGVRDMRSWVRGQWIPFDADAIGQFLGYPLVLEEGQECEYGQRRNWSDGFDEEAIAHFLCIPGQDFARTAAGRRVRIMRTNMTTLTQIWMTLLLSNIQPSDHNSNLPLPKCQLVYAILTRMSIHVAQLIADAIYLFAGMAPTRHPLDPDKSNRALGFPALITGLCQSFGVPVAPSKVIRPPITQAFIEKYCTQRQAQGDALQAADASPPHQAGPAESFDTEQYLRHLVRQQAANHRAH

SEQ ID NO: 110621 - protein, 98 aa, Glycine max
  Coding DNA Sequence Number=SeqID_18936
MKQKKRLKLKKKNPVKEHKSREKYEEKDEEQAQQQWENPFAKRTPRAKRVFDHALSRESQALSDQPLHLRLIWFAKLAKAELSQLQFDLNSAKLQPDR

SEQ ID NO: 110622 - protein, 85 aa, Glycine max
  Coding DNA Sequence Number=SeqID_18937
MEKSEKKNINEKKLKKAYITWDENDMESSEDSENEEINLCLMAKSYESDEEEPLRKKWYIDSGCSKHMTGDKSKFTHISPKKSGH

SEQ ID NO: 110623 - protein, 177 aa, Glycine max
  Coding DNA Sequence Number=SeqID_18938
MQAEPEEAITQLLCIPGQNFTRAAAKRRVRIMRTNMITLTQIWMTLLLSNIPPDDHNADLPLRKYQLRLCPQDTYWTRRSPTGPWGFQLWLQDSVSPTGCLSPPARSCHHDIGIAPANHPTEPEKSNRVLRFPTLITGLCQFYGVLVAPNKVIKPPTNRAFIKKYCTPRQAQGETPQ

SEQ ID NO: 110624 - protein, 122 aa, Glycine max
  Coding DNA Sequence Number=SeqID_18939
MCEGQHGARGCIFHGRKMCGVATNVYSRKTSEKPEKVWSTNFKCERFGSCIYAWGRLFKAVATYPSAGGRRVTRGMRVPRKEYARSRHQRLFEENVGKTGKDAIYELLSERFGSCIYARGRY

SEQ ID NO: 110625 - protein, 162 aa, Glycine max
  Coding DNA Sequence Number=SeqID_18940
MGGYILGGSLQVEGTSTWLFKENKGGYILCGSFLVKDFTRLLEISRTVGCLRTGCADGGDGCGVYAGVVSSSTTANDGAGVVGSLVIGSWAVEAPPPPEEEGWSPGQATCASNSSMLISVEKQGVGASDGRESKSGRIMLSSEGDLMGNKGLPISIKLESPP

SEQ ID NO: 110626 - protein, 138 aa, Glycine max
  Coding DNA Sequence Number=SeqID_18941
MVTILVEVIHLHGGRCAITELGCDKTAELSNPSKVGNDAISVKSTLELGCRKTAKLCDPSKSKLGCDKSTGLCNSSKVGNDDGIVVKPMLELACDESVGLCEPSKVESGTLEVKPITCLCSSKNMLSRNILCFHAMFA

SEQ ID NO: 110627 - protein, 310 aa, Glycine max
  Coding DNA Sequence Number=SeqID_18942
  Homolog annotation: Hit_ID=A5B5V0; Match level="QueryCoverage=87%, HitCoverage=61%, E-value=8e-09, Identity=24%"; Hit description =Putative uncharacterized protein
MDFFSNENFECIQAFENSNLIPFMSLKLPVYSELVKFFYSNLEIQESTLISEVFGIKMVIDQSLFYDLTQLSSEGVPFEGALNDDWKFDFSVHDARQLVCTNQADMTGRLLAGSLAFESRILHYLIVRILLPRSSNLAQVSEEDLIVMWAFHIVRQIDWAHLVRYHMHKALRLNDPLPYPHQVTLFLQHFNIPLDSEPYVPIKRSFLIGAAEIASFGYRKECDGSRVKKGAQPNDDEGHLPVGVDSSLLQSNLDRFDGLQTYVGERFDALEQQMDMRFDKMDSRITKVEGDVTFIHTCFDLLPPPPPPSS

SEQ ID NO: 110628 - protein, 56 aa, Glycine max
  Coding DNA Sequence Number=SeqID_18943
MADNLHGFAHGNVSEAIREKGRCLPPRGFLRKISERIPVTKFTPLFVLYGSLTGVF

SEQ ID NO: 110629 - protein, 130 aa, Glycine max
  Coding DNA Sequence Number=SeqID_18944
MTLLLSNILPSDRNANLPLRKYQLVCAVQTWGSHPQRHPVNLKKSNRALGFPALVTGLYQSYGGPVPPRQGHVIIGIATARHLVDPKKSNRFYGVPVTSSKGIRPPTNRAFIKKYCAPDRRRANTTAALG

SEQ ID NO: 110630 - protein, 322 aa, Glycine max
  Coding DNA Sequence Number=SeqID_18945
  Homolog annotation: Hit_ID=Q6WAY6; Match level="QueryCoverage=84%, HitCoverage=47%, E-value=7e-17, Identity=29%"; Hit description =Putative uncharacterized protein
MDGLVDLAAIDAFLAYHHGKESPVVAILADLFDTFDRRCEKSNARIICCLPTLCVWLVSRLFQQDIRHPCPLRSYSCVKKRRVDWDQHLAGIGGRTISWFPRWKEGKEGVLFSCGDYPNIPLIGTRGCINYNPTLAIRQLRYPMRGASIEESLSPFLIIDKESFEALEEDEEVRALKTELGKARLAKEKFKLVATDVRKECVGLQEENTANAKALQQETKRARKEEHGRDKFRGALWGSNSELKLRREERDQSRAHNMVLKEESAACSRSKRSLSQRLCETETNMLAIISKYQEELNLATAHEHKVADEYAQVYAEKEARGR

SEQ ID NO: 110631 - protein, 166 aa, Glycine max
  Coding DNA Sequence Number=SeqID_18946
MTGRLLAGSLTFDCRIMHYIIVRILLPRSSNLAQASEEDLIMMWVFQTIRQIDWAHLVQYRMHKALRANAPLPYPHLITLFLHHFNVPLNDEPFVKDLPPPISNERTPSPPPQRANSTSLLTEVLTDLRDLRAFLGERFNAMDTRITRLEDDMSFIGRSFAPSADS

SEQ ID NO: 110632 - protein, 80 aa, Glycine max
  Coding DNA Sequence Number=SeqID_18947
ISKEGKLLDPNFVRGLSFNDIWFLASQITMFDTSYHTKQGITQCFDREYKKIPRKGAKGSFFLIFLDPSSPRLAFGLPGP

SEQ ID NO: 110633 - protein, 19 aa, Glycine max
  Coding DNA Sequence Number=SeqID_18948
MSVQEWLLFGRGKCTGSHK

SEQ ID NO: 110634 - protein, 61 aa, Glycine max
  Coding DNA Sequence Number=SeqID_18949
MVGERVRLHIWPVFLECQPSCLDQALDLMLEGYALLNRMPQSSPMLRTSRIGVVPLWERRL

SEQ ID NO: 110635 - protein, 47 aa, Glycine max
  Coding DNA Sequence Number=SeqID_18950
MWTTTGEKLAAQLAQASKVASSRSNSLLEESSGGPKWVWLLFAPPIY

SEQ ID NO: 110636 - protein, 230 aa, Glycine max
  Coding DNA Sequence Number=SeqID_18951
ADDGQPGNAGRGHGVLGAGGKAAEAGRHLDAIGVMEVLIDQQRRFAVGECRQQLAQVGRGQASQRQGIAGLAVLRGIRIALDARLQVCASVRKRAGGNQVRTGIAAKTREAVVCRRSGFHIGLAAAVGRGSGAIVQPERASAEVDVVLGDRRVGAAEAVGAGPPDLVVDRHDHQRHQRWQEQQSVHPSGHLAAIPHQRRHAPAEVVAGDGHQPQDARSVASSSDTMMPNR

SEQ ID NO: 110637 - protein, 192 aa, Glycine max
  Coding DNA Sequence Number=SeqID_18952
MKIKKRTKERKEGFPIKDRKEVKRGKEATLDQRKEENRKSPKPDCHSESFLTGNIPPHMNKEEKTETPSFLSKNADLEKILLLEVDILPFILGYKEDYPWRKYIVSLRRGALANDLFFFAKSMAVHVFSTFESGAVFHDCLREDPQGNPPFSSFSRAAAVHVFSTFESGAVFHDCLREDPQGNPPFSSFSGA

SEQ ID NO: 110638 - protein, 155 aa, Glycine max
  Coding DNA Sequence Number=SeqID_18953
MEACLVVGDLLQQMIDQGRLEVSDEGEEEQHICMQSADKEGPRKPKPLNSHIVPWRYASSSDKKEEAIDISSLLAKPANAKGKARMTEGQNVKVIPTPDEDVPMKGLSEGGEGCGKKEVSLEEAGEFLCIIQQSEFKVIEQLNKTSARVSLWNCS

SEQ ID NO: 110639 - protein, 44 aa, Glycine max
  Coding DNA Sequence Number=SeqID_18954
MKHTSKREGGGLMNSCRNLPFGGRATRDSRDACSTKGIRAESPP

SEQ ID NO: 110640 - protein, 196 aa, Glycine max
  Coding DNA Sequence Number=SeqID_18955
  Homolog annotation: Hit_ID=Q84VH5; Match level="QueryCoverage=46%, HitCoverage=13%, E-value=2e-40, Identity=94%"; Hit description =Envelope-like protein
MLSQHPNMLNYTDSVIKRESPLSLHYKLFEGTHVPDIVSTSGKAASGAVSKDALIAELKDTCKVLEATIKANTEKKMELERLIKRLSESGIDGEAAEEDGEAAEVEEEAAEEEEEAAEEEEEAAEEEEDAAEGACHPARPGEEGACHPARPGELDNVIIPFLAFGMLWNLTDCVTMLPFDFRHVTEFHGSCNNALF

SEQ ID NO: 110641 - protein, 43 aa, Glycine max
  Coding DNA Sequence Number=SeqID_18956
MSALPFTYPCLNFGVFYLNAYGTPLIRPNGSGFDAILPCKGIG

SEQ ID NO: 110642 - protein, 174 aa, Glycine max
  Coding DNA Sequence Number=SeqID_18957
MWMDRFAFTLNGSQELPRLLAKAKAMAGVYSTPEEVQEQMKADMVALKDQMASMMEAMLSMKRMMESNAATAATASTAAEADPTHPCAINQAHQPIPDMVGQGEVLGGTDGLHMGYNRNAYPYGLPPNYTPPTMHVPNENPIGGVREEPRERAQADFDLYPTFTTEGPAYNAMP

SEQ ID NO: 110643 - protein, 146 aa, Glycine max
  Coding DNA Sequence Number=SeqID_18958
MVKRLSLLKGRSSSHRPCHRPPEQHPHLRGSLRVLPLPEIGPIYRPCNCGPELLWGCTGKSSHSTAPDPYDWPLAGQPHATCRVPSSRCEQRWTLGMAAAMEVAVVHMRLATADVLFYKGPVNRRPDKLCGRNRHPIELAETRDQG

SEQ ID NO: 110644 - protein, 114 aa, Glycine max
  Coding DNA Sequence Number=SeqID_18959
MGSNTFLSLKIPVNEKHETGVFKAVAKTMDTSRLPSRTLAIPASLVKKGSKGLKNIFKAGLLLEEATQLTWPSWVRRQPPPPFSFKLAKGGCSKDPYPPWLCISVVLGENKLFP

SEQ ID NO: 110645 - protein, 185 aa, Glycine max
  Coding DNA Sequence Number=SeqID_18960
MKREKHVSYSSHNSCKSLSEELRDYYEGRHRSHLRPHSHRREKERKPQEANINLSYFHGKDNVEANLDWEIRVEQQLKNKSTSKSYSSHSYPKKDQGQGILGAAPSKPKDDKGKTIEKQPLRLATTSPSSSESEEEKGEESSEEIYPQEEGQPLMVKEGCKETLVSIAIPIGLEFIPQVKELLDE

SEQ ID NO: 110646 - protein, 202 aa, Glycine max
  Coding DNA Sequence Number=SeqID_18961
AYGQEKRAQRMRSSLALGRRITETIYETGYGRRRTGEIFQTSGAPDVDHPAPPLRGGIASLSSKLVDMVGLRDGEPATASPCRDARRAARVGNLYDEIARRRRSPPRHRRRRERLRASNPLAVAIPVTGWSRAQTAGTGVLGSSITETGAAVREGAETHAGSSASSLPRPDRSYPQGVRPGKTRAADAQQPRAGAADHRDDL

SEQ ID NO: 110647 - protein, 132 aa, Glycine max
  Coding DNA Sequence Number=SeqID_18962
IGAIVSNDLPRESVPINQLPLYESDHYTPRDIGVGSRFDLFGEIIYCHENEAMTVRSLGFDGPYDVYPPHGKMPRGEHDIQRMWQVINIVSERLTFKAFHYMGATITFHGEPVITCSQDLPGHSMPIGVCSK

SEQ ID NO: 110648 - protein, 98 aa, Glycine max
  Coding DNA Sequence Number=SeqID_18963
MEVNTAIVVAASTAIEVDLTHPSSLNQGKSPASDMVGQEGKALGSTGGPHFVQVQSKHSFPPYGLPPNYTPPNVAHTPDENIDNSTPILIEGQQPQFG

SEQ ID NO: 110649 - protein, 89 aa, Glycine max
  Coding DNA Sequence Number=SeqID_18964
  Pfam annotation: Domain name=DUF1723; Domain location=43-89; Score =12.9; E_value=0.016; Accession=PF08330.1; Description=Protein of unknown function (DUF1723)
ECPELKLSSHGRKVQKFGVPTAEIEGLVAATGLSPLIACSLDTGDRGLISAFAEMRHKETSSFHLLVGEVTITLDGGLFASFFHHKRLP

SEQ ID NO: 110650 - protein, 121 aa, Glycine max
  Coding DNA Sequence Number=SeqID_18965
  Homolog annotation: Hit_ID=A4EB57; Match level="QueryCoverage=52%, HitCoverage=56%, E-value=7e-17, Identity=52%"; Hit description =Putative uncharacterized protein
MGANGIRYPSSPSRKRWILGAVRIDPCNAVANALSIPAWGRLDMPRILLKERGAFGNADTGGAWLSSARATAGDKPEEGEDDVKSSCPLCPGRHTCYNGRDKGSRSREGELTPKTRPQFGL

SEQ ID NO: 110651 - protein, 189 aa, Glycine max
  Coding DNA Sequence Number=SeqID_18966
MDAHPCQDGVHQLALRHGEVGIMIGGQDVAEEQRHPYLGQGGHIGAHDSHSPPCSSPGKILPRPVPPLAILAFLALFQYHRISQELADSVGIERDPLTPNPGSHVTHALLCWPSIGIKLKDYFWIKLGHGSNQWCPPAGRPISSWKSVYSSSPELDASLPEKRPSLDGLEALLVYSTPKAGDYHTPERN

SEQ ID NO: 110652 - protein, 120 aa, Glycine max
  Coding DNA Sequence Number=SeqID_18967
  Homolog annotation: Hit_ID=Q6WAY3; Match level="QueryCoverage=86%, HitCoverage=4%, E-value=3e-08, Identity=33%"; Hit description =Gag/pol polyprotein
MEIYTSEGEGEEATDVSSLSAKVTNITGLSGVTRSGRVFAPADLPVQPANVKGKAKVVEEQDDEAPLTSNKDIPAKGLPENKDGKKEVSLEEASEFLRIIQQSEFKVIEQLNKTPARVSL

SEQ ID NO: 110653 - protein, 54 aa, Glycine max
  Coding DNA Sequence Number=SeqID_18968
MEKNEETTMEEKLACGASMEAGSLSLNEVLYKVIFHHGDAAEDKGEEVRGGAIH

SEQ ID NO: 110654 - protein, 99 aa, Glycine max
  Coding DNA Sequence Number=SeqID_18969
QARQGASAGVGGCRGWLNYAASEQIVLRVHHMRAIGAGLFAITPAGERGMCCKAIKLGNARVFPVTTLIPKGDFVVEFTVGIDKVSIIHYEVDDIIVGL

SEQ ID NO: 110655 - protein, 333 aa, Glycine max
  Coding DNA Sequence Number=SeqID_18970
  Subcellular localization annotation: CTP_CleavageSite=49; ConfidenceScore=5.27e-01
MLQVDSRGSRMTVTALGALYTNSASKPSRDGHFSGSDASSSGTTKEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPSLITGLCQSFRVPVAPTKVIRPPITRAFIEKYCTQRQAQGDAPQVAGAPPPPHQAGQAGSFDMEQYLRHLVRQQAANHRAHFRAEVAWPGDWPEAQAGEAPPEAPGDGGEAHEDEEMADLLDFLGGSGDT

SEQ ID NO: 110656 - protein, 113 aa, Glycine max
  Coding DNA Sequence Number=SeqID_18971
MEQFREMLAWPGTQPSLHREDEGEEADETQVRQVAATTPERSLEATLEPPAPVVDLPSPQHTADPSTPILEIPEDPTTPVLAMDTSPPATPILHLTDEEDVQTQDTQDQSQEF

SEQ ID NO: 110657 - protein, 123 aa, Glycine max
  Coding DNA Sequence Number=SeqID_18972
  Gene Ontology: Cellular component=chloroplast
  Homolog annotation: Hit_ID=A6FJQ2; Match level="QueryCoverage=30%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLALSHMDSLMCSLAPDPEMWIIQGILAWRTSPV

SEQ ID NO: 110658 - protein, 203 aa, Glycine max
  Coding DNA Sequence Number=SeqID_18973
DMTGRLLPGSLDFESRILHYLIVRILLPRSSKFAQVYEEDLIVMWAFHKGRQIDWAHLVQYRMNKALRLNAPFPYPHLVTLFLQHFNIPLDSEPYVSIKRSFLIGASVIASFGYQKEHDGSWVKKGAQHVDEEGHGEEDSSLLQKILDRFDGLQTFVGERFATLELQVDMRFNEMESRIAKVEEDVSYIRSSFDLPPPPPPSS

SEQ ID NO: 110659 - protein, 380 aa, Glycine max
  Coding DNA Sequence Number=SeqID_18974
  Gene Ontology: Mol. function=methionine adenosyltransferase activity; Cellular component=phagocytic vesicle; Biological process=one-carbon compound metabolic process
  Homolog annotation: Hit_ID=P23686; Match level="QueryCoverage=99%, HitCoverage=99%, E-value=0.0, Identity=83%"; Hit description=S -adenosylmethionine synthetase 1
  Pfam annotation: Domain name=S-AdoMet_synt_C; Domain location=228 -369; Score=286.7; E_value=4.6e-83; Accession=PF02773.7; Description =S-adenosylmethionine synthetase, C-te
  Pfam annotation: Domain name=S-AdoMet_synt_M; Domain location=104 -226; Score=331.4; E_value=1.6e-96; Accession=PF02772.7; Description =S-adenosylmethionine synthetase, cent
  Pfam annotation: Domain name=S-AdoMet_synt_N; Domain location=4-100; Score=137.6; E_value=3.4e-38; Accession=PF00438.11; Description=S -adenosylmethionine synthetase, N-te
  Pfam module annotation: Pfam domain module=S-AdoMet_synt_C::S-AdoMet _synt_M::S-AdoMet_synt_N; Domain location=228-369::104-226::4-100
MAQETFLFTSESVNEGHPDKLCDQISDAVLDACLEQDPDSKVACETCTKTNMVMVFGEITTKANVDYERLSATHAAKLDSSLMMLQQSPDIAQGVHGHFTKRPEEVGAGDQGHMFGYATDETPEYMPLSHVLATKLGARLTEVRKNGTCAWLRPDGKTQVTVEYYNDNGAMVPVRVHTVLISTQHDETVSNDQIAADLKEHVIKPVIPEKYLDEKTIFHLNPSGRFVIGGPHGDAGLTGRKIIIDTYGGWGAHGGGAFSGKDPTKVDRSGAYIVRQAAKSVVANGLARRCIVQVSYAIGVPEPLSVFVDTYGTGKIPDKEILQIVKENFDFRPGMITINLDLKRGGHRFLKTAAYGHFGRDDADFTWEVVKPLKSEKPQA

SEQ ID NO: 110660 - protein, 447 aa, Glycine max
  Coding DNA Sequence Number=SeqID_18975
  Gene Ontology: Mol. function=hydrolase activity, acting on glycosyl bonds; Cellular component=extracellular region; Biological process =cell wall organization and biogenesis
  Homolog annotation: Hit_ID=A7Q0T9; Match level="QueryCoverage=86%, HitCoverage=86%, E-value=1e-178, Identity=73%"; Hit description =Chromosome chr7 scaffold_42, whole genome shotgun sequence
  Pfam annotation: Domain name=Glyco_hydro_28; Domain location=93-429; Score=346.4; E_value=5e-101; Accession=PF00295.8; Description =Glycosyl hydrolases family 28
MKHSHILPLASCIFFLTLVILVQARHHSHHAKHKHSHPHKSSKTPKPAPPPSPPHNQNYNNASGIFDLRKFGAIGDGETDDTESFKMAWDSACQSESAVNVILVPQGFSFLVQSTIFTGPCQGVLELKVDGTLMPPDGPESWPKNNSRHQWLVFYRINGMSLEGSGLIDGRGEKWWDLPCKPHKAIRFFMSSNLTVQGLRIKNSPQFHFRFDGCKNVHIESIYITAPKLSPNTDGIHIENTNDVKIYNSVISNGDDCVSIGSGCNDVDIKNITCGPGHGISIGSLGNHNSRACVSNIMVRDSFIKVTDNGVRIKTWQGGSGSVSGVTFSNIHMVSVRNPIIIDQFYCLTKECTNKSSAVSVSNIIYTNIKGTYDIRSPPMRFACSDSVPCTNLTLSDIELLPSQGDIVHDPFCWNAYGDLETLTIPPVSCLLESTPQLVLDYDITRC

SEQ ID NO: 110661 - protein, 487 aa, Glycine max
  Coding DNA Sequence Number=SeqID_18976
  Gene Ontology: Mol. function=nucleic acid binding
  Homolog annotation: Hit_ID=A7Q0Q5; Match level="QueryCoverage=100%, HitCoverage=100%, E-value=1e-176, Identity=63%"; Hit description =Chromosome chr7 scaffold_42, whole genome shotgun sequence
  Pfam annotation: Domain name=zf-CCHC; Domain location=88-105; Score =12.9; E_value=0.017; Accession=PF00098.14; Description=Zinc knuckle
MANRSDPDIDDDFLELYKEYTGPLGSATTNTQERAKSNKRSNAGSDEEEEARDPNAVPTDFTSREAKVWEAKSKATERNWKKRKEEEMICKLCGESGHFTQGCPSTLGANRKSQDFFERIPARDKNVRALFTEKVLSKIEKDVGCKIKMDEKFIIVSGKDRLILAKGVDSVHKIREEGDQRGTSSSQMTRSRSPERSPVSARFQRSEPQRSHSGPRNTSQFQQRFGRQERAVEDRIRDDVQKFSRGSPQGRDSIGYVYSILRKLQECLTYSSFPEAYGNSGARGRSSQSRSPRHAPYTGNSYNSFEGRNQNMGAYRNDGWDSHRRESGIRPGHQFDYSASPQTLEELELEYKNEAAELMKIRDREEDEENFKHREAIRDLREKYMSKVSLVRDTHAKQWEGFLQLDAQRRQQQAVQQMPSGYRGFKQQSFPEYDGSTANPPPYAGSNLPLESRNRFSDNMETYPNRPHDNFGEFHRRGDFAKAYNRY

SEQ ID NO: 110662 - protein, 689 aa, Glycine max
  Coding DNA Sequence Number=SeqID_18977
  Gene Ontology: Mol. function=long-chain-fatty-acid-CoA ligase activity; Cellular component=external side of endosome membrane; Biological process=metabolic process
  Homolog annotation: Hit_ID=A7Q0R1; Match level="QueryCoverage=97%, HitCoverage=96%, E-value=0.0, Identity=70%"; Hit description =Chromosome chr7 scaffold_42, whole genome shotgun sequence
  Pfam annotation: Domain name=AMP-binding; Domain location=78-559; Score=257.2; E_value=3.6e-74; Accession=PF00501.19; Description=AMP -binding enzyme
MKSFAAKVEEGREGINGELSIGPVYRNLLSKNQFPPLDPDLSTAWDIFSMAVKKYPKNRMLGWREFVDAKIGPYVWKTYKEVYDEVLHIGSALRASGAELGSKIGIYGANCPQWIVAMEACCAHSLVCVPLYDTLGPGAVNFIIDHGELDFVFVQDRKTLEKQIEVLIGYMYYFQLLNPDCKSAQRLKAMVSFTSLTEEEKDKAISIGIKPYSWQEFLHMGKENPSNISAPQPNNICTIMYTSGTSGDPKGVVLTHENIATFVRGMDLFMEQFEDKMTVEDVYLSFLPLAHILDRTIEEYFFHKGASVGYYHGDLNALRDDLMELKPTFIKLIKDHLFLSGIKKAVEELNPVRRRVFGMLYKHKLGWMNKGYKHCNASPLADLLAFRKVKARLGGRVRLIISGGAPLSSEVEEFLRVTSCAFVCQGYGLTETCGSTTLAYPDEMCMLGTVGPVSVYNEMRLEEVPEMGYNPLGSPSCGEICLRGKTVFTGYYKNPELTREAIKDGWFHTGDIAEVQPNGVVKIIDRKKNLIKLSQGEYIALEHLENVYGITPIVEDVWVYGNSFKSALVAVVVPNEEITKKWAFSNGHIAPFSKLCSLDQLKKHVLSELKVTAERNKVNIYEYENNSLTQMKKHGFEYIKGVILDPQPFDMERDLVTSTMKKRRNNMLKYYQVEIDDVYRSLSGDKAKI

SEQ ID NO: 110663 - protein, 291 aa, Glycine max
  Coding DNA Sequence Number=SeqID_18978
  Gene Ontology: Mol. function=sequence-specific DNA binding; Cellular component=nucleus; Biological process=regulation of transcription, DNA-dependent
  Homolog annotation: Hit_ID=Q2PJR7; Match level="QueryCoverage=77%, HitCoverage=94%, E-value=1e-106, Identity=74%"; Hit description =WRKY51
  Pfam annotation: Domain name=WRKY; Domain location=97-156; Score =154.1; E_value=3.8e-43; Accession=PF03106.6; Description=WRKY DNA -binding domain
MGVKIQDYASNMESNNYPFFDFSEDKGSLGFMELLGAQDYSPLLDFPLSSHVSGPQTSSVKEPPETKKECSEAKKTNQKRQREPRFAFMTKSEVDHLEDGYRWRKYGQKAVKNSPFPRSYYRCTSVSCNVKKRVERSFSDPSIVVTTYEGQHTHPSPVMGRSNNFGSVIMSGSAGNYMSQYYQQQHQQVHIDALSSLGFLSSSSSRNATFPQETALLSDYGLLQDENIDEDFVAALGYLSFSFHSHHDHTCKTHECAFVSLARPCRLLGLRFSKREPIGDTVAKDLTQYGH

SEQ ID NO: 110664 - protein, 1971 aa, Glycine max
  Coding DNA Sequence Number=SeqID_18979
  Gene Ontology: Mol. function=carbohydrate binding; Cellular component= cellulose and pectin-containing cell wall; Biological process=mRNA processing
  Homolog annotation: Hit_ID=A7Q0P8; Match level="QueryCoverage=60%, HitCoverage=98%, E-value=0.0, Identity=67%"; Hit description =Chromosome chr7 scaffold_42, whole genome shotgun sequence
  Pfam annotation: Domain name=Cna_B; Domain location=1002-1079; Score =2.9; E_value=0.39; Accession=PF05738.4; Description=Cna protein B -type domain
  Pfam annotation: Domain name=Cna_B; Domain location=819-890; Score =2.9; E_value=0.39; Accession=PF05738.4; Description=Cna protein B -type domain
  Pfam annotation: Domain name=Cna_B; Domain location=916-974; Score =17.0; E_value=0.015; Accession=PF05738.4; Description=Cna protein B -type domain
  Pfam annotation: Domain name=DEAD; Domain location=261-423; Score =192.8; E_value=8.5e-55; Accession=PF00270.20; Description=DEADDEAH box helicase
  Pfam annotation: Domain name=Helicase_C; Domain location=473-549; Score=115.7; E_value=1.4e-31; Accession=PF00271.22; Description =Helicase conserved C-terminal domain
  Pfam annotation: Domain name=Y_Y_Y; Domain location=912-974; Score =6.2; E_value=0.096; Accession=PF07495.4; Description=Y_Y_Y domain
  Pfam module annotation: Pfam domain module=Cna_B::Cna_B::Cna _B::DEAD::Helicase_C::Y_Y_Y; Domain location=1002-1079::819-890::916 -974::261-423::473-549::912-974
MSKRKFGFEGFGINRQSTYSFERPQAPQRLYIPPSARHGHDHYEDTDIDNIDYDDNNSNNNNNKDDDDDYGSNNNNGGGNDEDEIDPLDAFMEGIHEEMRAAPPPKPKEKAEDRYRDDEDDDPMESFLMAKKDLGLTLASDALHAGYDSDEEVYAAAKAVDAGMIEYDSDDNPIVIDKKKIEPIPALDHSSIDYEPFTKDFYEETPSISGMSEQDVSEYRKSLAIRVSGFDVPKPIKAFEDCGFSSQIMNAIKKQGYEKPTTIQCQALPVVLSGRDIIGIAKTGSGKTASFVLPMIVHIMDQPELQKEEGPIGVICAPTRELAHQIFLEAKKFAKAYGVRVSAVYGGMSKLEQFKELKAGCEIVVATPGRLIDMLKMKALTMMRATYLVLDEADRMFDLGFEPQVREILSDPIRVTVGEVGMANEDITQVVHVTPSDSEKLPWLLEKLPEMIDQGDTLVFASKKATVDEIESQLAQRGFKVAALHGDKDQASRMDILQKFKSGLYHVLIATDVAARGLDIKSIKSVVNFDIAKDMDMHVHRIGRTGRAGDKDGVAYTLITLKEARFAGELVNSLVAAGQNVSVELMDLAMKDGRFRSKRDARKGGGKKGKGRGGGGGGGRGVRGVDFGLGIGYNPESNNAPSTTAPSRSAAVNSLRTGMMSQFKSNFVAASSNSQNQGFGNNTSMTANKRTALPGFVSGGSIGGDINTYQSTASPNPATSAVISTSQGYGVNPGQKSTNSSKPKERRRPSDLFIHLRLNSSPSIRSEMSIGDAFLCLLFIATCWISAASADSIYGCGGFVEASSSLVKSRKQTDAKLDYSDVTVELQTVDGLVKDRTQCAPNGYYFIPVYDKGSFVIKINGPPGWTWDPEKVPVVVDNNGCNGNEDINFRFTGFTISGRVVGAVGGESCSVKNGGPSNVKVELLSLSGDLVSSVLTSSSGSYLFTNIIPGKYELRASNPDMKVEVKGSTQVELGFGNGVVDDIFFVPGYSIGGFVVAQGNPILGVHIFLYSDDVSEVECLQGSANGPRQEVALCHAVSDADGKFTFNSIPCGSYELVPYYKGENTVFDVSPPSVSVNVKHQHATVPQKFQVTGFSVGGCVVDGNGMGVEGVKIIVDGHERSITDNQGYYKLDQVLPNMASIEDINAISYNLCGLVRMASGDLKVKVALTHGPDNVKPQKKQTDENGNFCFEVLPGEYRLSAIAATPENAAGLMFAPSYIDVVIPQLQCVTVIVKGENDEVSPNAVEMIVEGATNMGDSVCLHSGDDGALVNIHGDVSCKEKCGPFVSVTLVRQADKHNEERKTISLTTKSSEFLFSNVIPGKYRLEVKHSSPESVTLEDNWCWEQSFIDVNVGAEDLEGILFVQKGYWVNVISTHNVDGYLTQPDGSNVNLKIRKGFQHICVEQPGVHEFSFVDSCIFFGSSSVKINTSDQLPIHLIGEKYLLNGQINVQSGSLDALPDNIVVDIKHDGAGVIDYATATFKSHSKDQMEAAIFEYSVWTNLGEKLTFIPRDSRNDGQKKLLFYPREHQVSVTDDNCQVYIPTFSCQLGVYIEGSVSPPLSGVHIRVFAAGDSSFTTLKSGELVLETTTGIDGSFVAGPLYDDIGYNVEASKPGYHLKQVAPHSFTCQKLSQISVHIHHKDDSKEPIPSVLLSLSGDNGYRNNSVSGAGGTFLFDNLFPGMFYLRPVLKEYAFSPPAQAIDLGAGEFKEVVFQATRVAYSATGIVSLLSGQPKGEVSVEARSESKGYFEETVTDSSGNYRLRGLLPDTDYVVKVAKRDVGSSNIERASPDSIAVKVGTEDIKGLDFIVFEEPEMTIISCHVEGNGTDELHKHLMVEIRSASDLNKIESVFPLPISNFFQVKGLSKGRHLLKLQSGLPSSSLKFESDIIEVDLEKNVQIHVGPMRYRIEDQLKQELTPAPVFPLIVAFLVVALFLSMPRLKDLYQATVDIPTPGLTAASRKDVKKPLLRKKTY

SEQ ID NO: 110665 - protein, 521 aa, Glycine max
  Coding DNA Sequence Number=SeqID_18980
  Gene Ontology: Mol. function=transcription regulator activity; Cellular component=nucleus; Biological process=regulation of transcription
  Homolog annotation: Hit_ID=A9PFE6; Match level="QueryCoverage=75%, HitCoverage=82%, E-value=8e-35, Identity=31%"; Hit description =Putative uncharacterized protein
  Pfam annotation: Domain name=HLH; Domain location=331-380; Score =56.1; E_value=1.2e-13; Accession=PF00010.17; Description=Helix-loop -helix DNA-binding domain
MIQKMFDPSRSGMTRSSSHVASIYDNDFLELVWENGEVVVRGGSSNRSRKTNDERIHEDASINKRTRLNPLLYSLEDHFPPQRDSDMSTSHQSNGQDSCGQSSQSKLHEEFANLLKPVSIGNNHLQQCLPSSPLKKQRTVDSTQTPPTPKVNFSNFSIPAVFLKSTTHQGNSATQQTNNHSSPARMEEIIEARKVEQSVKESHGFQKQTSLTVERSTKLPTPPVDEHSEAVGHNCGVLGIHRSQGQLRCDQTSTSEALIRAKAKAYNNNANMCHEPLLASSSVCSLGASNDPNLGLRKHEDTETYLSDNDGEPEDMVKQDRDGNRVRRIRNPVVHNLSEKKRREKINKKMRTLKELIPNCNKVDKASMLDDAIDYLKTLKLQLQIMSMGNGLWPLMMLPAATTAHHMNPQLGMGFRPPQLPIPPSLSAITDNRLQMFGCFPNQIPPMPAMPHAPFFPIIANSATQPHLANTTNLAEHLAASLHGNATKLAPPSQNISALESDIVQFHAFSLIQYTAPMYYR

SEQ ID NO: 110666 - protein, 690 aa, Glycine max
  Coding DNA Sequence Number=SeqID_18981
  Gene Ontology: Mol. function=DNA-dependent ATPase activity; Cellular component=nucleus; Biological process=DNA replication initiation
  Homolog annotation: Hit_ID=A7Q0M6; Match level="QueryCoverage=99%, HitCoverage=99%, E-value=0.0, Identity=81%"; Hit description =Chromosome chr7 scaffold_42, whole genome shotgun sequence
  Pfam annotation: Domain name=AAA_3; Domain location=332-484; Score= -12.7; E_value=0.0083; Accession=PF07726.2; Description=ATPase family associated with various
  Pfam annotation: Domain name=AAA_5; Domain location=332-490; Score= -8.3; E_value=0.012; Accession=PF07728.5; Description=ATPase family associated with various
  Pfam annotation: Domain name=MCM; Domain location=274-610; Score =657.3; E_value=1.3e-194; Accession=PF00493.14; Description=MCM235 family
  Pfam annotation: Domain name=Mg_chelatase; Domain location=323-494; Score=-154.7; E_value=0.082; Accession=PF01078.12; Description =Magnesium chelatase, subunit ChlI
  Pfam module annotation: Pfam domain module=AAA_3::AAA_5::MCM::Mg _chelatase; Domain location=332-484::332-490::274-610::323-494
MSAKNLNFDADTALAKDFLSNFADANGEAKYMNILQDVANHKTRAVQIDLEDLFNYKDLDEEFLSRVTDNTRRYIGIFSNAIDELMPEPTEDFTDDDHDILMTQRSDEGVEGTDGSDPRQKMPPEIKRYYELYIKASSKGRPSTIREVKASNIGQLVRISGIVIRCSDVKPLMKVAVYTCEDCGFEIYQAKIQELAEHVPKGHIPRTMTVHLRGELTRKVAPGDVVEFSGIFLPIPYTGFRAMRAGLVADTYLEAMSVMHFKKKYEEYEFRGDEEEQIARLAEDGDIYNKLARSLAPEIFGHDDIKKALLLLLVGAPHRTLKDGMKIRGDLHICLMGDPGVAKSQLLKHIINVAPRGVYTTGRGSSGVGLTAAVQKDPVTNEMVLEGGALVDIIKEHSKFQVLADMGICAIDEFDKMDESDRTAIHEVMEQQTVSIAKAGITTSLNARTAVLAAANPAWGRYDLRRTPAENINLPHALLSRFDLLWLILDRADMDNDLEMARHVLYVHQNKESPALGFTPLEPSVLRAYISAARRLSPSVPRELEEYIATAYSSIRQEEARSNAPHSYTTVRTLLSILRISAALARLRFSETVAQSDVDEALRLMQMSKFSLYSEDRQKSGLDAISDIYSILRDEAARGNRMDVSYAHALNWISRKGYSEAQLKECLEEYAALNVWQIHPHTFDIRFIDA

SEQ ID NO: 110667 - protein, 895 aa, Glycine max
  Coding DNA Sequence Number=SeqID_18982
  Gene Ontology: Mol. function=triacylglycerol lipase activity; Cellular component=DNA-directed RNA polymerase III complex; Biological process=lipid metabolic process
  Homolog annotation: Hit_ID=A5AS61; Match level="QueryCoverage=67%, HitCoverage=85%, E-value=1e-155, Identity=50%"; Hit description =Putative uncharacterized protein
  Pfam annotation: Domain name=Lipase_3; Domain location=326-465; Score= 115.1; E_value=2e-31; Accession=PF01764.16; Description=Lipase (class 3)
  Pfam annotation: Domain name=RNA_pol_Rbc25; Domain location=760-887; Score=89.4; E_value=1.1e-23; Accession=PF08292.3; Description=RNA polymerase III subunit Rpc25
  Pfam annotation: Domain name=RNA_pol_Rpb7_N; Domain location=689-758; Score=71.8; E_value=2.3e-18; Accession=PF03876.8; Description=RNA polymerase Rpb7, N-terminal domain
  Pfam module annotation: Pfam domain module=Lipase_3::RNA_pol _Rbc25::RNA_pol_Rpb7_N; Domain location=326-465::760-887::689-758
  Subcellular localization annotation: CTP_CleavageSite=73; ConfidenceScore=5.36e-01
MDALCLHSSICGIAPSPSILITATARANDYASHSRVKAVGSSSLFSIFSFRYPLKSFWPRPTGNATGYNDAVLAENATAETEQPEGEGEGQNGNWVFKIFHIRSVWRGEQRSDDNDEEEAVTNGQTDEEEEECDDCRVDYDDDEEEEENEEVSFDRDSFSRMLRRPGKLFKHYGLRFVTSSIEKKELAMAAEKNQISQKEETNEKDVDETKEEKNNGGYMISASAVYEIAASAASYLHAQTRSILSLTSSDAAEGEGSIEAINESFNGDKIRNTEEANLKATTDSVTAVVAANEQVKQAFADDLNSTSSSPCEWFVCDDDQTSTRYFVIQGSESFASWQANLLFEPVQFEGLDVHVHRGIYEAAKGTYQQMLPEIRAHLKSHGSRATFRFTGHSLGGSLALLVNLMLPIRKEALFSSLLPVITFGAPSIMCGGDTLLDMLGLPRSHVQAITLHRDIVPRAFSCQYPNHLVELLKAVNGNFRNHPCLNNQKLLYAPMGELLILQPDENFSPSHHLLPSGSGLYILSGSLSESSDTLKQIYKAQMVFLNTPHPLEILSDRSAYGFGGTIQRDHDMNSYLKCVRTVIRQELNQIRKARREQRQKSRKTQPTTQVRNPNAKLLVAPKASAVSVAPESRHSVVNIFLTKRRSMEGHQFFRMSIEQNHNQKHLYLPLASQLYSSIGSMFYLSKIEHKLPLPPSRFVLPIREAIHMELEKLFLDKVIANLGLCISVYDIRSIDGGFIFPGDGAPTYTVVFNLIMFRPFEKEIITARLLSSDADGLRLTIGFFDDIYIPASRLPDPNHFVETEQKKRVFSGQESTTNSSSKKGVWYWDYNEQEYPIQDTDVIKFRVTNVSYPQIPVEQPKESKPFAPMLISGAMDDDGLGPVSWWFADEDEDE

SEQ ID NO: 110668 - protein, 513 aa, Glycine max
  Coding DNA Sequence Number=SeqID_18983
  Gene Ontology: Mol. function=hydrolase activity, acting on glycosyl bonds; Cellular component=cellulose and pectin-containing cell wall; Biological process=cell wall organization and biogenesis
  Homolog annotation: Hit_ID=A7Q8H9; Match level="QueryCoverage=78%, HitCoverage=78%, E-value=1e-159, Identity=66%"; Hit description =Chromosome chr5 scaffold_64, whole genome shotgun sequence
  Pfam annotation: Domain name=Glyco_hydro_28; Domain location=110-462; Score=3.6; E_value=2.5e-09; Accession=PF00295.8; Description=Glycosyl hydrolases family 28
MKSLGHHKLRQYLVRIHFFFNENSVEILEIGHYAKIEILVVQWYGTDYRAISTAVESNGEDNGGPCKQNAFKARPHSVSILEFGAVGDGITLNTVAFENAMFYLKSFADKGGAQLYVPSGKWLTGSFNLTSHLTLFLERGAIIIASQDYSHWDIVDFLPSYGRGIGRYRSLIYGQNLSDVVITGDNGTIDGQGSIWWELFSSNSLNYSRPNLIEFVDSVDIIISNLTFLDSPAWGIHPVHCSNVQIQNITSRAPAEFPYTSGIVPDSSRYVCIENSNISTGHDAVVLKSGWDQYGIAYGKPTSSVHISNVYLQSSSGAGLAFGSEMSGGISDIIAEKLHILNSPIGIELKTTKGRGGYMRGIFISDAELENISLGISMTGYSGFHPDDKYDTSALPIVGDITFKNVIGANISVAGNFSGIVESPFSTICLSNVTFSLSSEPSPSWFCSNVIGFSEDVIPEPCPDLQSSYSKFSFSCFSSLYPLFSNVSGYLDHQPQELQSLIFIHSIHEIQNS

SEQ ID NO: 110669 - protein, 184 aa, Glycine max
  Coding DNA Sequence Number=SeqID_18984
  Gene Ontology: Mol. function=enzyme inhibitor activity; Biological process=metal ion transport
  Homolog annotation: Hit_ID=A7PR97; Match level="QueryCoverage=78%, HitCoverage=20%, E-value=3e-09, Identity=32%"; Hit description =Chromosome chr14 scaffold_26, whole genome shotgun sequence
  Pfam annotation: Domain name=PMEI; Domain location=29-174; Score =93.4; E_value=7.1e-25; Accession=PF04043.6; Description=Plant invertasepectin methylesterase inhibitor
MERSTKLFSAALVLFVVVVAHQAAASQDLKGKKLINKVCTIAPSRDLCVQILSSDPIRSPNADLKDLAVISLRVAARNASGILSDTKMLIDDDNLDPDVQQGLADCKETILDAESQLEDTIASLLVGSDTDAQVWLKAAVAAIDTCDASIPGDDDVLSVKSAMFRRLCNIAIAISKLLNKPLKF

SEQ ID NO: 110670 - protein, 83 aa, Glycine max
  Coding DNA Sequence Number=SeqID_18985
  Gene Ontology: Mol. function=hydrolase activity
  Homolog annotation: Hit_ID=O22248; Match level="QueryCoverage=95%, HitCoverage=29%, E-value=2e-23, Identity=55%"; Hit description =Putative phospholipase
MVWGGTEAKKGWDECGVRLACAKYAVFGMDYEGHGRSEELQEYKAKARFLYGESMGGAVSLLLHKKDPSFWDGAVLVAPMCKV

SEQ ID NO: 110671 - protein, 272 aa, Glycine max
  Coding DNA Sequence Number=SeqID_18986
  Gene Ontology: Cellular component=respiratory chain complex I; Biological process=photorespiration
  Homolog annotation: Hit_ID=B0LUW2; Match level="QueryCoverage=22%, HitCoverage=73%, E-value=4e-25, Identity=83%"; Hit description=NADH -ubiquinone oxidoreductase-like protein
MASSVVGGFVTQAFVFMLKDCYGNKFFELEKAIRDYTCTLDPYFHCFHCSIGNIDSLVHLVMMLLMHDKEEGEKSREIVATEVEVALGMAPAREMHGATRRIKMCNKGFHEFTAETNREERTVKKNRRPQMKRSPWGSELQEELSCLGGIEEVALNWNAICENCLGWQGDSWGAIVWSEIRGREEALGVERAKEREMASGWGITGNKGRCYDFWMDFSECMSRCREPKDCALLREDYLECLHHSKEEETDVEVFRLELIFQLPVSALVHNRK

SEQ ID NO: 110672 - protein, 867 aa, Glycine max
  Coding DNA Sequence Number=SeqID_18987
  Gene Ontology: Mol. function=zinc ion binding; Cellular component =COPII vesicle coat; Biological process=ER to Golgi vesicle-mediated transport
  Homolog annotation: Hit_ID=A7Q0Z5; Match level="QueryCoverage=100%, HitCoverage=100%, E-value=0.0, Identity=70%"; Hit description =Chromosome chr7 scaffold_42, whole genome shotgun sequence
  Pfam annotation: Domain name=Sec23_BS; Domain location=486-580; Score= 67.7; E_value=3.8e-17; Accession=PF08033.3; Description=Sec23Sec24 beta-sandwich domain
  Pfam annotation: Domain name=Sec23_helical; Domain location=592-692; Score=98.6; E_value=1.9e-26; Accession=PF04815.6; Description =Sec23Sec24 helical domain
  Pfam annotation: Domain name=Sec23_trunk; Domain location=238-481; Score=-48.9; E_value=1.8e-08; Accession=PF04811.6; Description =Sec23Sec24 trunk domain
  Pfam module annotation: Pfam domain module=Sec23_BS::Sec23 _helical::Sec23_trunk; Domain location=486-580::592-692::238-481
MANPTQPNVGFTPEREISNPEKSPIPPPPSFVASSPGFPPPKLHLQQDQASSRSVKTPNVLSPANGVTTGSPVPHLSTPPGPPVFTSPVRPAAVPFRTSPALPQPLAFSPGSSLPTSSSPLQFSNGTFESQHQVSDSIEDHVPLGESSFVLFSAHKVLKQKKQANVPSLGFGALVSPGREVSVGPQCVICRKLNGSEGEYIAHSKEDLHRFPELSSPMFDYVQTGNKRPGFVPVSDSRMSAPIVLVIDECLDEPHLHHLQSSLHAFVDSLPPTTRLGIILYGRTVSVYDLSEEAMASADVLPGDKSPSQESLKALIYGTGIYLSPMHASLAVAHSIFSSLRAYKLNVPEASRDRCLGTAVEVALAIIQGPSADLSRGLVKRSGGNSRIIVCAGGPNTYGPGSVPHSFSHPNYPYMEKTGIKWMENLGHEAHRHNTIIDILCAGTCPVRVPILHPLAKTSGGVLVLHDDFGEAFGVNLQRASARSAGSHGLLELRTSDDILITQVVGPGEGSRVDTHETFKNDTALYIQMLSVEETQSFSLSMETEGDIKSDFVFFQFAIQYSNVYQADVSRVITVRLATVDSISAYLESVQDEVAAVLIAKRTLLRAKNHSDAIDMRATVDERIKDIALKFGSQLPKSKLHSFPKELSLLPELLFHLRRGPLLGSIIGHEDERSVLRNLFLNASFDLSLRMVAPRCLMHREGGTFEELPAYDLAMQSDAAVVLDHGTDVFIWLPFLLPGQWLLPVLKAAVAGGQMASQGGAELAADEGRSAAALAACRTLAEELTEYRFPAPRILAFKEGSSQARYFVSRLIPAHKDPPYEQEARFPQLRSLTSEQRTKLKASFVHFDDPSFCEWMRSLKVVPPQPS

SEQ ID NO: 110673 - protein, 246 aa, Glycine max
  Coding DNA Sequence Number=SeqID_18988
  Homolog annotation: Hit_ID=A7Q0B0; Match level="QueryCoverage=52%, HitCoverage=70%, E-value=1e-43, Identity=68%"; Hit description =Chromosome chr7 scaffold_42, whole genome shotgun sequence
  Pfam annotation: Domain name=CS; Domain location=53-129; Score=73.1; E_value=9.1e-19; Accession=PF04969.7; Description=CS domain
MTFTLLKKVLGENSKIVDGKCKALVQFVKLGWANIVTSEYILENDSTQGSRHPEVKWAQRLDKVYITVQLADSKNAKVDLTPDGIFTFSGSAGAEDHQYELKLELFDKVNVEESKINVGERSIFIVVQKAEDGWWKRLLRGEGKTPHYVKVDWDKWVDEDEDEGNTGEVDLGGMDFSKFGGMGADAMGGMDAMGGMGGMDFSKFGGMGDAMDDIDESDDEEQEVSKPVEQDAGEGSTEKKEAAPST

SEQ ID NO: 110674 - protein, 391 aa, Glycine max
  Coding DNA Sequence Number=SeqID_18989
  Gene Ontology: Mol. function=thiamin diphosphokinase activity; Cellular component=ribonucleoprotein complex; Biological process =thiamin diphosphate biosynthetic process
  Homolog annotation: Hit_ID=A7Q0A5; Match level="QueryCoverage=66%, HitCoverage=100%, E-value=1e-108, Identity=72%"; Hit description =Chromosome chr7 scaffold_42, whole genome shotgun sequence
  Pfam annotation: Domain name=LSM; Domain location=250-316; Score =52.2; E_value=1.8e-12; Accession=PF01423.13; Description=LSM domain
  Pfam annotation: Domain name=TPK_B1_binding; Domain location=184-252; Score=78.2; E_value=2.7e-20; Accession=PF04265.5; Description=Thiamin pyrophosphokinase, vitamin B1 binding domain
  Pfam annotation: Domain name=TPK_catalytic; Domain location=33-173; Score=178.3; E_value=2e-50; Accession=PF04263.7; Description=Thiamin pyrophosphokinase, catalytic domain
  Pfam module annotation: Pfam domain module=LSM::TPK_B1_binding::TPK _catalytic; Domain location=250-316::184-252::33-173
MELMCHCSSFLLPPENPNTTCSLSLKYALVVLNQSLPRFAPLLWDHAQVRVCADGGANRVYDEMPLFFPHQQPSHVRTRYKPDVIKGDMDSIRTEVLDFYAKLGTKIIDESHDQDTTDLHKCVAYIRDLTPNVDGSELCILVAGALGGRFDHEIGNINVLCRFSNTRIILLSDDCLIHLLPKNHCHQIFIESSVEGPHCGLIPIGMPSGSSTSTGLKWDLNDTAMSFGGLVSTSNIVKGEIVTVQSDSDLLWTISIKKLELVELKNGETYNGHLVNCDTWMNIHLREVICTSKDGDRFWRMPECYIRGNTIKYLRVPDEVIDKVQEETKSRADRKPPGVGRGRGRGREEGPGGRPTKGIGRGLDDGGARGAGGSRGRGGPSGKPGGNRGKS

SEQ ID NO: 110675 - protein, 195 aa, Glycine max
  Coding DNA Sequence Number=SeqID_18990
  Gene Ontology: Mol. function=transferase activity, transferring glycosyl groups; Cellular component=integral to membrane; Biological process=polysaccharide biosynthetic process
  Homolog annotation: Hit_ID=A7Q099; Match level="QueryCoverage=70%, HitCoverage=32%, E-value=5e-75, Identity=90%"; Hit description =Chromosome chr7 scaffold_42, whole genome shotgun sequence
  Pfam annotation: Domain name=Glyco_transf_34; Domain location=1-135; Score=58.7; E_value=1.9e-14; Accession=PF05637.3; Description =galactosyl transferase GMA12MNN10 family
MVYDDKNWIGLNTGNFLLRNCQWSLDILDAWAPMGPKGKVRDEAGKVLTRELKDRPVFEADDQSAMVYLLAKERDKWEGKVYLENGYYLHGYWGILVDRYEEMIENYHPGFGDHRWPLVTHFVGCKPCGKFGDYPVERFMALHTSRWVVGGELREYGMRLAILLRSKMNLGCFIQRLKQLSLSLFLGLKLLNLYL

SEQ ID NO: 110676 - protein, 504 aa, Glycine max
  Coding DNA Sequence Number=SeqID_18991
  Gene Ontology: Mol. function=nucleic acid binding; Cellular component= intracellular; Biological process=regulation of transcription
  Homolog annotation: Hit_ID=A7PTW6; Match level="QueryCoverage=89%, HitCoverage=99%, E-value=1e-139, Identity=56%"; Hit description =Chromosome chr7 scaffold_31, whole genome shotgun sequence
  Pfam annotation: Domain name=RS4NT; Domain location=118-155; Score =13.9; E_value=0.035; Accession=PF08071.3; Description=RS4NT (NUC023) domain
  Pfam annotation: Domain name=zf-C2H2; Domain location=133-155; Score =24.2; E_value=0.00048; Accession=PF00096.17; Description=Zinc finger, C2H2 type
  Pfam annotation: Domain name=zf-C2H2; Domain location=160-181; Score =17.5; E_value=0.052; Accession=PF00096.17; Description=Zinc finger, C2H2 type
  Pfam annotation: Domain name=zf-C2H2; Domain location=57-79; Score =26.4; E_value=0.0001; Accession=PF00096.17; Description=Zinc finger, C2H2 type
  Pfam module annotation: Pfam domain module=RS4NT::zf-C2H2::zf -C2H2::zf-C2H2; Domain location=118-155::133-155::160-181::57-79
MFDICECSYIISRGASNSMFNCYLPKFCQLMDAFDETDPNAEVVVLSPTTLMATNRFVCEICNKGFQRDQNLQLHRRGHNLPWKLRQRTSAEVKKRVYVCPEPSCVHHNPARALGDLTGIKKHYSRKHGEKKWKCDKCSKRYAVQSDWKAHQKTCGTREYKCDCGTIFSRRDSFITHRAFCDALTEENNRVNNQGLTSGMPPNLQSKIPDLMSTMPLTTSPNTTTKFGDYDPKNPLKSLAQELVPIPFKPTSMGGGMFSTNAGARFGGPKTMSPSSSSLQLGSSTSSSFNYLQDSKNGGLIAASAQMSATALLQKAAQMGATASNSINSPMMQKGFVGGTTTGPDHVSFTTRPPYYGAMLQHNNSYDHFSPQHDLSNMAGVSGGGAFINQLFHKGQEISQVFDTNTTMNGVGMFSQMPMGSEHNHNQGLMKNVEQEVSNGSSLIHVRDVSDGNHTMQPSRFGGSDMTTVHDFLGIGGSTSRVMNHFHHHFPHEDSAIEEPMWDV

SEQ ID NO: 110677 - protein, 53 aa, Glycine max
  Coding DNA Sequence Number=SeqID_18992
MLFCGKVEEEEVGREGAYQARAYGGDDDDVCVSQMTKHKTQPEAKVVGWVHFN

SEQ ID NO: 110678 - protein, 325 aa, Glycine max
  Coding DNA Sequence Number=SeqID_18993
  Gene Ontology: Cellular component=integral to membrane
  Homolog annotation: Hit_ID=A7PHL8; Match level="QueryCoverage=74%, HitCoverage=88%, E-value=1e-43, Identity=37%"; Hit description =Chromosome chr17 scaffold_16, whole genome shotgun sequence
  Pfam annotation: Domain name=MtN3_slv; Domain location=142-227; Score= 53.2; E_value=9.1e-13; Accession=PF03083.7; Description=MtN3saliva family
  Pfam annotation: Domain name=MtN3_slv; Domain location=24-108; Score =18.2; E_value=0.00017; Accession=PF03083.7; Description=MtN3saliva family
  Pfam module annotation: Pfam domain module=MtN3_slv::MtN3_slv; Domain location=142-227::24-108
MQAVRGDEENFLRETKVIEPNECVRNIVNSLIYLAPMVTIYDTFQEQTKQHYNAIPYSLSLFTASLMLYYAHLKGNEEALLLITINSIGCTMEVAYLIICYIYANFRAKTVIVRWVFLFNGATYLVILFLTSLVSPLSNRLKVVGWICATFSVGVYVTSLINPMMRTVVRTKCISMPLLISLTLSSIVWFFYGFFSHDYFIVMPNVLHFWLGVAQMILCFIYRNGGADERERVQSETGEINNENDEILETIEMQIAEAKNTNVDHQTDNDDIKKKENGSSSRVELEPCEIVHLQNNIVVVTRNGTRIVCNEIQSVAEPEIVEIPG

SEQ ID NO: 110679 - protein, 170 aa, Glycine max
  Coding DNA Sequence Number=SeqID_18994
  Subcellular localization annotation: CTP_CleavageSite=37; ConfidenceScore=5.67e-01
MASFWSFLAMLMAMLACSCSLALASSSQQSMQVTSITAAPASAPLVSPTQSPDIEPLFPTPGAGGVSHSPSYSSLPQFLQARALLIPTQKSWALQALCWILCHLRLLLSTILISPYIQFHFSSEVGDFHGIKAGKFSHYSLRDTKERSPCHRQPTNFAIDRTKDEEVPFT

SEQ ID NO: 110680 - protein, 172 aa, Glycine max
  Coding DNA Sequence Number=SeqID_18995
  Gene Ontology: Mol. function=flavin-containing monooxygenase activity; Cellular component=microsome; Biological process=electron transport
  Homolog annotation: Hit_ID=A7PTZ7; Match level="QueryCoverage=78%, HitCoverage=35%, E-value=3e-55, Identity=70%"; Hit description =Chromosome chr7 scaffold_31, whole genome shotgun sequence
MVSLGLFLLKYLSLSTVDSLMVMLSTMIYGDVTKYGVARPNEGPFYMKVKYGKYPVIDVGTYKKIKSGELKVLPSEIESLRGKDVLFKNGESHPFDSIVFCTGFKRSTNKWLKGDDYLLNDEGLPKPSYPIHWKGNNGLYCVGLSRRGFYGAAADAENIANDIALLAAIAAS

SEQ ID NO: 110681 - protein, 143 aa, Glycine max
  Coding DNA Sequence Number=SeqID_18996
  Homolog annotation: Hit_ID=A5BJX0; Match level="QueryCoverage=90%, HitCoverage=97%, E-value=2e-13, Identity=46%"; Hit description =Putative uncharacterized protein
MDSQAGGNKSNMQFGVEKLVGSNYNCWWLCMEAFLPGQDLWDLMVGNDTEMPPDTPNRTEAQRKWKVKCGKALFALRTTVSKELIDHIEILTHQRCTKHIEVHHHFVREKVLNKEIDLKKIHTKKHLADIFTKALVKPLFEKF

SEQ ID NO: 110682 - protein, 300 aa, Glycine max
  Coding DNA Sequence Number=SeqID_18997
  Homolog annotation: Hit_ID=Q6WAY6; Match level="QueryCoverage=43%, HitCoverage=21%, E-value=6e-14, Identity=38%"; Hit description =Putative uncharacterized protein
EISVVAILADLYDTFDRRCVKNGTRILCCMPALYVWLVSHLFRQESRPTCPLHRHRLCTEKGKANWEQLLASVVGASINWFPRWKEGKVGVLSSCEGFSNVPLMGTRGCINYNHVLTIRQLGYPMRGAPSKESITPFITRGFSDPNARWLRVRTQGLDWLPKLRAARKEEAETPEESEEVQALKAELEQARAVKEKFKSTAIKVRKEYDELKDINMATTEALEQETKKALKEEHDRNKFRGALWGRYNELKLQRDEKDQSRVEVMILKDELKDCHRSKRSLSQQLSKTEGNIWAIINDYK

SEQ ID NO: 110683 - protein, 164 aa, Glycine max
  Coding DNA Sequence Number=SeqID_18998
  Gene Ontology: Mol. function=ATP-dependent helicase activity; Cellular component=intracellular; Biological process=DNA recombination
  Homolog annotation: Hit_ID=Q0CJX7; Match level="QueryCoverage=59%, HitCoverage=6%, E-value=5e-17, Identity=52%"; Hit description =Putative uncharacterized protein
MTRHNLEVHLKWLLQQGPSLYPSLSPSARENRNSIRENHTQNRLIPALHATGNQVPEIAIGDSQPLQKKPVDNVEKDFEVESDEDMARLLMAPQSASKPGYRARIRNHGHSCFLRETCRASCINESANARGEAVCVLGALPLPRSLTRCARSFGCGERYQLTQR

SEQ ID NO: 110684 - protein, 251 aa, Glycine max
  Coding DNA Sequence Number=SeqID_18999
  Homolog annotation: Hit_ID=UPI0000ECA21E; Match level="QueryCoverage =17%, HitCoverage=11%, E-value=8e-17, Identity=95%"; Hit description =UPI0000ECA21E related cluster
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPEEHALELVELGPTFVVDSVALAARSGRETCRASCINESANARGEAVCVLGALPLPRSLTRCARSFGCGERYQLTQRRTIKIPGVSPWKLPRALSCSDPAAYRIPVVRSKLGCVHEPPVQPDRCALSGNYRLEFNPVRHDLSPLAAATGNRISRA

SEQ ID NO: 110685 - protein, 147 aa, Glycine max
  Coding DNA Sequence Number=SeqID_19000
  Subcellular localization annotation: CTP_CleavageSite=33; ConfidenceScore=5.15e-01
MRRNSLASSSNTSFLPQPSLFIWKTFHWNILVRSEGRFVTLFFHHLCLPFNVCGLCRQVGGCKHATVVGPPPSPVILVTLADNELMSVASSFLSLGGAYIHGTAWLFRYGNRTGLTTKGYQGFWGAASLVKYITKGLGLPKLLSSGD

SEQ ID NO: 110686 - protein, 44 aa, Glycine max
  Coding DNA Sequence Number=SeqID_19001
MASSGTPTIFTVLQMSMYVASWIKEYGYEKLAVCTSGLDMLVKY

SEQ ID NO: 110687 - protein, 117 aa, Glycine max
  Coding DNA Sequence Number=SeqID_19002
LRGSSNGVIAGYHQWLKARMQGITWLPKLKSSSGGETEVPKESEEVQALKAKLERTQVVKEKFKATTIRVRKECDKMRDVKDKLKACQRSKRILNEQLSRTEENMWAIIDQYKEIRS

SEQ ID NO: 110688 - protein, 115 aa, Glycine max
  Coding DNA Sequence Number=SeqID_19003
  Homolog annotation: Hit_ID=A5BEV8; Match level="QueryCoverage=80%, HitCoverage=11%, E-value=4e-12, Identity=43%"; Hit description =Putative uncharacterized protein
MERFEELKHSLLVDGLSMVTMDKWTNITDMGCVIASRYNVNVVSLPRQQNMTFFPLRSQPPPDSSVHRVICIGHVYGNHFVQVFLRDQCPLPPLAFIVEYTLSLSGKEVAHPIHR

SEQ ID NO: 110689 - protein, 53 aa, Glycine max
  Coding DNA Sequence Number=SeqID_19004
MGCYNGQCLSISVIQLWILHLTETTMRAGNSDVYGFLEPQSIQRSRQSQFDSE

SEQ ID NO: 110690 - protein, 15 aa, Glycine max
  Coding DNA Sequence Number=SeqID_19005
MEVFLADRMVGNEKD

SEQ ID NO: 110691 - protein, 89 aa, Glycine max
  Coding DNA Sequence Number=SeqID_19006
  Homolog annotation: Hit_ID=UPI0000ECBAF8; Match level="QueryCoverage =46%, HitCoverage=48%, E-value=1e-16, Identity=100%"; Hit description= UPI0000ECBAF8 related cluster
MMSWVMWKDTHQIYPGQHFTPYRKHFAAVKKQSRPAGMQAWHWPSFYNVVTGKTLALPNLIALQHIPLSPAGVIAKRPAPIALPNSCAA

SEQ ID NO: 110692 - protein, 163 aa, Glycine max
  Coding DNA Sequence Number=SeqID_19007
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPRLGVCTTELAVESSKPSVDD

SEQ ID NO: 110693 - protein, 40 aa, Glycine max
  Coding DNA Sequence Number=SeqID_19008
MDEWDDKTTRLKMKGRKESLFPARATHKGCESPLIQPGCS

SEQ ID NO: 110694 - protein, 96 aa, Glycine max
  Coding DNA Sequence Number=SeqID_19009
MAKFDPDIVLEFYANAWPIEEGVRDMWSWVMGQWIPFDADALSQFLGYPLVLEEGHESGFCPDRCHETGADHAHQHDYLDPDMDDVAAQQHPAQRS

SEQ ID NO: 110695 - protein, 147 aa, Glycine max
  Coding DNA Sequence Number=SeqID_19010
MDPLFTMTVVFPFKLPLQFPYEYLTGNQFRFQCMQLKDDADVNTMLMCNHEFSFVGSIELLCSIARTPNGILNILEATMTPTHDALLYYNGRWNMSRQNEFVGYSFTGKNPKNFDIPIGCTMDELKDLIKQVAPRGISPYGIDETQM

SEQ ID NO: 110696 - protein, 128 aa, Glycine max
  Coding DNA Sequence Number=SeqID_19011
DLQVLQVDPSSKSFRGLHILAVIGLHVLAFRGLHVLAFRGLHVLAIRGQHVLAFRGLPALTFRGLHVLTFKGLDVLAFSGLHALASTSEDSTSSPPEGYMPSPSKGNTPSLSEGCTFSPSEDYTSSPS

SEQ ID NO: 110697 - protein, 198 aa, Glycine max
  Coding DNA Sequence Number=SeqID_19012
LPYERCAPEETIAPFVARGFNEGNAKILQRICKAWNTVERKDKELRGSSNGVISGYHKWLKARTQGITWLPKLRDPSKKEVEVPEESEKVKALKAELERTKVIKEKLKTTVTRVKKECDKLRDVNMTTTEALKRETKRAQKEEWSRNKYRGALWGSNNELKLRRVERDESRLESMVLEDKLKACQRSKKSLTEQLSRT

SEQ ID NO: 110698 - protein, 196 aa, Glycine max
  Coding DNA Sequence Number=SeqID_19013
MGYNRMKPSKVSYQNIKQTMKFDNQELFVLTNEFHYPSREAINDKFNCLIDNIWNIPKHTNNNEHFFYLVKKNIVCALYNFSIVDNQGVLLLTKASPSGKGYTTFVLLSGPHKGVYTNFKDLCLAKEGIQSPIYIGFYSREEAEKALELNTTNINKIKKALEPETTNIVINADQTKTCHKTYKDSVSSNVPRPVNR

SEQ ID NO: 110699 - protein, 146 aa, Glycine max
  Coding DNA Sequence Number=SeqID_19014
APLDPDKSNRALGFPALITGLCQSFGVPVAPTKVIRPPITRAFIEKYCTQRQAQGDAPQAAGAPPPPHQAGQAGAFDIEQYLRHLVRQQAANHRAHTSSGQRLHGPEIGPKAQAGEAPPEAPGDGEEAHEDEEMADLLDFLGGSGD

SEQ ID NO: 110700 - protein, 205 aa, Glycine max
  Coding DNA Sequence Number=SeqID_19015
MFSVQDSFEEQMTQGSFVPHGRQDVLTAATGRLEHPGRVCAAGVGVTIKQYFGSAPRTSRSSSSLPPEELLQLTQQIRDLLEESITEKVTRQLMASFSQMQSQIQSQMQSQGLALPPEPLVGPSGPRVSTKGSFVDPSRNNPKTGDLDRHLTDTSMRAGNSDIYGFLEPQSIQRSGQSQFESESYIKTWMQNSKCDVYLGAYLNR

SEQ ID NO: 110701 - protein, 105 aa, Glycine max
  Coding DNA Sequence Number=SeqID_19016
MVLEVQTQEHRSLEQMDQWLALNSGFTCDSPQISASPHQLDLAPYASGPYNAQWNAPGLLNDKHTLRSSRILGEMEVDEPWLGLWLPLNYQIDMGASQHRTLELG

SEQ ID NO: 110702 - protein, 125 aa, Glycine max
  Coding DNA Sequence Number=SeqID_19017
MKIKVRETSGDHQGPKNDEERTKDGGKSSRNHPRKRFERVTEAPRLGFSSRKRFLKGKRVERFCYSLLPLFIEKRGRSLPPSSPRRARLLSPEGGAFWKNFLEGPSGPGCYLHPLFTKYTPTFFC

SEQ ID NO: 110703 - protein, 113 aa, Glycine max
  Coding DNA Sequence Number=SeqID_19018
MIMRGQDIYNSLSTTSPSSSEGIYPQEEGQPLMVKEECKKERHFEIKANIKEISLLRQPPHFLFSKKTLVSIAIPLRLEFIPQVKELLDEGLVRKSLNPCALFVPKIVIKGFP

SEQ ID NO: 110704 - protein, 48 aa, Glycine max
  Coding DNA Sequence Number=SeqID_19019
RKMQGLCMSEHNMRTIKIEWTISDNASRKEEMRLHCYQASRRPSMITD

SEQ ID NO: 110705 - protein, 72 aa, Glycine max
  Coding DNA Sequence Number=SeqID_19020
MAESGLKESEWAQAHYDQLNLIEGTWGRMQVGIGSRPTDRCPFLALNKQRTSLQGSPVSFAFAVSFTIVCFK

SEQ ID NO: 110706 - protein, 88 aa, Glycine max
  Coding DNA Sequence Number=SeqID_19021
MQRRAVVAALIPIDLEINTTCRKRKAERNKIFLQDIEAAPTPEEPISSEASSSFPTQGQSHTILAKANIMAEEPRRVTLEDYSSSSVS

SEQ ID NO: 110707 - protein, 111 aa, Glycine max
  Coding DNA Sequence Number=SeqID_19022
MEIYVSDRLGKKVVIIKKGEIVEAKLHDESRMITKDDDKGDDKKLKGQSKNEFKIFKIESRTLQDSTGKLISRIKNQDSRDQDFKNQDSRDQDSRLKIQESRESLIKSGIL

SEQ ID NO: 110708 - protein, 182 aa, Glycine max
  Coding DNA Sequence Number=SeqID_19023
MSWKRTHYFSMPHHKTMIMRIQDIYSSQDEATTSPSSSESEEAKEEESSEEIYPQEEGQPLMVKEECKEVSVSSKRLVKKESHFEIKTNIKETSPLRQPPHLLLCKKTLVSTATALGLEVIPQVKELLDEGLVRKSLNPCALLVPKIGVEGRSPEYEEPQDLRSNPFQGGGDDAILPLKGIG

SEQ ID NO: 110709 - protein, 93 aa, Glycine max
  Coding DNA Sequence Number=SeqID_19024
GLSNWLAAIWFSAAFRVSKNIIEVPLSYHRQWRPYYPTRYFFSDGLKQFRRTHDIDDSVIMRFFIADKNTSFEVDVIGPIHRQGCPRSFHQQL

SEQ ID NO: 110710 - protein, 323 aa, Glycine max
  Coding DNA Sequence Number=SeqID_19025
  Homolog annotation: Hit_ID=Q6WAY6; Match level="QueryCoverage=93%, HitCoverage=57%, E-value=1e-30, Identity=30%"; Hit description =Putative uncharacterized protein
MGPLQMQAYRKAYGKILDLTIAEISTEAIASLTQYYDQPLRCFSFGDFQLVPNVEKFEEILGCPLGGRKLYLFSGFLPSLSKIAVVVRDSARGLDRVKQTRNGIVGLPRKYLEGKARDMANQEEWVPFIDVLALLIFGVVLFPNVDGLVDLAAIDAFLAYHHSKESPMVAILADLFDTFDEDVKRVVHGSSVVYPLFMYGGRTVNWFPRWKEGKEGVLFSCGSYPNIPLIGMRGCINYNPALSIRQLGYPMRGAPTKESLSPFLVRDFGVQNFKVIQSVHKAWESPLRKDKELRGIRNGIIGGYHEWLKVRTRGLDWLAKGIL

SEQ ID NO: 110711 - protein, 119 aa, Glycine max
  Coding DNA Sequence Number=SeqID_19026
  Gene Ontology: Mol. function=acid phosphatase activity; Cellular component=cytoplasm; Biological process=keratinization
  Homolog annotation: Hit_ID=O00839; Match level="QueryCoverage=98%, HitCoverage=27%, E-value=5e-14, Identity=44%"; Hit description=SAcP -2 protein
DYTSSPSEGYRSSLSEGYTSSPSEDYTPSPLEDYTSSPSKDFTSSPLEGYTSSPSEGNTSSPTDGCTPSPLEDYTFSPSENYTSSTSKDYVFSPSEDFTSSPSEGYTSLLSEDYTSSPS

SEQ ID NO: 110712 - protein, 112 aa, Glycine max
  Coding DNA Sequence Number=SeqID_19027
MTRGNPSDLQPFDLEIDRIFHRLVRHSVHPVHFEHSEHSVEGDSEYSDFEHFTTNFHTENMAQPPPRDRTLKEMDAPDFTYESLCIQYPDEGVPYVLKTGLIHLLPKFHGLA

SEQ ID NO: 110713 - protein, 249 aa, Glycine max
  Coding DNA Sequence Number=SeqID_19028
  Gene Ontology: Mol. function=carbohydrate binding; Cellular component= periplasmic space; Biological process=carbohydrate biosynthetic process
  Homolog annotation: Hit_ID=P67558; Match level="QueryCoverage=42%, HitCoverage=20%, E-value=2e-52, Identity=94%"; Hit description =Glucans biosynthesis protein G precursor
  Pfam annotation: Domain name=MdoG; Domain location=6-248; Score= -142.6; E_value=9.2e-09; Accession=PF04349.3; Description=Periplasmic glucan biosynthesis protein, MdoG
MTVKTSDTCSSRRRSQLVCKRMPGADKPVRARQRMRKEKIPHQAPFAIQAAQLLGRAIGAGLFAITPAGERGMCCKAIKLGNARVFPVTTLIPSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGRETCRASCINESANARGEAVCVLGALPLPRSLTRCARSFGCGERYQLTQR

SEQ ID NO: 110714 - protein, 118 aa, Glycine max
  Coding DNA Sequence Number=SeqID_19029
MKRRLNKLFMVVILWTLTQILIMCDQILANEQVPSMDSLVTRLLRVPTLVRGENSVVAAETLAAPAEKLAMLAGCINESANARGEAVCVLGALPLPRSLTRCARSFGCGERYQLTQRR

SEQ ID NO: 110715 - protein, 144 aa, Glycine max
  Coding DNA Sequence Number=SeqID_19030
  Homolog annotation: Hit_ID=A0ST23; Match level="QueryCoverage=31%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPRPLVGSHGGKKGTELEFVIMVIAVSFGKPVVPAALMNRPTRGERRFAYWALFRFLAH

SEQ ID NO: 110716 - protein, 135 aa, Glycine max
  Coding DNA Sequence Number=SeqID_19031
MPRDTSIISAGCVGVVPLREEKLVDLLGAHHHHLVGDQGWQQVSLRHQDWGEFHKLLYWKISSWISACAGIGVADEARLCGSRVLSGRPLWLSGNPLFDGCRIGRVSDMGRIAWLVWGILLSVVRSLLGLRPSRS

SEQ ID NO: 110717 - protein, 45 aa, Glycine max
  Coding DNA Sequence Number=SeqID_19032
MGGKLHVHDRVTRASAKHNTPGLSARKTLEENVLYRFAKDTASSH

SEQ ID NO: 110718 - protein, 142 aa, Glycine max
  Coding DNA Sequence Number=SeqID_19033
  Homolog annotation: Hit_ID=A2Q2U3; Match level="QueryCoverage=95%, HitCoverage=28%, E-value=3e-64, Identity=91%"; Hit description=CENP -B protein; Homeodomain-like
  Pfam annotation: Domain name=CenpB-DNA-bind; Domain location=77-131; Score=46.8; E_value=7.5e-11; Accession=PF09091.2; Description =Centromere binding protein B, DNA bind
MASHLKDVVKSTMSDQIRKELYEYKRDNPASTQKDLQRWLEGKFELKVSQGTISNTLKRSDDYLSAEIEKGRAEIKRHKPAKYPDMEKVVYEWFLQLQERVNITGELILLKARDTMKLVYPHDDSDFNFSMDGLGNSSIDMA

SEQ ID NO: 110719 - protein, 211 aa, Glycine max
  Coding DNA Sequence Number=SeqID_19034
  Homolog annotation: Hit_ID=Q2HTK5; Match level="QueryCoverage=89%, HitCoverage=90%, E-value=8e-13, Identity=26%"; Hit description=H+ -transporting two-sector ATPase, alpha/beta subunit, central region
MGDFTHDNWRWDMKWRRNLFDHESDLAVEFMEEITSIPIQRHAKDTMMWMAEPSGVYTTKSTYSLLMNPSTTGSDGKTFKIIWKLKIPPRAVEEASHLFFNCKMTIGLWWESMRWIQVVGPLPVSPASHFTQFYEGFGAAVNHSRWCGWWIALTNSIWQHRNLLIFQGKAFDSSKVMDDALFLAWSWLKAREKDFNNSFNHWSSNISDSFG

SEQ ID NO: 110720 - protein, 152 aa, Glycine max
  Coding DNA Sequence Number=SeqID_19035
MNLIRRQVVVNDRLCPFCGLKDEEAEHLFFNCTYTLPLWWESISWANLTTALPINPRDHFLQHTLGAAGDSAEYLLSIVVSLVPLVLFHIVATYPSAGGRRVTRGMRVPRKEYARRRHQRLFEENVGKTGKDAIYELLSERFGSCIYARERY

SEQ ID NO: 110721 - protein, 64 aa, Glycine max
  Coding DNA Sequence Number=SeqID_19036
  Subcellular localization annotation: CTP_CleavageSite=33; ConfidenceScore=5.33e-01
MTSRLARVSVFGLGANHALSLAKDNRRALFFCRAKRAEAALSVGCVLSPNGELSATAPFSTLRF

SEQ ID NO: 110722 - protein, 58 aa, Glycine max
  Coding DNA Sequence Number=SeqID_19037
MSVKNHIGRLGCFARMIQPYGINISLKEHSNRVTPKAYTSKSPSGPLPPDSGPTHKTF

SEQ ID NO: 110723 - protein, 39 aa, Glycine max
  Coding DNA Sequence Number=SeqID_19038
MISKFPTVRMLVIGAANIVLKFHDDPTVNDSEIVIFLRQ

SEQ ID NO: 110724 - protein, 155 aa, Glycine max
  Coding DNA Sequence Number=SeqID_19039
  Gene Ontology: Mol. function=beta-lactamase activity; Biological process=beta-lactam antibiotic catabolic process
  Homolog annotation: Hit_ID=A6FJS5; Match level="QueryCoverage=27%, HitCoverage=67%, E-value=1e-16, Identity=100%"; Hit description=Beta- lactamase
SEQESARGSFQGETPGGREPMEIWMTPATRDPFYDDQRPQPIAFPTVERSLKAEERLMRTIRASEPIQLMPAHDRSRPEQPAERLNALMNCVSRYNFTGNSYDRDYEFEARKSMSIQHFRVALIPFFAAFCLPVFAHPETLVKVKDAEDQLGARV

SEQ ID NO: 110725 - protein, 121 aa, Glycine max
  Coding DNA Sequence Number=SeqID_19040
MKAQVEKDEGPEAETLSRLLIVAEGPKKNFWHLIKFGKSFSLGSLLNQSQTYQGNPCGVCPDLSSFTGSGVYPNLSSFTGSGVYHDLSSFTGSGVIQIFVTCIKRSAPTQVHIIWYQSFGS

SEQ ID NO: 110726 - protein, 74 aa, Glycine max
  Coding DNA Sequence Number=SeqID_19041
MKLCFYKRQKTKLEEVAQSESTKVVIDPSSPIRRHDSLEEQASKGSFVPYGRQDLLTAAIGRSKHPSCVRAAGF

SEQ ID NO: 110727 - protein, 140 aa, Glycine max
  Coding DNA Sequence Number=SeqID_19042
  Homolog annotation: Hit_ID=UPI0000ECBAF8; Match level="QueryCoverage =29%, HitCoverage=48%, E-value=1e-15, Identity=97%"; Hit description =UPI0000ECBAF8 related cluster
GAEPMEKRQQRGLFTVPGLLLAFCSHVLSALSRDSVDNRITAFEKRKSAQYANRLSPRVGRFINAAGTTGFPTGKRAVSATQLIRPAGMQAWHWPSFYNVVTGKTGALPNLIALQHIPLSPAGVIAKRPAPIALPNSCAA

SEQ ID NO: 110728 - protein, 47 aa, Glycine max
  Coding DNA Sequence Number=SeqID_19043
MSALPIIVKQNSPIGGLGPPKARAVGDPREAGLALRDALKRNFPSSG

SEQ ID NO: 110729 - protein, 119 aa, Glycine max
  Coding DNA Sequence Number=SeqID_19044
MTMITNSSSVPSAVECHLDVVEVISSSLIIPKPNARGITRGVGGLYFWERTPVEYEAPGYKLCLGMEENSESALSTNKEAISNATRNLMESSILAQDERWRHALHMQVGREVVFPVADG

SEQ ID NO: 110730 - protein, 91 aa, Glycine max
  Coding DNA Sequence Number=SeqID_19045
  Gene Ontology: Mol. function=Mo-molybdopterin cofactor sulfurase activity; Biological process=molybdenum incorporation into molybdenum-molybdopterin complex
  Homolog annotation: Hit_ID=A6FJQ2; Match level="QueryCoverage=41%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTFGQWMVLIDAAKGCATMPPDLSKYPADFVAISFYK

SEQ ID NO: 110731 - protein, 134 aa, Glycine max
  Coding DNA Sequence Number=SeqID_19046
ESQPQRHPVDPEKSNRALGFPALGSCLQDTQWTRRSPTGSWSCQALITGLCQFYGVPVTYSKGIRPPTNRAFIKKYCIPRQAQGETPQQPGDGQQRATDAPPSPLEFTSAHPKKVKALLTTHGRPIGDQVQSQK

SEQ ID NO: 110732 - protein, 260 aa, Glycine max
  Coding DNA Sequence Number=SeqID_19047
  Gene Ontology: Mol. function=nucleoside-triphosphatase activity; Cellular component=cytoplasm; Biological process=protein metabolic process
  Homolog annotation: Hit_ID=A7MQ34; Match level="QueryCoverage=76%, HitCoverage=57%, E-value=2e-86, Identity=75%"; Hit description =Putative uncharacterized protein
  Pfam annotation: Domain name=Clp_N; Domain location=200-252; Score =27.8; E_value=4.1e-05; Accession=PF02861.11; Description=Clp amino terminal domain
  Pfam annotation: Domain name=DUF1305; Domain location=1-183; Score =14.3; E_value=7.8e-12; Accession=PF06996.2; Description=Protein of unknown function (DUF1305)
  Pfam module annotation: Pfam domain module=Clp_N::DUF1305; Domain location=200-252::1-183
PAVSLDRADNRRFERYLASLIGMGQPGQMNKGSLSAHARFTHAGHLTRHGRDPEGLEKILRHYFKAPVKLVSNVPQWMPLSAREQAQLGAGRRMPRLGESAFLGIAVRDVQHKFRIEIGPLSAEEYNRFLPGEAWVTELRDWVRQYAGVEFEWETRVILREDAVQGTSLGGTGRLGYNTWLGHQPQPVPRGDLVYRAERATAFCKLRGNPYVELVHWLHQLMQQQDGDLQQVIRHFALDEQQLTRDIVAALDALPRGASS

SEQ ID NO: 110733 - protein, 74 aa, Glycine max
  Coding DNA Sequence Number=SeqID_19048
  Homolog annotation: Hit_ID=P58054; Match level="QueryCoverage=78%, HitCoverage=22%, E-value=4e-15, Identity=75%"; Hit description =UPF0012 hydrolase ybeM
MLVAAGQFAVTSVWEKNAEICASLMAQAAENDASLFALPEALLARDDHDADLSVKSAQLLEGEFLGLYGEKGIL

SEQ ID NO: 110734 - protein, 211 aa, Glycine max
  Coding DNA Sequence Number=SeqID_19049
  Homolog annotation: Hit_ID=A0KNM9; Match level="QueryCoverage=15%, HitCoverage=5%, E-value=8e-07, Identity=75%"; Hit description =Glycosyl transferase, group 2 family protein
MCGFRVYPLAASLELCDRRAIGQRMDFDTEIMVSGLVINALGHRQRPERFRAVLESIAPMRASIAAGHDIARTPFTAMLDAGGGDVGDRTAAASRGANGGVDCAAAAALQLPLLVLLIKSRCAQGKLDACTARPLPILYRCRAMGDSRRCRRRSIATLRACSIMPCWHRWTGLTFTISGLCPKRSNAMRDASWRAEIERVVSFHDCDPMGV

SEQ ID NO: 110735 - protein, 84 aa, Glycine max
  Coding DNA Sequence Number=SeqID_19050
MNDNAIHGAPKRLRMENGTKQSLCIAPNLKGLRMENCTKQSLRIAPNSKNGELHQAITTNSSKLEGGGHMNENAIHGAPKKVEN

SEQ ID NO: 110736 - protein, 98 aa, Glycine max
  Coding DNA Sequence Number=SeqID_19051
  Subcellular localization annotation: CTP_CleavageSite=2; ConfidenceScore=5.29e-01
MKNSGKSSRNHPRKCLGSVTEAPWLGFFSRKQFFSLMLSNSQIPGGLNEFLFCPPSPIIGKRGRWLPPSSPRRAQLARVASTRRHRFLLEHPGRPKWA

SEQ ID NO: 110737 - protein, 177 aa, Glycine max
  Coding DNA Sequence Number=SeqID_19052
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPWPAVNFEFIWDVASGNRLPMVGNRLQGLKMKTGG

SEQ ID NO: 110738 - protein, 43 aa, Glycine max
  Coding DNA Sequence Number=SeqID_19053
MQALICTKNLLLGFDMQGKEDEDVEIEKVQATSNMESFVVGDV

SEQ ID NO: 110739 - protein, 104 aa, Glycine max
  Coding DNA Sequence Number=SeqID_19054
  Subcellular localization annotation: CTP_CleavageSite=26; ConfidenceScore=5.17e-01
MMKALTSSCSKATVETLGPFSPRVPRCVSDRPEFCFTLRSKNEKRGWNLLLLKLVRNNDLYPVHAVPPKDQLVRFFPAYFGFEVFSVALVLLVEPLYCLENLFQ

SEQ ID NO: 110740 - protein, 119 aa, Glycine max
  Coding DNA Sequence Number=SeqID_19055
GYIYLGLTENKRGYISCGSVLVEGTSTRFKESKGGSLLNIGGLLIEFPSGKRKFDETIIILEVSKPYTRQRSQHRRLCEESLEGLHHSANGRSQMFDQNASNPGFRHSLLDSHSTTWCP

SEQ ID NO: 110741 - protein, 402 aa, Glycine max
  Coding DNA Sequence Number=SeqID_19056
  Subcellular localization annotation: CTP_CleavageSite=55; ConfidenceScore=5.34e-01
THLLLEVASPLSLPSPFRCHSSSKKQRNPLMKRILGLQAPMELTSWSSPNGAYIMVFAGERIEVGLKRGKFDYISPIGASTRRTGIAGAKKKEGDAHTVTSTPAWPKPPQTPNNTHQYAQYHLSFSARAKASFDTTLTQPRAPTPPQGGALRASAPTRPHPANNAHFGANTTRNFLPRQAQIFAPIPMTYGELLPSLITNQLAVVVPGKIFQSPFPKWPLNRTVLGLDKQGPKLDRGRVTRAQAFEGRNDPRRFIYKALQKAGIIPCGRRREDSCLMDPGVLHDMETCSAIRDLLQQMIDQGQLEVDSEREEEQHVYMQSVDEEGPKKPKPLVIHFFRDTTPQRPQHPSVVGGRSIPFPYENSRAVPWRYAPPGGRKDEATGISSLSSKVTNISGLSGITRS

SEQ ID NO: 110742 - protein, 237 aa, Glycine max
  Coding DNA Sequence Number=SeqID_19057
  Homolog annotation: Hit_ID=A5BSR3; Match level="QueryCoverage=84%, HitCoverage=65%, E-value=8e-18, Identity=31%"; Hit description =Putative uncharacterized protein
  Subcellular localization annotation: CTP_CleavageSite=32; ConfidenceScore=5.79e-01
SPPASTPPPPPPPSPHSPPPPPPPSDASALPSAVKRTRKASRLRSLSTRPPGAERPVVHVDPAIWKADGPHRKKLRTYLEMVARDKVDVTYENWKEVPTAQKDLIWEDIQDVRIKAPAIQKQNTAPHVLSRGGYDYLEQKLLAEKTKKKLQEAAQSGSVDGVIDLPSLVRRHVKWKMARTKKTREMTTEAAKEIADKIDSFEEQATQGSFVPQGCQDVLAAAIGCLEHPGRVRAAGA

SEQ ID NO: 110743 - protein, 23 aa, Glycine max
  Coding DNA Sequence Number=SeqID_19058
MASGPAVGVCQYCHKKIVSFVRQ

SEQ ID NO: 110744 - protein, 85 aa, Glycine max
  Coding DNA Sequence Number=SeqID_19059
MKRCMMQSRNMPEDIILLGDTSWQSGLSAAMHHQRRKTLDEASLFQASQRPSMTTDRPPLLMAHIDPGIRPSISMCVRGVGAMCA

SEQ ID NO: 110745 - protein, 71 aa, Glycine max
  Coding DNA Sequence Number=SeqID_19060
  Gene Ontology: Mol. function=aspartic-type endopeptidase activity; Biological process=DNA integration
  Homolog annotation: Hit_ID=A5C737; Match level="QueryCoverage=100%, HitCoverage=16%, E-value=1e-18, Identity=53%"; Hit description =Putative uncharacterized protein
MKKECPKYAAWCVKKDTWWIDFGAATHISMTMQGCLWSRLPSDDERFIFMGDDKKVVVEAIRTFRLQLKTG

SEQ ID NO: 110746 - protein, 97 aa, Glycine max
  Coding DNA Sequence Number=SeqID_19061
  Homolog annotation: Hit_ID=A5AYU6; Match level="QueryCoverage=71%, HitCoverage=12%, E-value=1e-09, Identity=40%"; Hit description =Putative uncharacterized protein
SNIKSFQDHDEDQANLCLKTKSHENNEKESIRKKWYIDSGCSKHMTVDVSKFTTISPKKSGHVTYGDNNKGKIIGFGKIGTSSSTSYSPSYPTAEGQ

SEQ ID NO: 110747 - protein, 122 aa, Glycine max
  Coding DNA Sequence Number=SeqID_19062
MDSRARSGPFNASPKIEVRGWWTLGDSVGRRGYVGTVMSPEWVWARTATGMPMWLTLGVTRTNMGWGMNPGNLEEGMHHQDSGGGGNRRGGSTRSAKFRATVPSQFPSGELARDEPVGSLYR

SEQ ID NO: 110748 - protein, 105 aa, Glycine max
  Coding DNA Sequence Number=SeqID_19063
  Subcellular localization annotation: CTP_CleavageSite=60; ConfidenceScore=5.55e-01
MKAKAVKGNWSLRTNKLSFPYVFLVCIFFFLAGFFGFTLFSHSQAVCVLGALPLPRSLTRCARSFGCGERYQLTQRRNRKKAALLAFFHRLRPPDEHHKIDAQVR

SEQ ID NO: 110749 - protein, 84 aa, Glycine max
  Coding DNA Sequence Number=SeqID_19064
MCSATDYKIKSIGGMCILIQIWAWERCTTLAPKRTPPVIQNKPLEHRWLRRGNQHIGNDDLIVFRRKLDIMKRHEFLWEPYTTT

SEQ ID NO: 110750 - protein, 108 aa, Glycine max
  Coding DNA Sequence Number=SeqID_19065
  Subcellular localization annotation: CTP_CleavageSite=39; ConfidenceScore=5.29e-01
MALTAPLHDWQAGLFLCWARPLEKSTIRLLSSFGPCFSRPSTVRPSGLGFPHEVPRRVGACPKVSIVGRVRPGWSRSLKSPPPCGGVGVLGWASAVSEEAPARAEKLG

SEQ ID NO: 110751 - protein, 131 aa, Glycine max
  Coding DNA Sequence Number=SeqID_19066
  Homolog annotation: Hit_ID=B0HC01; Match level="QueryCoverage=25%, HitCoverage=70%, E-value=7e-11, Identity=96%"; Hit description =Putative uncharacterized protein
GGGAYGKTPATRPFYGSWPFAGLLLTCSFVRYPLILWITVLPPLSELIPLAAAERPSAARNSYDHDYEFELGTINVSVCVLCWEWGIVKWKSYLLGFSPSVEKQHSPPYDAGKIHPLLLKHAHLLGAVGIL

SEQ ID NO: 110752 - protein, 88 aa, Glycine max
  Coding DNA Sequence Number=SeqID_19067
  Homolog annotation: Hit_ID=B0HC01; Match level="QueryCoverage=36%, HitCoverage=68%, E-value=4e-10, Identity=100%"; Hit description =Putative uncharacterized protein
MSFLRYPLILWITVLPPLSELIPLAAAERPSAARNSYDHDYEFELGTQALTFMWLRNRVRMEDCLEGPLLGNHGTQLQTRKWRTHEQP

SEQ ID NO: 110753 - protein, 158 aa, Glycine max
  Coding DNA Sequence Number=SeqID_19068
MTGRLLVGSLAFESRILHYLIVRILLPRSSNLAQVSEEDLIVMWAFHKGLQIDWAHLALQSLHPLVIKKSMMASWVKKGARHVDEEGHLHGGEDSSLLQKILDRFDGLQTFVGERFDTLELQVDMRFNEMESRITKVEEDVSYIRTSFDLPPPLPPSS

SEQ ID NO: 110754 - protein, 75 aa, Glycine max
  Coding DNA Sequence Number=SeqID_19069
MPTPFAYQSNKVVPWKYIPPAFGERVATEVDSLSAKVTNITGLSGVTHSGRVFAPPHSAELPSKGKAPMLQEPTD

SEQ ID NO: 110755 - protein, 150 aa, Glycine max
  Coding DNA Sequence Number=SeqID_19070
  Homolog annotation: Hit_ID=UPI0000ECBAF8; Match level="QueryCoverage =27%, HitCoverage=48%, E-value=1e-16, Identity=100%"; Hit description= UPI0000ECBAF8 related cluster
VGTGERTRELPGGNAGIFIVLSGFATSDLSVDFCDARQGGGAYGKTPATRPFYADTARRSRTTERSESVSEEAEERPIRKPPLPARNSYDHDYEFELGMQAWHWPSFYNVVTGKTLALPNLIALQHIPLSPAGVIAKRPAPIALPNSCAA

SEQ ID NO: 110756 - protein, 81 aa, Glycine max
  Coding DNA Sequence Number=SeqID_19071
MSLRNSNGHKFSLGYPIKEHDISRHSKLNNGTSREIQMVIAYSLGCPIRGHNISRCSKLNNRYPREIPMVITFHTGCPLSA

SEQ ID NO: 110757 - protein, 60 aa, Glycine max
  Coding DNA Sequence Number=SeqID_19072
  Gene Ontology: Mol. function=RNA-directed DNA polymerase activity; Biological process=RNA-dependent DNA replication
  Homolog annotation: Hit_ID=Q2HRM6; Match level="QueryCoverage=50%, HitCoverage=7%, E-value=4e-09, Identity=86%"; Hit description=RNA -directed DNA polymerase
MCTNCRPINNITVRYRHPITRLDDMLDELHVFLGFVVSAKGVQVDDEKIKAIRDWPIPKN

SEQ ID NO: 110758 - protein, 74 aa, Glycine max
  Coding DNA Sequence Number=SeqID_19073
MHVVFLDAFCDLMQSGSYAWGATALVHMYENLNDTSKSTTRQLARYITLLQHFPTVGSAIVVEDYDERKPRACC

SEQ ID NO: 110759 - protein, 238 aa, Glycine max
  Coding DNA Sequence Number=SeqID_19074
ALVFHFERLGILRDSIRHPSKKLLSLEFAQSFNIQFRASRIYYGTQSDIRVKGFCRLNLLRASYSISSVSINYGTQSDIRIKSYCRLNLLRASVFHFERLDILRDSIRHPSKRLLSFEFAQSFGIPFERLDILRDSIRHPSKKLCRLNLLRASTFNFERSDILRDSIRHPNKKLLSFEFAQEFLYSISRVSIYYGTQSDIRVKSYCRLNLFRASTYNFEHLDLLRDSIRHPSKKCIVV

SEQ ID NO: 110760 - protein, 93 aa, Glycine max
  Coding DNA Sequence Number=SeqID_19075
NTSARTDDVGFTLVDLKKLAYHNDPFIMVEQAKQAHTYSTYLASSSSSSSSSTISVSVYLEADMQNHAAMILGHYTTWGRETSGPHRSYDWEG

SEQ ID NO: 110761 - protein, 141 aa, Glycine max
  Coding DNA Sequence Number=SeqID_19076
MVCAGCARVIPLWEQKLEDLSWDHHGQLVGNERWQEFPICHWDWGGDLCPPWRKVPCRVCAKVSVVGWVRPSRSWSPKSSPLWGCGRLWLGHAGVEVTVWASPSFFFAPAIPVLLLLAPIRGDVIKLSPLQTHLDPFSGED

SEQ ID NO: 110762 - protein, 116 aa, Glycine max
  Coding DNA Sequence Number=SeqID_19077
  Homolog annotation: Hit_ID=Q51617; Match level="QueryCoverage=52%, HitCoverage=88%, E-value=1e-16, Identity=75%"; Hit description =Putative uncharacterized protein
  Subcellular localization annotation: CTP_CleavageSite=6; ConfidenceScore=5.69e-01
MIPHVCKKAVSSFGPPIVVRSKLAAVLSLMVMAALHNSLTVMPSVRCFSVTGVSRGPFVSRVSVMTVKTSDTCSSRRRSQLVCKRMPGADKPVRARQRVLAGVGAGLTMRHQSRLY

SEQ ID NO: 110763 - protein, 181 aa, Glycine max
  Coding DNA Sequence Number=SeqID_19078
  Homolog annotation: Hit_ID=Q8IKV2; Match level="QueryCoverage=96%, HitCoverage=20%, E-value=1e-11, Identity=27%"; Hit description =Putative uncharacterized protein
DNDLHLHFEDDNIFSHCMLLKGDNDLHLHFEDDDVFSHCMLSKGNNDLHLHFEDDNVFSHCMPSKGDNDLHLHFEDDNIFSHCMLSKGDNDLHLHFEDNDVFSHCMLSKGNNDLHLHFEDDNVFSHCMPSKGDNEYHLQFEDDNVFSHCMPSKGDNAIIYAFKDDNVFISKTSNVFCPCAS

SEQ ID NO: 110764 - protein, 54 aa, Glycine max
  Coding DNA Sequence Number=SeqID_19079
MSTHHILGLKKVPRVRLFADSSGRGGEEPTLVREDWVGPTYGVPVVMPIAAPGC

SEQ ID NO: 110765 - protein, 105 aa, Glycine max
  Coding DNA Sequence Number=SeqID_19080
MERSMIDAASGGALGDMTPAEARNLIEKMASDSQQFSAINEAIVIRGVHEVATNSSASSETKKLEVKLDALVNLPEAYAANIYIDLLNLSSKISHNRTIMTSPAT

SEQ ID NO: 110766 - protein, 180 aa, Glycine max
  Coding DNA Sequence Number=SeqID_19081
  Gene Ontology: Mol. function=structural constituent of ribosome; Cellular component=ribonucleoprotein complex; Biological process =translation
  Homolog annotation: Hit_ID=P92959; Match level="QueryCoverage=41%, HitCoverage=37%, E-value=2e-30, Identity=79%"; Hit description=50S ribosomal protein L24, chloroplast precursor
  Pfam annotation: Domain name=KOW; Domain location=82-113; Score=40.6; E_value=5.8e-09; Accession=PF00467.20; Description=KOW motif
KRKSAQYANRLSPRVGRFINAAGTTGFPTGKRAVSATQLIYDHDYEFELGTLLFLLWQLKRWERKECKPNSLPILHKMHVKLGDTVQVISGRERGKVGEITKIFKHNSTVIVKDLNLKTKHVKSREEGMQAWHWPSFYNVVTGKTLALPNLIALQHIPLSPAGVIAKRPAPIALPNSCAA

SEQ ID NO: 110767 - protein, 175 aa, Glycine max
  Coding DNA Sequence Number=SeqID_19082
MTKKEIIANDSRHITSVLLWKMVGYTPSSFADLVFAGEMIEVGLKRGKSDHHALINEKKTGANEEGENEGETHAVTVIPIQPSFPPTQQCHYSANNKPSPYPPPSYLQRSSLNQPQSLSTALPMTNTTFSTNQNTNQEMNFAAKKPIEFTPIPVSYANLLPYLLDNSMVAITPAK

SEQ ID NO: 110768 - protein, 178 aa, Glycine max
  Coding DNA Sequence Number=SeqID_19083
  Homolog annotation: Hit_ID=Q6WAY4; Match level="QueryCoverage=94%, HitCoverage=29%, E-value=7e-18, Identity=33%"; Hit description =Putative uncharacterized protein
MAEVSTEAIASLAQYYDRSLRCFTFGDFQLSPMVEEFEEILGCPLGGRKPYLFSRFYPSLARISKIVQISAQELDHRKQVENGVVGVPRRCLEAKARILAGRGEWAPFIDILAFLIFGGVLFPNVDGLVDLAAIDAFLAFHDRKESSIVAILADLYDTFDRRCEKSSTRIVCCTPALY

SEQ ID NO: 110769 - protein, 152 aa, Glycine max
  Coding DNA Sequence Number=SeqID_19084
MKADLSALKDQMASISEVMLKLQKTIEDKATATASNRNTAVFGRRYSPQAYPYGLPPDFTPRATPKDLSQAPTFEGQLPPYEDYPGQDDGEGDTHLGPLLHLKDPSPHELPQPNIVCHIPASPTPVKESVPFAEDKGKIEALEERLRAVEGL

SEQ ID NO: 110770 - protein, 89 aa, Glycine max
  Coding DNA Sequence Number=SeqID_19085
MSSSLEDYTSATLEGYTSSPSEDCIVLTFRGLHVLAFRGLYVLAFRGLHVLAFRGLQVLAFRGLQVLAFRGLHVLAFTGLHALAFRGLH

SEQ ID NO: 110771 - protein, 209 aa, Glycine max
  Coding DNA Sequence Number=SeqID_19086
  Gene Ontology: Mol. function=protein transporter activity; Cellular component=integral to membrane; Biological process=protein transport
  Homolog annotation: Hit_ID=Q0ZB98; Match level="QueryCoverage=95%, HitCoverage=100%, E-value=4e-99, Identity=92%"; Hit description=ExbB
  Pfam annotation: Domain name=MotA_ExbB; Domain location=82-209; Score= 157.3; E_value=4e-44; Accession=PF01618.7; Description=MotATolQExbB proton channel family
MSWRNSVGNNLMQADLSVWGMYHHADIVVKVVMIGLILASVVTWAIFFGKGAEMLSSKRRLKREQQQLSEARSLDQANTIANGFHAKSLTTQLINEANNELELSAGVDDNEGIKERTGFRLERRVAQVGRYMGRGNGYLATIGAISPFVGLFGTVWGIMNSFIGIAQTQTTNLAVVAPGIAEALLATAIGLFAAIPAVVIYNVFARMIA

SEQ ID NO: 110772 - protein, 107 aa, Glycine max
  Coding DNA Sequence Number=SeqID_19087
  Pfam annotation: Domain name=zf-CCHC; Domain location=76-93; Score =18.5; E_value=0.0024; Accession=PF00098.14; Description=Zinc knuckle
MEMGGDLYDHINKFNQLVTVALRENERMMRTENVDNEHNVIVMVESERRRNHSRRHDGPRRRLKLQSHPQQDMSNIQCYYCSENGHVQVRCKQMKEDLKKLRDMNKD

SEQ ID NO: 110773 - protein, 251 aa, Glycine max
  Coding DNA Sequence Number=SeqID_19088
MSCTGSLSEPLHLTKRTASVHLLSEKGVLSQKSLTCTKREFWIGIQSFACLGFLERERFKFQRVLRDFSCGRNYFQDYFDDAKKSRVKQVPKNQTSRIKSQRIKIQEQLSFKIQDSRTIKIKIQEKLISRFKRRNREATVKTSQGKYFFKKSKHSTILFYKRVFSKFSKLPEYLLSGYILCGTSRGYIYLDCYTENKRGYISCGSVQVEGTSTWLFKENKGGYIPCGSLACKGFYKAERNLKNRWLLGGWM

SEQ ID NO: 110774 - protein, 83 aa, Glycine max
  Coding DNA Sequence Number=SeqID_19089
MMFAFTSAGIKFKKSINHSRGPPTIRIQAERRRKRERRCHFKEKMSLDEAHHHRRPWIRAWRKKEMNEGRGEKSTKFCALKEL

SEQ ID NO: 110775 - protein, 147 aa, Glycine max
  Coding DNA Sequence Number=SeqID_19090
MTLTYKNRRITRPFRLARFGDDADAGSRQARQGASAGVGGCRGWLNYAASEQIVLRVHHMRCEIPHTCVRRKYRIRRHSPFRLRNCWEGRSVRASSLLRQLAKGGCAARRLSWVTPGFSQSRRCKTTASAKLACLQVDSRGSPNSFL

SEQ ID NO: 110776 - protein, 243 aa, Glycine max
  Coding DNA Sequence Number=SeqID_19091
  Homolog annotation: Hit_ID=A5AUP9; Match level="QueryCoverage=63%, HitCoverage=7%, E-value=2e-09, Identity=31%"; Hit description =Putative uncharacterized protein
MTRGNPGDLQPFDTEIDRTFHRLFRHIVHPDHSVHFEHSVAGDSEYSDFEHSTTNLHIENMALPPPRERTLREMVAPDFTYESLCIHILMRCSICEDPHKHLKEFHIVCSTMKPPDVQEDHIFLKAFPHSLEGVAKDWLYYLAPRSIFSWDDLKRQHGEEYEQPEAYAANIYNRPPQQQNQQQENNYDLSSNRYNPGWRNHPNLRWTSPPQQQQPIPPFQNDAGPSKPYVPPPNAATTKTTSN

SEQ ID NO: 110777 - protein, 39 aa, Glycine max
  Coding DNA Sequence Number=SeqID_19092
MIVLENREVDSESSKSSHSSSSEGKDDGFLPSEEGDLLM

SEQ ID NO: 110778 - protein, 77 aa, Glycine max
  Coding DNA Sequence Number=SeqID_19093
MPVCGRARRGSRVRFPREERCVESPPTFICGKRQKNRRKPVKKKIPSLEVVFAFEEGRQKRGSCSYVPSIEEEIRPT

SEQ ID NO: 110779 - protein, 86 aa, Glycine max
  Coding DNA Sequence Number=SeqID_19094
MYIGLIRNNQHENTEKGTLYCITFLNFLNSDQGVLTDPKRIKVIPEWPTPPSVEGRSPEYEDPQDLRSNPFQGGGDDAILPPKGIG

SEQ ID NO: 110780 - protein, 124 aa, Glycine max
  Coding DNA Sequence Number=SeqID_19095
MGEVEDVQEKMKANMEAMMIMKKIMEASAVAVAATSTVAKVNPMLPSGLNQMNHPTSAMVGKDLGSTGGPHDVQIQNEHAFLPYGLPLNYTPPNVAYTPNKNVNNSTSILIESQQPQTYHAHVS

SEQ ID NO: 110781 - protein, 301 aa, Glycine max
  Coding DNA Sequence Number=SeqID_19096
  Gene Ontology: Mol. function=DNA-directed RNA polymerase activity; Cellular component=alpha DNA polymerase:primase complex; Biological process=DNA replication, synthesis of RNA primer
  Homolog annotation: Hit_ID=A4AGC2; Match level="QueryCoverage=43%, HitCoverage=20%, E-value=2e-45, Identity=64%"; Hit description=DNA primase
  Pfam annotation: Domain name=zf-CHC2; Domain location=168-267; Score =166.0; E_value=1e-46; Accession=PF01807.11; Description=CHC2 zinc finger
  Subcellular localization annotation: CTP_CleavageSite=38; ConfidenceScore=5.04e-01
VDSRGSRLSSFDRSRQSLARLKNLTSDLIGRFARASVSATTEAYGTTALVRYNAHVVVPRVIEVEIAVLKGIMGQAIVTIEARKGVYKEQRRVLKRLADALWSTDALWSAGSDVLEPAFAADFIAAEDDAERARVVVDQIASLTDQSAIDWHNRLVGEIDPAEVGIWTPRHADVDEVKARTNIADIIGERVALKSAGVGSLKGLCPFHDEKSPSFHVRQQVGYYHCFGCGESGDVYSFLREMDHVSFTEAVERLAGRIGYTLHYEDGGAAPETSGRSRLYAANTAAAEFFRAQLLTPDAEG

SEQ ID NO: 110782 - protein, 170 aa, Glycine max
  Coding DNA Sequence Number=SeqID_19097
MVDHWCLLVTLRLEPIVARSVRFRDVSEGNKPKTQNWGELINLGGVLHPWAHLGPLRSFYMKLKPPAGLDELGGKLLPYFGYKRAWEAEGKGSTPWESIFHLKLLKRRRKKKKIKVEGNTSVTKSVNVLCHSSSVLHRSSSFDRGPFLLCMFSSSSCLLSVFFFFVLSEF

SEQ ID NO: 110783 - protein, 134 aa, Glycine max
  Coding DNA Sequence Number=SeqID_19098
  Homolog annotation: Hit_ID=A7K9I5; Match level="QueryCoverage=74%, HitCoverage=18%, E-value=7e-14, Identity=49%"; Hit description =Putative uncharacterized protein Z575R
MTEDFESYEDEDFESSKGEDFEPSKARTLSPTKVRTLSPMKARTLSPMKARTLSPMKARTLSPPKARTLSPLKARTLSPLKQRTLTPMKARTLNPLKERTLSPLKQRTLSPMKQANGHYNAKGLLIPLKLDDMG

SEQ ID NO: 110784 - protein, 56 aa, Glycine max
  Coding DNA Sequence Number=SeqID_19099
MWAKRTSTAKRSFNATEESGRASASRPHAKCEISVLSTEDVFSQAQCTNGTKPEST

SEQ ID NO: 110785 - protein, 69 aa, Glycine max
  Coding DNA Sequence Number=SeqID_19100
MATECVEAKLHDDDKGDDKKLKDQSKNNSSESKINQRTTQVNQEEFKTQQESLDSRIKNQDSRFKISRI

SEQ ID NO: 110786 - protein, 77 aa, Glycine max
  Coding DNA Sequence Number=SeqID_19101
  Homolog annotation: Hit_ID=UPI0000ECBAF8; Match level="QueryCoverage =53%, HitCoverage=48%, E-value=1e-16, Identity=100%"; Hit description= UPI0000ECBAF8 related cluster
MWGKVRVWARVKRWGVDKFSSRPAGMQAWHWPSFYNVVTGKTLALPNLIALQHIPLSPAGVIAKRPAPIALPNSCAA

SEQ ID NO: 110787 - protein, 353 aa, Glycine max
  Coding DNA Sequence Number=SeqID_19102
  Subcellular localization annotation: CTP_CleavageSite=59; ConfidenceScore=5.31e-01
PSEDYSSSPSEDYTSLPTESCTPSLQRTTRPRLQRTPCPHLHRATRTRRQRTARPRLQRAAHPRYRGQHILAIRGLHALSFRGIHVVAFRGLHVLVFRGLLALAFRGLHVLTIRALYALAFRGLHILTSEDAIRPHCLHALPFRGLHVLAIRGLYALTFRVITRPHHQRDCTPSPLEDCMSSPSEELHALTFRGYSLASEAACPRLSEVLHVLTFKEHVLTFRGLARPHLRGLLPVLTFKGASYPHSLRGHLRSSALKCLTETCAPVVGPPPDIGERPTMRAQLEREAITQLLCIPGQDFTRAAAKRRGRIMLINMTTLTQIWMTMLLSNILPNDHNADLPLRKYQLVCAVMT

SEQ ID NO: 110788 - protein, 225 aa, Glycine max
  Coding DNA Sequence Number=SeqID_19103
  Homolog annotation: Hit_ID=Q2HW90; Match level="QueryCoverage=87%, HitCoverage=39%, E-value=2e-25, Identity=36%"; Hit description =Putative uncharacterized protein
MGPLQRQAFRKVYGMILDLTAAEVFTEAVISLAQYYDQPLRCFTFGDFQMVPTIEEFEEILGCPLGGRKPYLFSGFLPSLSKIAAVVGDSAKELDHMKQTRNGIVGLPRKYLEGKARDMASQEKWGPFADILALLIFGVVLFPNVDGLVDLAAIDAFLTYHHNKESPVVAILADLFDTLDRRCEKNSARIVCCLPALCVWLVSHLFQQDTRHPCPLQSYRSCAEK

SEQ ID NO: 110789 - protein, 163 aa, Glycine max
  Coding DNA Sequence Number=SeqID_19104
MVKEECKEVSVSSKRLTKKERHFEIKTNIKEISPLKQPPHFLLCKKTLVSIATPLRLDFIPQVKELLDEGLVRKSLNPCALLVPKIGIIRHQIPKIGGMMNALGGATLFCKITRAPNIFMICVHRDSLGRVSMNPKRIKVIPEWPAPPSVLRKKAQSFKNLGI

SEQ ID NO: 110790 - protein, 230 aa, Glycine max
  Coding DNA Sequence Number=SeqID_19105
LTSYPELRRSEFLIGGYVGARASLLSTTPPFVAMTQELVARGGTLRLSAPRHSVTPSVIDEQRPMWSSAPLSGDVSIFGWRLFKSHKGGGPDDTRRYLTVIRTLLSSRGGGPDDKQRPKAAGPMTSRDQVWSFCTLVSSRGGGPDDTRRYLMVIRTLLSSRGGGPDDKQRPKTDIVFCTFCSSGNNKSFTCGNFMVARDSRQPRGAKLVSYTDFRGPLLDDMRPFFGPCE

SEQ ID NO: 110791 - protein, 66 aa, Glycine max
  Coding DNA Sequence Number=SeqID_19106
REPEKRLPQSKEGSRRANYPILTRGVKKLVVGPWVGSIGPPPVCTGRLVPSAGDALLSLTGPGRAS

SEQ ID NO: 110792 - protein, 102 aa, Glycine max
  Coding DNA Sequence Number=SeqID_19107
MDIEEDADIPLILGRPFMSIASCVVDMGKKKLEIGIEDQQINFDLFNEERKLMDQNVCLQMKEFDEKCIPRTKRHFLHALSELLFMLSALTPDQWLDGPAKQ

SEQ ID NO: 110793 - protein, 62 aa, Glycine max
  Coding DNA Sequence Number=SeqID_19108
MEKSEKKNINEKKLKKAYITWDENDMESSEDSGNEEINLCLMAKSYESDEEENKDMPPIRLD

SEQ ID NO: 110794 - protein, 75 aa, Glycine max
  Coding DNA Sequence Number=SeqID_19109
MAERGHGMYYTPPTFSQYPTQMYQYPFEGHHTDTSASEHSFDGVAETHPNFSWPTMTPSQQHDAPIPTPNALIRC

SEQ ID NO: 110795 - protein, 81 aa, Glycine max
  Coding DNA Sequence Number=SeqID_19110
MDQGAKKPVSSKRDRAYFHWDTCTEARLGPDRMMSSTYTSKMTKEFPEPIVKKGVIMLGLMESMTKKSSGELTAPLSRGLF

SEQ ID NO: 110796 - protein, 81 aa, Glycine max
  Coding DNA Sequence Number=SeqID_19111
PHELIVFHASSTIKSGVPQIDCLALFVYPPPSYLEPHVSFVIKREASEKEEGETEVEQLSYPNFVRGLLFDGLQPLVDRFE

SEQ ID NO: 110797 - protein, 89 aa, Glycine max
  Coding DNA Sequence Number=SeqID_19112
MTNRLRYLLFPLTKIQRTNCLRILCLNTLEGTSFMRGYISCGSVQVEGTSTWFFKENKGGYIPCGSLACKGFYKVERNLKNRKLLGDWM

SEQ ID NO: 110798 - protein, 45 aa, Glycine max
  Coding DNA Sequence Number=SeqID_19113
MHQTGIFYVPTVGNYASLLFRQGRTTLGREAGRSSREISQPSGWR

SEQ ID NO: 110799 - protein, 138 aa, Glycine max
  Coding DNA Sequence Number=SeqID_19114
  Homolog annotation: Hit_ID=A0ST23; Match level="QueryCoverage=31%, HitCoverage=100%, E-value=4e-12, Identity=69%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPNLQDFNHVNSIQVGKPVVPAALMNRPTRGERRFAYWALFRFLAH

SEQ ID NO: 110800 - protein, 177 aa, Glycine max
  Coding DNA Sequence Number=SeqID_19115
  Homolog annotation: Hit_ID=Q6WAY4; Match level="QueryCoverage=87%, HitCoverage=28%, E-value=1e-17, Identity=36%"; Hit description =Putative uncharacterized protein
MGTNQNNKRFYQVKVKSLDVSSLKELGRLMGPLQRQAFRKVYGKILDLTAAEVFTEVVISLAQYYDQPLRCFTFGDFQMVPTIEEFEEILGCPLGGRKPYLFSGFLPSLSKIATVVGDSANELDRMKQTRNGVVGLPQKYLEGKARDMASQEKWGPFADILALLIFGVVLFPNVDSL

SEQ ID NO: 110801 - protein, 31 aa, Glycine max
  Coding DNA Sequence Number=SeqID_19116
MMHAPDLNFQMQCVFVEATQSCTVTPPPPRR

SEQ ID NO: 110802 - protein, 34 aa, Glycine max
  Coding DNA Sequence Number=SeqID_19117
ARLITSWGSRLMVEDASALDNQFMGLRIRLEGGG

SEQ ID NO: 110803 - protein, 170 aa, Glycine max
  Coding DNA Sequence Number=SeqID_19118
  Gene Ontology: Mol. function=solute:hydrogen antiporter activity; Cellular component=integral to membrane; Biological process =regulation of pH
  Homolog annotation: Hit_ID=Q7CRH4; Match level="QueryCoverage=100%, HitCoverage=32%, E-value=8e-61, Identity=74%"; Hit description =Na+/H+ antiporter
MRGVVTLALALSLPEDFPGRDFILVMAFAVIVGTVLIQGTTLGWIIAWAGLGNIEPERAPMTMSEAEAAMAQVQLAAVQGLAYDESGELIHPQLLKRYEHRLAASVRYAESTEKYSPLLHAHFDVVLQAVAAGRKELIRLRREGKIDDETLRELEHDLDLEELGAISAKA

SEQ ID NO: 110804 - protein, 153 aa, Glycine max
  Coding DNA Sequence Number=SeqID_19119
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-26, Identity=57%"; Hit description =Putative uncharacterized protein
MTMITPSSKLTLTKGNKSCIKIIKSEFSKYVWLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 110805 - protein, 244 aa, Glycine max
  Coding DNA Sequence Number=SeqID_19120
  Subcellular localization annotation: CTP_CleavageSite=41; ConfidenceScore=5.35e-01
MAEPSKKRKGSSSTAAVAVHRHHGPSGAPTTPIHPSLSSPRSSTLFSSDDQHLRQGAPFEGTIVDDWKFDYSSHDARRMEDLILMWAFLTGRQIDWAHLVRYRMLKALRANALLPYPQLITLFLRHFQILLDDEPFVQVKHSFAIGAGAVTSFGYRKDRNGQWLKKDALPPQDERTPSPPPQRDDSALMTEVLSELQGLRSYVGEHFDSLDTHFAGMDIRLTQLEEDVGYIRQSFDLPPPPPPS

SEQ ID NO: 110806 - protein, 173 aa, Glycine max
  Coding DNA Sequence Number=SeqID_19121
MSPANTSKPDRRAFLRPYQVTWDATMFGVFNPDFPLYIKHKDLSEIAHGGQCLSISVLQLWILHLTETSMRAENSDIYGFLEPQSIQRSGQSQFEFESYIKTWMQSSKRDVYLGAYLNGALKGLDDTPQPKSKAPARWIVVKYFNDPRPLEPERLKALRIQWTQYYLRVRDQT

SEQ ID NO: 110807 - protein, 63 aa, Glycine max
  Coding DNA Sequence Number=SeqID_19122
MAKYSIKVSPICGPSPLELVGLGSSSSMDSFASWKMNVSGMEKEEREEMPLQGEDDSRRSSPP

SEQ ID NO: 110808 - protein, 174 aa, Glycine max
  Coding DNA Sequence Number=SeqID_19123
  Homolog annotation: Hit_ID=A1FXN1; Match level="QueryCoverage=58%, HitCoverage=59%, E-value=9e-42, Identity=84%"; Hit description =Putative uncharacterized protein
  Subcellular localization annotation: CTP_CleavageSite=56; ConfidenceScore=5.17e-01
MVVFPFPGDPTPCPRTSKAKRDKRKKQQAKRPFLRLNAQQQVQNHAVLTNEDGQVVAAIGLQGGEWLLAIGGRTMGNAENPVPMLAMLKHLSNVQEKEGRKVNLEYSELLQKLLDTLAAESEQTADEYLDKLVAEFETVEAEEGEEAAEAAEGEVVEAAAEATPAADSDSKPQA

SEQ ID NO: 110809 - protein, 158 aa, Glycine max
  Coding DNA Sequence Number=SeqID_19124
TLTVRGLHVLALRGLHVLTIRGLHALTSRGLHVLALRGLHALTLGTSYPHCQRTTRPRLERTTRPHHQRAARPHLQRTTFTLTVERTTRPRLERTTRPHHQRVHALTSRGLHVLALRGLHVLTLGTSYPHRFRGLHCPHLQRTTRPRLERATRPHLGY

SEQ ID NO: 110810 - protein, 96 aa, Glycine max
  Coding DNA Sequence Number=SeqID_19125
MELSNGKGPSRVNLGCVEAYQGRALDFVNPYGSASAKVGFDESCVQCKYCALTYTPLTKWQVLETWWCLSVGLTKGGPWVSQALWRIDQGIFRLGF

SEQ ID NO: 110811 - protein, 130 aa, Glycine max
  Coding DNA Sequence Number=SeqID_19126
MKNVEERFKPLRDSSRKRYGNVSEAPRLRFSSRKQFFQANSKEREVPKGLGSLFFLHSSPIYSKIGEVVAAQLAQASSARPGEQGCFLQKQPPSGGIFWRAQMGLVTETYEFRPRYLFSFPPPYGTLRIT

SEQ ID NO: 110812 - protein, 216 aa, Glycine max
  Coding DNA Sequence Number=SeqID_19127
  Homolog annotation: Hit_ID=A6N073; Match level="QueryCoverage=16%, HitCoverage=92%, E-value=1e-09, Identity=86%"; Hit description =Putative uncharacterized protein
GRRVPSGTDWERALRGLFPGRRTVNSELGWSGSQEIRAKGVCNNSLKDHSPMSRTGCGGSAAGKTQASPELDGLVRFVQMILRCVILMEAGRTAPSFGSQGRLSCRDSEGIGSPKMSSETEISGNPKEGKSSFSDFHPGINARGRKVPQAGRAPHVAWCPVSKVNSLWSMEQCMQGKSAKWIRNLGKRIGSEGWARGSQSRTRRLSWTARAASRES

SEQ ID NO: 110813 - protein, 115 aa, Glycine max
  Coding DNA Sequence Number=SeqID_19128
  Homolog annotation: Hit_ID=A5BP71; Match level="QueryCoverage=61%, HitCoverage=18%, E-value=2e-10, Identity=46%"; Hit description =Putative uncharacterized protein
  Pfam annotation: Domain name=zf-CCHC; Domain location=88-105; Score =17.6; E_value=0.0033; Accession=PF00098.14; Description=Zinc knuckle
MVIIVNAEACGYVSMNYYQYIDVVYTNEHILKAYSAQWWPLENEAAIPPSDDAWTLIPDPTTIHAKGRPKSARIRNEMDWLEPSKHRQKCSRCGVEGHNRRRCPIQSDHGSCSFN

SEQ ID NO: 110814 - protein, 119 aa, Glycine max
  Coding DNA Sequence Number=SeqID_19129
  Gene Ontology: Mol. function=motor activity; Cellular component =flagellin-based flagellum; Biological process=ciliary or flagellar motility
  Homolog annotation: Hit_ID=Q1GZU3; Match level="QueryCoverage=95%, HitCoverage=34%, E-value=2e-45, Identity=78%"; Hit description =Flagellar motor switch protein FliG
  Pfam annotation: Domain name=FliG_C; Domain location=1-110; Score =161.5; E_value=2.2e-45; Accession=PF01706.7; Description=FliG C -terminal domain
MDGLKSYDDGMAQQIMDQMFVFDNIMEIDDRGIQVLLREVQSDMLIVALKGTSDEMKEKFFRNMSSRAADMMREDLESRGPVKLSEVEGQQKQILQIVRRLADEGQIMLAGKGDSEQYV

SEQ ID NO: 110815 - protein, 250 aa, Glycine max
  Coding DNA Sequence Number=SeqID_19130
MGAGGLLQHHRLAGVRRLYLRDGLRGHRTGAAHRTVPGEVYGQAHADAGLCGGDHRYPAGAVHAVQHRAHRRHGVPGGEKPAAAVRFFPQRSLFTPHRRLPDVDDGGRHQHQLLDVRHRRRAERTGHRVRRQDRRGAHQLDAVVPGVPAGRPAAVDRCAADLLLPVQTGRDPQQRSGRLGGYRAGGNGQADAQGIHPDRPGAAQPVPVGVRRQNAGCHRGVPAGGVADAGAARGVVERDHQIFQRLEYAG

SEQ ID NO: 110816 - protein, 219 aa, Glycine max
  Coding DNA Sequence Number=SeqID_19131
MVRFMKQANVFPSKKTLKKFILWGINNDKGILKEDFQAFSRVPIINKDSGGHTLVTMSNHKITELALKNLEVQVEQLAKQIVDKSSNSFVANTEQNPKEECKDVMTRSKRFVEAEDEESVVYNEKVAEKESTEVKKNDGRGEGNQEKEKQIMVQKKEMEDQEKEKEVEKEIENEKKCKRRKKIRLQRRVEVKKLWTKVWKYHILWYLPRRRKIVIWQDF

SEQ ID NO: 110817 - protein, 108 aa, Glycine max
  Coding DNA Sequence Number=SeqID_19132
MTLISACQRACRPRLTKGTEDDVSICVLSGFSSYRQQKVYTDNHSGISARQRDSKTSKKFIRITTRVFPPVNVTQKQQKVYTDNHSGISARQRDSKVSMTDLVSAEDD

SEQ ID NO: 110818 - protein, 92 aa, Glycine max
  Coding DNA Sequence Number=SeqID_19133
MFESTSTFKDTELAHYTFANTAFMGKKQPSMLRVKKALCQYEAEYDGHHAFGSWQFRLRNLCKELKMPQEEPRKDMCCNKSALRLGKESSLL

SEQ ID NO: 110819 - protein, 185 aa, Glycine max
  Coding DNA Sequence Number=SeqID_19134
  Homolog annotation: Hit_ID=A7UQU7; Match level="QueryCoverage=48%, HitCoverage=18%, E-value=5e-11, Identity=38%"; Hit description=IMP dehydrogenase/GMP reductase, putative
  Pfam annotation: Domain name=DUF1723; Domain location=152-185; Score =21.6; E_value=0.0015; Accession=PF08330.1; Description=Protein of unknown function (DUF1723)
IMARTRGLGRAIGRFVGRDRAADEDAGDVPERRRPTASARRLRVHQMTTEGRDMAEDVADMTDDVPEQPTEAPEMRADAQGADSGEGSDGDDAAEGFPGGPRDPSVLTSFAEHVAHAVWSGQLTLIGRPVPEIEGLVAATGLSPLIDCSVITGDPGLISAFVERWHSETSTFHLPVGELTITLDD

SEQ ID NO: 110820 - protein, 125 aa, Glycine max
  Coding DNA Sequence Number=SeqID_19135
MVAITPARFRQSPFFRGYDSNATCACHGEAPRRSIEHCRALKSKDFQVQAIGQFAQATCAPEFGLPRPFNQRLLVLHVGGVAVKQRGQPFPCVQESSTTRDPRSLNPFSEIRRREEEKKRSLLKR

SEQ ID NO: 110821 - protein, 226 aa, Glycine max
  Coding DNA Sequence Number=SeqID_19136
PEPDPRDRRPERLRAAARLAPGTRLRRLPGMRRLGRDPHCRRRGRLRPGIACPALAGTGAALWRGAVPAGVRGAQPAFRPAQPRQPDAIGSASGRAGRDPGHLPGLHLAQSPCLSRHGGAARFDLQPVRRTQGCLRAGRDGGFVHVLLHTGVRRPPVAAGVRQPDGVAGAGRPGRHRHAGDRVEAGLAVILSRRRPHWPDVALRTAAGVLRNVTPRRLNAFISPIA

SEQ ID NO: 110822 - protein, 198 aa, Glycine max
  Coding DNA Sequence Number=SeqID_19137
  Homolog annotation: Hit_ID=UPI00016621D1; Match level="QueryCoverage =95%, HitCoverage=42%, E-value=9e-16, Identity=32%"; Hit description =UPI00016621D1 related cluster
GQHVLTIKGLHVLTYSGLLALAFRGLHVLAIRGLHALNFRKLRVLTFRGIHVLAFRGLHVLVFRGLQVLAFKGLHVLAIRRLHALAFRGLRVLKIRGLHALTFRGLHVFAIRGLHALTIRGLHVLAFKGLHVFTFSGLQVLAIRGPHALTFRGLHALAIRGLHVLTLRGLHVLTFRGYLPFPSEDYTSSPSEDCTSSP

SEQ ID NO: 110823 - protein, 36 aa, Glycine max
  Coding DNA Sequence Number=SeqID_19138
MLGSGNLIVRMYACPCCMLVFKKNNVLTNEMRYVYY

SEQ ID NO: 110824 - protein, 47 aa, Glycine max
  Coding DNA Sequence Number=SeqID_19139
MTQVKARAISRLGRIDGDPALRGTTIRATWEYVSSVEGGQQGMVGYT

SEQ ID NO: 110825 - protein, 97 aa, Glycine max
  Coding DNA Sequence Number=SeqID_19140
  Subcellular localization annotation: CTP_CleavageSite=36; ConfidenceScore=5.47e-01
MRVHCNQASRRPSMTTDSPPLLMFPWTRSPVESPTVATNPTTEGRREGSRVRLPWEEDARSRNQRLFEENVGKNGKVWSTNFKCERFGSCIYARGRY

SEQ ID NO: 110826 - protein, 118 aa, Glycine max
  Coding DNA Sequence Number=SeqID_19141
MVTSRKTMKVRSGFVLNRNREASLEDSASLEGSSRCGVSTENNGGLWGLLVVVGDGEEALDVGNGFGRKKEKKWRFSKATWTTRLKTHKHILKDPNGQILDIRPMNLQTKFQEDPTVN

SEQ ID NO: 110827 - protein, 351 aa, Glycine max
  Coding DNA Sequence Number=SeqID_19142
RLGQELVVAAVRAVDLVAGAQRQHRADGAAFLAHRRVGGAVHQAFGGQVQHRFLEGADPVQLRQHGGQQRGVGLLPVRGLDRQLPPGRLGTKRLVAVAAPAAIGHQGVSGDVGGLAGRQEHRQVGHFGRLRQAPQRRALLEAFGVEAAARGQVAHQVGLDVAGRQRVHAHARRAPFHRQGLGQQYHRALGGAVGGAVGRRHHAIHGGQVDDAALALGHHAAAGGLGAQKHAGQVDVDGAAPFLGGDVQRRLVGRDAGVVDQHVDAAPGLFDLGEDALDRVGVGDRGLRGQRLAAGRAQPGHGRVQRYRVHVQQRHPRALAHERLGRGVADAFGAAGDHHVLAAQVGVAYFR

SEQ ID NO: 110828 - protein, 230 aa, Glycine max
  Coding DNA Sequence Number=SeqID_19143
  Pfam annotation: Domain name=Transposase_23; Domain location=65-130; Score=-9.6; E_value=0.013; Accession=PF03017.5; Description =TNP1ENSPM transposase
MDTFKGQIQEAIKLELSQIASQHSAPLQPNDIQVLAARVSTKGSCAAAETNALAKKPSELNGDNVGLHVTVENSNKLVAVGKRCDSFGTIHNVPYADDVVRVSMVEVIFDDAEVPIPTSEIKFVKEALGSFVPWPTHLVKPILPEEAEKDVSSPLKTIEEEKVAEVIDPLGELVKNLFDIYQRPVEVSWDGAKFGINNVKDGFFITHADVSEIILGDKCLNISILQLWLM

SEQ ID NO: 110829 - protein, 101 aa, Glycine max
  Coding DNA Sequence Number=SeqID_19144
IRPSITWAFIEKYCTPRQAQGDAHQATDALPPPRQADPAGSLGMERYLQHLVLQQATNHRGQVQIHECLYRFSLSQLGQGSAPFACPTPEQFGEEVAWPGD

SEQ ID NO: 110830 - protein, 246 aa, Glycine max
  Coding DNA Sequence Number=SeqID_19145
  Homolog annotation: Hit_ID=Q84VH5; Match level="QueryCoverage=100%, HitCoverage=41%, E-value=2e-84, Identity=64%"; Hit description =Envelope-like protein
  Subcellular localization annotation: CTP_CleavageSite=21; ConfidenceScore=5.12e-01
MATSPKETSAPGSPSVPSSPSSTKAPSNQEQPEFHIQPIQMIPGQAPVPEKLVPKRQQGVKISENPSRATSPREVDPEMDKKIHSIVSSILKNAPVPDADKDDSTEEEDQATEETPAPRAPEPAPGDLIDLEEVESDEEPIANKLAPGIAERLQSRKGKTPITRSGRIKTMAQKKSTPITPTTSRWSKVAIPSKKRKEISSSDSDDDVELDVLDIKRAKKSGKKVPGNVPDAPLDNISFHSIGNVE

SEQ ID NO: 110831 - protein, 159 aa, Glycine max
  Coding DNA Sequence Number=SeqID_19146
  Gene Ontology: Mol. function=hydrolase activity, acting on ester bonds; Cellular component=periplasmic space; Biological process =nucleotide catabolic process
  Homolog annotation: Hit_ID=A4W7G3; Match level="QueryCoverage=88%, HitCoverage=25%, E-value=3e-75, Identity=95%"; Hit description=5' -Nucleotidase domain protein precursor
MGHYDNGEHGSNAPGDVEMARSLPAGSLAMIVGGHSQDPVCMASENKKQVDYVPGTPCAPDRQNGIWIVQAHEWGKYVGRADFEFRNGEMKLVHYQLIPVNLKKKVTYPDGKSERVLYTPEIAENQQMLSLLTPFQNKGQGAAGCENRHAERASGRGPQ

SEQ ID NO: 110832 - protein, 57 aa, Glycine max
  Coding DNA Sequence Number=SeqID_19147
MAKGCGMTKFCLRMSSGPPPLDDKRGQYDRACGAADKSKALAPTYPPMRNSDLRSSG

SEQ ID NO: 110833 - protein, 109 aa, Glycine max
  Coding DNA Sequence Number=SeqID_19148
  Pfam annotation: Domain name=SnoaL; Domain location=1-98; Score=2.1; E_value=0.00043; Accession=PF07366.3; Description=SnoaL-like polyketide cyclase
MYETVLNKKQSDQAGKFIDERYIVEFNNQNKPLFDAFPDIHFTLKDIFEGGNKVITVYGVGKEPIFINTKISLLHKKRDGKIVSSTASPDKLSFYQQLGVGPDLLVTKE

SEQ ID NO: 110834 - protein, 129 aa, Glycine max
  Coding DNA Sequence Number=SeqID_19149
MVKEECKEVSVSSKRLPKKERHFEIKTNIKEISPLRQPPHFLLCKKTLASIATPLGLEFIPQVKELLDEGLVHKSLNPCALLVPKIGIIRHQIPKIGDMMSVLSGATLFCKITHAPNIFKIRVDRDSLG

SEQ ID NO: 110835 - protein, 193 aa, Glycine max
  Coding DNA Sequence Number=SeqID_19150
MARGQHHVTVQQQHRHADEFLDFRQGFVVIIAAGLEILAGGAGQAGHVGQRFLALFGQGWPVATTTQTEAAQERAGPAEHGIGLRGHVIVVGQQQFEGEVTVFQLLDGDLQQLRQHAVGGHRRQVVVGQHARRPVVAGGAAGGQPATQRAVQLGSGGAQAQFLAGAVTSSTEGSSVIVRLVRKGNPGRARARP

SEQ ID NO: 110836 - protein, 136 aa, Glycine max
  Coding DNA Sequence Number=SeqID_19151
  Homolog annotation: Hit_ID=Q6UUU1; Match level="QueryCoverage=44%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLYGR

SEQ ID NO: 110837 - protein, 100 aa, Glycine max
  Coding DNA Sequence Number=SeqID_19152
MFLQKVVASGGSNLACLGKLGGKHLLPFPINRGRREEQKGSTLLVSEIHLKLVRKIVSVKKIHSRGASVTFLWVISRRFSTVLRRSSFVLRSSTASVNFC

SEQ ID NO: 110838 - protein, 173 aa, Glycine max
  Coding DNA Sequence Number=SeqID_19153
  Homolog annotation: Hit_ID=UPI00006A2D9E; Match level="QueryCoverage =98%, HitCoverage=85%, E-value=3e-15, Identity=17%"; Hit description =UPI00006A2D9E related cluster
MTGPLDESISCFLIRVDPWVLVPIAFIRGLHAQAFRGLHILALRGLHVLAFRGLHTLAFRGLHALAFRGLHVLPYRGLHALTLRGLHVLTFRGLHVLAFRGLHVLPFRGLHALAFRGLHALAFRGLHALAFRGLHVLAFRGLHVLAFRGLHALAFRGLHVLAFRGLRTLAFRG

SEQ ID NO: 110839 - protein, 158 aa, Glycine max
  Coding DNA Sequence Number=SeqID_19154
  Gene Ontology: Mol. function=catalytic activity; Cellular component =cellular_component; Biological process=metabolic process
  Homolog annotation: Hit_ID=Q9MB42; Match level="QueryCoverage=59%, HitCoverage=16%, E-value=9e-23, Identity=48%"; Hit description=Beta -amyrin synthase
TVLIANNVSLLNKEDNAPIYSVEDVKNIKEIAARDDAFDLLSDSLAPSIYGHSWIKKGVLLNPTKFLGNIVVEHDYAECTGSAIQALVLFKKLYPRHRETEIKNSIANAVHAASKTYTNCAAIRKTIKFLLSTLKEDGVFWEKAIFHAQNRFVIEWSW

SEQ ID NO: 110840 - protein, 260 aa, Glycine max
  Coding DNA Sequence Number=SeqID_19155
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSIRGGAVATWLAQCRSDLGHRDNRIPHHQIESSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 110841 - protein, 176 aa, Glycine max
  Coding DNA Sequence Number=SeqID_19156
  Pfam annotation: Domain name=zf-CCHC; Domain location=61-78; Score =16.7; E_value=0.0045; Accession=PF00098.14; Description=Zinc knuckle
MVEQQLKRKSTSKSYGSHSYPKKDQCQGILGVRPSKPKDDKGKTIEKQPLKASMQEKTRSMKCFKCLGRGHITSQCLTQKTMIMRGQDIYSSQYEATTSPSSSKSEEAKGEESSKEIYPQEEGQPLMVKEECIIRHQIPKIGGVMNALGGATLFCKITRAPKGVEEKSPEFQEPRD

SEQ ID NO: 110842 - protein, 106 aa, Glycine max
  Coding DNA Sequence Number=SeqID_19157
  Homolog annotation: Hit_ID=A0ST23; Match level="QueryCoverage=23%, HitCoverage=51%, E-value=3e-07, Identity=100%"; Hit description =Putative reverse transcriptase
MASNALLTNDQRLARHLNMDATCLRWGARYQLLFPLVRVNFELGVIMVIAVSFGKPVVPAALMNRPTRGERRFAYWALAECILAYYVGTDEGVSEVLHVAEKKGCT

SEQ ID NO: 110843 - protein, 214 aa, Glycine max
  Coding DNA Sequence Number=SeqID_19158
  Gene Ontology: Mol. function=hydrolase activity, hydrolyzing O -glycosyl compounds; Cellular component=anchored to membrane; Biological process=carbohydrate metabolic process
  Homolog annotation: Hit_ID=A7Q143; Match level="QueryCoverage=41%, HitCoverage=23%, E-value=1e-35, Identity=78%"; Hit description =Chromosome chr10 scaffold_43, whole genome shotgun sequence
MGFKGIEVRVSETGWPSKGDANEVGATPMNAATYNRNLLRRQMAGEGTPLNPRMRLEVYLFALFNEDLKPGPTSERNYGLFRPDESMTYKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 110844 - protein, 101 aa, Glycine max
  Coding DNA Sequence Number=SeqID_19159
NRSRGTSITLPRRFREENCLPSFFTVLHSFFVLQPEEKKPEENKVEEKKANEEEKKEEEKKSEESKDDKEPKEEYMPPEIVQGTTFGMHGHFKHDFWHLLS

SEQ ID NO: 110845 - protein, 64 aa, Glycine max
  Coding DNA Sequence Number=SeqID_19160
MLVDLKKLAYQNDPFIMTEQAKHMMIHTLILMLVLCPHKCRLTSSEKKKLTTFMLIVMIMMNEN

SEQ ID NO: 110846 - protein, 23 aa, Glycine max
  Coding DNA Sequence Number=SeqID_19161
MPDISLHERNIKLIDTVDLEGGP

SEQ ID NO: 110847 - protein, 282 aa, Glycine max
  Coding DNA Sequence Number=SeqID_19162
  Gene Ontology: Mol. function=oxidoreductase activity; Cellular component=cytosol; Biological process=auxin mediated signaling pathway
  Homolog annotation: Hit_ID=Q65QR0; Match level="QueryCoverage=100%, HitCoverage=95%, E-value=1e-113, Identity=68%"; Hit description=Tas protein
  Pfam annotation: Domain name=Aldo_ket_red; Domain location=9-273; Score=133.1; E_value=8.1e-37; Accession=PF00248.12; Description =Aldoketo reductase family
MGLGCMGMDHGYGYSVEIRERTKLIDKAVELGCNLFRHCPPFTDLKTKNCWVLRSANTGTTRPASVREQLEGSLSRLQTDHIDLFYQHRVDPKVEPEVVAGLMKELIAEGKIKYWGLSNAPVSYIRRAHAVCPVTAVEDQYSMMWRKPEQDLFKVCDELDIGFMAYSPLGNGFLSGQVTADTTYGEGDYRGMMGRFKPEVMENNQALLDLIAQIAERNNATSAQIVLAWELAQKPYIVPIPGTTKLHRLEENFHAANVQLSDAELNDINEALSRLEIDETFF

SEQ ID NO: 110848 - protein, 45 aa, Glycine max
  Coding DNA Sequence Number=SeqID_19163
MQRIAKVPEYREMKQEKILALARKVALSGYYNFDWSCMLDQVASE

SEQ ID NO: 110849 - protein, 133 aa, Glycine max
  Coding DNA Sequence Number=SeqID_19164
MEFADHLLPAGQPCLVPGQVSADYIEWFFRISHPFMTPTQAADQQRDAPAADPEDYIQPPSPQVPVAFDPPPYVDDYEGYEAIAQRLEPLLNLRIVTAGTELYDIMQDCLTIARGGPSADGTVRARQRRRTDH

SEQ ID NO: 110850 - protein, 53 aa, Glycine max
  Coding DNA Sequence Number=SeqID_19165
MASYGVASPLSLPFSIPLAFIFQEAKESIDEEDPRPTSSNGACISDSSPRQWR

SEQ ID NO: 110851 - protein, 177 aa, Glycine max
  Coding DNA Sequence Number=SeqID_19166
  Gene Ontology: Mol. function=motor activity; Cellular component=cell projection
  Homolog annotation: Hit_ID=UPI00016621D1; Match level="QueryCoverage =96%, HitCoverage=40%, E-value=4e-16, Identity=35%"; Hit description =UPI00016621D1 related cluster
GLHVLALRGVHVLHFRGLHVLPFRGLHVLAFRGQHVIPFRGLHVLTLRGLHVLAFRGLHILAFRGLCALTFRGLHVLTFRGLPVLTFRGLHVLAFKGIHSLTFRGLHVLTIRGLHAVTFRGLHVLAIRGLHALDIRGLHALVFLGLHVLTFRGLHALTIKGLHVLAFKGLHVLAIKI

SEQ ID NO: 110852 - protein, 116 aa, Glycine max
  Coding DNA Sequence Number=SeqID_19167
MEVVKWQATTRTVWRQECPKVANTNVAFAEAIRSNHQLSSKEEKKDLAGKVEGITVERGELAKAAKIKELEEKLIMYKKEAGFFTKVLDLGLFDPFKDVKDGVLLDKEEIATKEEE

SEQ ID NO: 110853 - protein, 80 aa, Glycine max
  Coding DNA Sequence Number=SeqID_19168
MGNKGEVKKSGNPQNKNYKLSFKKLIWLEAYKNKMPKSSPNMHVKQEVSTRVKPRLLCKQSMGQNTPNKKDDDGSNSHQG

SEQ ID NO: 110854 - protein, 133 aa, Glycine max
  Coding DNA Sequence Number=SeqID_19169
MLGKFGRIDGDPVLRETRIWATWEYVSSVGGGLQGMSGTLEICRGGQETLGTSGGVLLPKTKLDQSRPNPGVATYPLAGGRRVTCGMRVPRKEYARSRHQRLFEENVGKTGKDAIYELFSERFGSCIYARGRY

SEQ ID NO: 110855 - protein, 36 aa, Glycine max
  Coding DNA Sequence Number=SeqID_19170
VEGRTPEYQEPRDLRSNPFERGGDDAILPPPPPPPP

SEQ ID NO: 110856 - protein, 117 aa, Glycine max
  Coding DNA Sequence Number=SeqID_19171
AGNHRLVGETSRTSCRTNNKKLSSYPTSSFEDLLYPPHLFPHHVRIASTIALFLLRACSADLWGTVVLDPGLLISIWHLLLARASTTTGNDWTHHPLAIESISWCTELGTEETVRVH

SEQ ID NO: 110857 - protein, 76 aa, Glycine max
  Coding DNA Sequence Number=SeqID_19172
MWVQAIGLFAQATCAPEFGLPRPFNQRLLVLHVGGVAVKQQRDNPFPCVQESSTTRDPRSLNPFSEIRRREEEVSP

SEQ ID NO: 110858 - protein, 66 aa, Glycine max
  Coding DNA Sequence Number=SeqID_19173
MKILSSGVVFTFEEVDKSGALAPTYPPSKRKSDLRSSFLRVNHTISFYLKGDHLKVLDLKNDPLTW

SEQ ID NO: 110859 - protein, 225 aa, Glycine max
  Coding DNA Sequence Number=SeqID_19174
MPLSAAADSLAVDCDEEDREEHTYTDVQGAPGPTPDSGCLLDPVWGAPTGLRLPCDIMLFRSLALGACCCLLSTREGRAAVWDTRRPFPLLLSIHGCRTDDIHDSDYMDWFFHISHPFMTPGHTSDPLPHGHAPQSRVIPQAPQTDISHVLKPGASSTSVEEPKHAVEIYDDIVERLERHLSQGAVTPDSSTHEVIEERLRLAKSVTQDHLVYVRSRRRRRTNQA

SEQ ID NO: 110860 - protein, 63 aa, Glycine max
  Coding DNA Sequence Number=SeqID_19175
MTAETDIVFCTFCSSRAAGNKHLRGNFMVTRDSRQPRGAKLVSYTDFRGPLLDDMRPFFGPCE

SEQ ID NO: 110861 - protein, 156 aa, Glycine max
  Coding DNA Sequence Number=SeqID_19176
LFVLQIAKRNVNTDNHSGISASQRDSNVSMTDLVSTEDDAFRLTDIKRKFIRITTRVFPPVSMTQMSIAKRNVYTDNHSGISARQRDSNVSMIDLVSADDDVNLGVLMGLSAAIDKGRRRRDNHLGISARQRDYNVNMTDLVSAEDDINLRVSPSL

SEQ ID NO: 110862 - protein, 47 aa, Glycine max
  Coding DNA Sequence Number=SeqID_19177
MPPRFPSGELEPNNEGLTIDFDRDISPTVNEEEEEDVLSPELERLVA

SEQ ID NO: 110863 - protein, 148 aa, Glycine max
  Coding DNA Sequence Number=SeqID_19178
MGEVEEVQEQMKADMEAMKEKMAIMMEAMMSMKKIMEANAVTVAVTSAVAQVNPMAPSDLNQMNHPTSAMVGKDLGSKGGPYYVQIQNKHAFPPYGLPPNLHHPMWCTLPMRMLVTPLLYSLRANNLNLIMHISLNPWGRHMKCPTII

SEQ ID NO: 110864 - protein, 72 aa, Glycine max
  Coding DNA Sequence Number=SeqID_19179
MATSPKETSAPGSPSVPSSPHQGQPEFNIQPIQIIPGQAPVPEKLVPRRQQGVKIAENPSLVTSPREVGGIL

SEQ ID NO: 110865 - protein, 48 aa, Glycine max
  Coding DNA Sequence Number=SeqID_19180
MNVHCLVAVHMSSTFEFGAMLHDCLSADPQALFMCPPPSSLELCFMIA

SEQ ID NO: 110866 - protein, 68 aa, Glycine max
  Coding DNA Sequence Number=SeqID_19181
MITTKKLYPLLAMNPKAVILLDPVINQEANPLLAMNPKAVSLLSPVFNQEDLFLEKQSPRVGLLKSFL

SEQ ID NO: 110867 - protein, 82 aa, Glycine max
  Coding DNA Sequence Number=SeqID_19182
MEGLVDLAAIDAFLAFHHGKEIPVVAILARHDTFDQRGEKSGARIVCCTPALYVWLVGSSIRYKVTASCVEKKKDELGPTLG

SEQ ID NO: 110868 - protein, 298 aa, Glycine max
  Coding DNA Sequence Number=SeqID_19183
  Homolog annotation: Hit_ID=A5APQ3; Match level="QueryCoverage=27%, HitCoverage=5%, E-value=3e-08, Identity=37%"; Hit description =Putative uncharacterized protein
SGTNRIELMRQFGMQQPIPESPSQPWNVHGLTLKGKMDENWFQLLAPFISQWNNRAEFRVDVYARQEGLLSFNSDYMLWYRRITEMFIDPNNANTATLGEVTETLQYMVSPQGRNTWTVDDLVPYVEKLAILSQEQERITEPVAHGPASERRFPPQQFHMLQSSVETRGFDKRREIVQAEDFSQHMEQRGHGMGMYRYPFEGHDTDMSASEHSFGGVAETQPHFSWPTMTPSQQHDAPMATPNTPLGQQWDVPGAIPRLRNKGGDSAQEEIRIVKPEGGIDHVAHPRAITDTTMTDFD

SEQ ID NO: 110869 - protein, 153 aa, Glycine max
  Coding DNA Sequence Number=SeqID_19184
MPPTRHPLDPDKSNWALGFPVLIMGLCQSFGVPVTPSKATDAPPPPHQADPAGSFGMERYFQHLVRQQAANHRGQVQIHECLYQLSLSQQSQGFAPFACPTPDQFRDEVSWPRDWPEDQTEEAPAGAPDGAEDARMDEEMTYLLDFLGGSEAT

SEQ ID NO: 110870 - protein, 47 aa, Glycine max
  Coding DNA Sequence Number=SeqID_19185
MGLSATMHRQKRKTLDEGSLLSSESTTQHDYRSTPTPYDSHRPGYRA

SEQ ID NO: 110871 - protein, 35 aa, Glycine max
  Coding DNA Sequence Number=SeqID_19186
MSLHSSSSVNGEGSTPKDPFGLPLLGNEGFMGILQ

SEQ ID NO: 110872 - protein, 104 aa, Glycine max
  Coding DNA Sequence Number=SeqID_19187
MNFDDAKEESNRAASKDTHCFKINTILLQQTKSCFKITLRSSLASKQSDSKICKALVIDYQTVRLPVVCNRLPATKLLKFKFKSHDPSKFNCVTDYQKLVIAYQ

SEQ ID NO: 110873 - protein, 164 aa, Glycine max
  Coding DNA Sequence Number=SeqID_19188
MALVKEFYANLYTTEDQAPKQARVRGHLIKIDADKLNEFLQTPVVLKEGESLPTYFRFCRLRTKHQEIDARLCIPRKGKDLTALAQTWSVFSYSNLAPTSYTSDLNMDRARLVYGLVTNIDMNIGALISGHISSIAQSNSSRLRFPALITAVCRARGVTSDNLT

SEQ ID NO: 110874 - protein, 109 aa, Glycine max
  Coding DNA Sequence Number=SeqID_19189
IVPTKHPVDPKNSNRDLGFPALITGLYQFYGVPVAPSKVIRPPINRAFIEKYYTPRQAQGEAPQQPGDGQQWAIDALAPPQGSTSAHLQRLECCLRPVVDQQANKSKAK

SEQ ID NO: 110875 - protein, 110 aa, Glycine max
  Coding DNA Sequence Number=SeqID_19190
MTSKIILMMSNNQELSKFQRIRLQESRYILCGTSRGYIYLGCYTENKRGYISCGSVQVEGTSTWLFKDNKGGYIPCGSLACKGFYKVERNLKNRWLLGDWMKARIVAEPV

SEQ ID NO: 110876 - protein, 162 aa, Glycine max
  Coding DNA Sequence Number=SeqID_19191
  Gene Ontology: Mol. function=phosphotransferase activity, alcohol group as acceptor; Cellular component=cytoplasm; Biological process =carbohydrate metabolic process
  Homolog annotation: Hit_ID=Q98I54; Match level="QueryCoverage=95%, HitCoverage=30%, E-value=5e-32, Identity=46%"; Hit description =Bifunctional protein hldE [Includes: D-beta-D-heptose 7-phosphate kinase (EC 2.7.1.-) ...
  Homolog annotation: Hit description=(D-beta-D-heptose 7 -phosphotransferase); D-beta-D- heptose 1-phosphate adenosyltransferas e (EC 2.7.7.-)]
  Pfam annotation: Domain name=CTP_transf_2; Domain location=76-161; Score=4.7; E_value=0.00042; Accession=PF01467.17; Description =Cytidylyltransferase
MACGGSVELAAHVANTAAGIVVGKRGTATTTRSELMEEFAKESDTGHAPSAVKVLSWEEAKVVSRSWLNDGLKVGFTNGCFDILHVGHTSILDFARSHCDRLIVGVNADASIRRLKGPERPINSQDDRANLLSALAVVDAVVIFDNDTPKELLHSSRAVVAC

SEQ ID NO: 110877 - protein, 96 aa, Glycine max
  Coding DNA Sequence Number=SeqID_19192
MSGLTRDSPQISVSPHQLDLAPYASGPYNAQWNAPGLLHDKHTLRSSHILGEMEVDEPWLGLWLLHDTEIWGESYRLFCCTIHFLVGVLARAKGGV

SEQ ID NO: 110878 - protein, 83 aa, Glycine max
  Coding DNA Sequence Number=SeqID_19193
  Homolog annotation: Hit_ID=Q10IC4; Match level="QueryCoverage=65%, HitCoverage=2%, E-value=2e-08, Identity=50%"; Hit description =Retrotransposon protein, putative, Ty1-copia subclass
MSLASPSRRRVGCDKGHSASTGYIRKNGNSIGKMVWVPKGSFVKTNIQGPKKNWDSLKQSWYIDSGCSKHMTGDASKFSHISP

SEQ ID NO: 110879 - protein, 153 aa, Glycine max
  Coding DNA Sequence Number=SeqID_19194
MSSEVTSSLTSFVLNGIVMTGMLEVVSNPWRFIVGNWLCDSDLVSPTGIERVLTEKDLLADSYSDLEAYILDEKEFLLLKVISTFPELSCLICSMVGAGQGKDGVALSITHLSGRVTSSHFIFLGRETLAFVISVINKVVSPFRGFNRTLDAQ

SEQ ID NO: 110880 - protein, 286 aa, Glycine max
  Coding DNA Sequence Number=SeqID_19195
  Gene Ontology: Mol. function=motor activity; Cellular component=cell projection
  Homolog annotation: Hit_ID=UPI00016621D1; Match level="QueryCoverage =74%, HitCoverage=39%, E-value=1e-15, Identity=32%"; Hit description =UPI00016621D1 related cluster
GGPLGTSTLTFRGLHVLTFRGLHALTFRGLHTLAFRGQHVLAFRGLHVLSIRGKHVLAFKGLHVLAIRGLHVLAIRGLHVLAIRGLHALAFRGLRGYMHALRGLRVLTFRGLHALAFRGLHALTFRGLHALTFRGLHVLTIRGLHVLAFRGLHALTFRGLHVLTFRGLHVLAFKGMHTLSFNGLHAVAFRGLDALAFKGSSALNAQPRLALRVTGASSFLLLVGVPGPPPDPGGGPTVRAQLEEEAIVQPLCILGQDFTRARYKETSADHMHQHDHSYTDMDDVAT

SEQ ID NO: 110881 - protein, 166 aa, Glycine max
  Coding DNA Sequence Number=SeqID_19196
MIALLASHATLAADGQITFVGAIVEPSCEYAVTRSVSLNCTREGIKKSETLQVNGAARELPYALGIAHITRERGLTFLQAGADQRLYGAAGSAPYILRHENLSDYCPGRRHAVRGGGYRRHPDARQPAPAGGRRWRTLSHQHCDHAAAPGDPRPVRPQSARRSQTG

SEQ ID NO: 110882 - protein, 84 aa, Glycine max
  Coding DNA Sequence Number=SeqID_19197
MGFHPTKLNFVPSDADEAPLDVSICLHAFGIVGCGSFSGVKSCERADDWFLCAYLPNGIRVASQTHSIQASLLGDAGGFQSPTT

SEQ ID NO: 110883 - protein, 52 aa, Glycine max
  Coding DNA Sequence Number=SeqID_19198
LEEINEEAEDDKEERKRKKVENEKQKEKVVDDEMRRGKSEAYTEKEEGYYSK

SEQ ID NO: 110884 - protein, 84 aa, Glycine max
  Coding DNA Sequence Number=SeqID_19199
MPFCGRARRGSRVRFPKEERCAELPPTFICGKRRKNRRKPVKMKILSSGVVFTFEEAQLAQASKVASSRSNRLLEEEIGRPKWA

SEQ ID NO: 110885 - protein, 167 aa, Glycine max
  Coding DNA Sequence Number=SeqID_19200
MDKGLIEVYSARKGEGDVCMHLVDKSPGKPKPLVIHFTRDVATQKPQGFQPVLVTKPTPFPYKSDKVVPWKYAAQGLNRRKDTSVVLVKDDLSSTKVKTYPIFAPPELPVRSKDPKGKAKADVVESDKADEVLVGRFAKEEDDFRKNGISAKEATEFLKIIQQSKFK

SEQ ID NO: 110886 - protein, 160 aa, Glycine max
  Coding DNA Sequence Number=SeqID_19201
MIRGDTLRLSAPFCHPEAAGPMTSRDQVWSFCTLVSSRGGGPDDTRRYLTIIRTLLSSRGGGPDDTRRYLTVIRTLLSSRGGGPDDKQRPKAAGPMIRGDTLRLSAPFCHPQAAGPMTSRDQVWSFCTLVSSRGGGPDDTRRYLTVIRTLLSSKGGGPDD

SEQ ID NO: 110887 - protein, 159 aa, Glycine max
  Coding DNA Sequence Number=SeqID_19202
  Gene Ontology: Mol. function=nucleic acid binding
  Homolog annotation: Hit_ID=A3BTE5; Match level="QueryCoverage=54%, HitCoverage=9%, E-value=1e-08, Identity=36%"; Hit description =Putative uncharacterized protein
  Pfam annotation: Domain name=zf-CCHC; Domain location=125-142; Score =11.7; E_value=0.026; Accession=PF00098.14; Description=Zinc knuckle
MWRAIKEARQLVEGNGRKQYAKLRSTQCQVQKVHHNFRGYIFVLLAVRREWVECHEWLSIEAYNKTYQHFIEPVQGPQYLARHSIHILFPPHKRVQRGRPKKNRSRSVDEDNVTGHRLKRKLADFTCGRCGQTNHNIRSCKKYWSSYYAKEICCTTNFK

SEQ ID NO: 110888 - protein, 58 aa, Glycine max
  Coding DNA Sequence Number=SeqID_19203
MARMKKTGQMTSEAAKEIADRIMSKPILFRLLTTGFPGGVGLTRKLCRPWMSGCTDCY

SEQ ID NO: 110889 - protein, 41 aa, Glycine max
  Coding DNA Sequence Number=SeqID_19204
EINESHKDSKNGGFNPFSVSLTFGNSIGAVGGKTGGISGNR

SEQ ID NO: 110890 - protein, 166 aa, Glycine max
  Coding DNA Sequence Number=SeqID_19205
STLEDPTCLTETCAPGEGASSFLLSVPGPSPDIGGQPTVRAHPEKEAITHLESDSQRHSVDPKKSNRALGFLALGSRLQDTQWTRRSPIGSWSCQALITGLCQFYEVPVTSSKGIRPPTNRAFIKKYCVPRQAQGETPQQPGDGRQRATDAPPSPLEFTSAHPQKG

SEQ ID NO: 110891 - protein, 124 aa, Glycine max
  Coding DNA Sequence Number=SeqID_19206
MIYISLFLKQILLDIIKIFMIYKSAKVDVSLSELNALSECHLLSEASTRLADRRNLEGNLSRRHALSVSSAHSASHLSPLGLSASLALCKSSLTRAKRKNGAKRDVEELPCYGRLNPQLGILAE

SEQ ID NO: 110892 - protein, 20 aa, Glycine max
  Coding DNA Sequence Number=SeqID_19207
AEIAGAGSLNIQTGINYWEL

SEQ ID NO: 110893 - protein, 111 aa, Glycine max
  Coding DNA Sequence Number=SeqID_19208
MRGTGFGSMLGRKDSLREGNPSLAQEGMDLFRSWRGSIIMPIGWTSQESEADIEEEEPTDLRSNLLQGGGDDAILPRKGPVTRAMSKRLQEDWARVDKEGLRVLMNLRVDF

SEQ ID NO: 110894 - protein, 71 aa, Glycine max
  Coding DNA Sequence Number=SeqID_19209
  Homolog annotation: Hit_ID=A5C4T9; Match level="QueryCoverage=92%, HitCoverage=10%, E-value=8e-08, Identity=43%"; Hit description =Putative uncharacterized protein
MEYQKIHACPNDCMLYRHEFQEYCQSVCGTSRYKVKDEEEKKCSDGMLYWTLPVARRSDGLGMSQEIKMLA

SEQ ID NO: 110895 - protein, 59 aa, Glycine max
  Coding DNA Sequence Number=SeqID_19210
MGRIVLDNGQRSRQGQRQKSIKVLMDGRKERLGSRPIGRHPLPSPGQAENATARLPSIL

SEQ ID NO: 110896 - protein, 203 aa, Glycine max
  Coding DNA Sequence Number=SeqID_19211
  Homolog annotation: Hit_ID=Q2HW90; Match level="QueryCoverage=79%, HitCoverage=38%, E-value=2e-17, Identity=33%"; Hit description =Putative uncharacterized protein
MGSSQKPSLKKRFYQVKIKSLEVTSLGELGQLMGQLQRQAFRKAYGKIWDLARVEVSMEPIASLSQYYDQPLRCFTFEDFQLVPTVKEFKEILGCPLGGRKPYLFSGFYPSTTRVAKVVKISAQELDRANGLSFIDILALLIFGVVLFPNMEGLVDLAAIDAFLAFHHGKESPVVAILAMYDTFDRGCEKSGARIVCCAPTLG

SEQ ID NO: 110897 - protein, 234 aa, Glycine max
  Coding DNA Sequence Number=SeqID_19212
MNHSDKPKHFPTQPSDLHLLFPCSRHTESLLATLQCLAIRILAAAVARQSTFPERHELLREIRIVLARAEEEALAPVQQRHRQVRDRARFRSRRSFLSPEAVPYLASLVVERRRFYRRRGNADDVAGDREEVRGDVPEFGLAFGGGGGCGGGGADGGGVRDIDARVPEAVAELPNLKLQQVRKRNELTQLSQALPEIGGSSLRRGFVGGASFELFNDCFNFREATVVSHRVSVE

SEQ ID NO: 110898 - protein, 296 aa, Glycine max
  Coding DNA Sequence Number=SeqID_19213
  Gene Ontology: Mol. function=actin binding; Cellular component =integral to membrane; Biological process=actin cytoskeleton organization and biogenesis
  Homolog annotation: Hit_ID=A2Q5W8; Match level="QueryCoverage=89%, HitCoverage=26%, E-value=1e-110, Identity=78%"; Hit description =Actin-binding FH2
  Pfam annotation: Domain name=FH2; Domain location=1-241; Score=124.9; E_value=2.4e-34; Accession=PF02181.14; Description=Formin Homology 2 Domain
MAPSKEEESNFEFEVEYLRTSFQTLQTACEELRHCRMFMKLLEAVLKTGNRMNVGTNRGDAEAFKLDTLLKLVDVKGADGKTTLLHFVVQEIIQTEGACLSGTNQTPSSTLSGDAKCRRLGLQVVSSLSSELANVKKAAAMDSEVLSSDVLKLSKGIASLAEAVQLNQTMASDESSQKFTESMNKFIRMAEEEIPKIQAQESVASSHVKEITEYFLGNLTKEEAHPFRIFMVVRDFLAVLDRVCKEVGMINERTMVSSAHKFPVPVNPMLPQPLPGLHERQQYNDSSDDDSSSSSP

SEQ ID NO: 110899 - protein, 458 aa, Glycine max
  Coding DNA Sequence Number=SeqID_19214
  Gene Ontology: Mol. function=hydrolase activity; Cellular component =mitochondrion; Biological process=cell redox homeostasis
  Homolog annotation: Hit_ID=A2Q5W7; Match level="QueryCoverage=100%, HitCoverage=100%, E-value=0.0, Identity=86%"; Hit description =Phosphoglucomutase/phosphomannomutase C terminal; Thioesterase superfamily
  Subcellular localization annotation: CTP_CleavageSite=57; ConfidenceScore=5.19e-01
MDLNSSPSNNTIAVNGTIPVASTFAKATAPLENPPPANGSSNRKPIALWPGMYHSPVTTALWEARTKIFERLLDPPRDAPPQSELLTRTPSQSRTSILYNFSSDFVLREQYRDPWNEVRIGKLLEDLDALAGTISVKHCSDEASTTRPLIVVTASVDKIVLKKPISVNIDLKIVGSVIWVGHSSIEIQLEVTQSNEEGNDSDSVALTANFIFVARDSKTGKAAPVNRLSPETAHEKLLFVQAEARSNLRKRKREGEKRDFENGEKNRLQALLAEGRIFCDMPALADRDSILLKDTSLENALICQPQQRNIHGRIFGGFLMHRAFELAFSTAYAFAGLVPCFLEVDHVDFLRPERERGKGVLQVDVGDFLRLKSCVLYTEVHDPDQPLINVEVVAHVTRPELRSSEVSNTFHFTFTVRPEAKAMKNGFKLRNVVPATEEEAWRILERIDADNLNEFFRT

SEQ ID NO: 110900 - protein, 240 aa, Glycine max
  Coding DNA Sequence Number=SeqID_19215
  Gene Ontology: Mol. function=peptidyl-prolyl cis-trans isomerase activity; Biological process=protein folding
  Homolog annotation: Hit_ID=A2Q1W0; Match level="QueryCoverage=90%, HitCoverage=66%, E-value=1e-93, Identity=71%"; Hit description =Peptidyl-prolyl cis-trans isomerase, cyclophilin type
MGRRQNDSDFGRFAILVLFLIGAISCSVIYLFLTVVFSPSPESLPSVDDHVVGVAEEEQCCRGIEHLELWGDAVKWGSEFRLNSSEECCMACKRMCSGDGGPCMCNSWVYCGDREACGPRFGECWLKKQKDALNPDRRDSGDLVMWTSGFVFDKEEGTVGMETDHGILRIKLLPECAPYSVSYILELLALPHCVGCHIHRAESRGSFWDTEGNHIKKIRREITSRVVGCQVPNKEDIASD

SEQ ID NO: 110901 - protein, 253 aa, Glycine max
  Coding DNA Sequence Number=SeqID_19216
  Gene Ontology: Mol. function=3-deoxy-8-phosphooctulonate synthase activity; Cellular component=cytoplasm; Biological process =biosynthetic process
  Homolog annotation: Hit_ID=O50044; Match level="QueryCoverage=84%, HitCoverage=73%, E-value=1e-113, Identity=93%"; Hit description=2 -dehydro-3-deoxyphosphooctonate aldolase
  Pfam annotation: Domain name=DAHP_synth_1; Domain location=4-240; Score=223.4; E_value=5.1e-64; Accession=PF00793.11; Description=DAHP synthetase I family
MSSELEVASVYLTAGPRKILSMGQMSPLAVPKEKDTILILILEKVKIAYDIPIVTDVHESIQCEAVGRVADIIQIPAFLCRQTDLLVAAAKTGKIINIKKGQFCAPSVMTNSAEKVRLAGNPNVMVCERGTMFGYNDLIVDPRNLEWMREANCPIVADITHSLQQPAGKKLDGGGVASGGLRELIPCIARTAVAVGVDGIFMEVHDDPLKAPVDGPTQWPLRHFKELLEELVAIARISKGKQRFNIDLTPFRE

SEQ ID NO: 110902 - protein, 523 aa, Glycine max
  Coding DNA Sequence Number=SeqID_19217
  Gene Ontology: Mol. function=hydrogen ion transporting ATP synthase activity, rotational mechanism; Cellular component=proton -transporting two-sector ATPase complex; Biological process=energy coupled proton transport, ...
  Gene Ontology: Biological process=against electrochemical gradient
  Homolog annotation: Hit_ID=P11574; Match level="QueryCoverage=98%, HitCoverage=98%, E-value=0.0, Identity=90%"; Hit description =Vacuolar ATP synthase subunit B
  Pfam annotation: Domain name=ATP-synt_ab; Domain location=180-412; Score=317.4; E_value=2.6e-92; Accession=PF00006.16; Description=ATP synthase alphabeta family, nucleotide-binding domain
  Pfam annotation: Domain name=ATP-synt_ab_C; Domain location=429-523; Score=88.5; E_value=2.1e-23; Accession=PF00306.18; Description=ATP synthase alphabeta chain, C terminal domain
  Pfam annotation: Domain name=ATP-synt_ab_N; Domain location=24-84; Score=11.2; E_value=0.018; Accession=PF02874.14; Description=ATP synthase alphabeta family, beta-barrel domain
  Pfam module annotation: Pfam domain module=ATP-synt_ab::ATP-synt_ab _C::ATP-synt_ab_N; Domain location=180-412::429-523::24-84
MGVAQNIPDAEEGTLEIGMEYRTVSGVAGPLVILDKVKGPKFQEIVNIRLGDGTTRRGQVLEVDGEKAVVQDSAANGFVCLVLSSAVAIIANSGLVYLPYCTIHQVFEGTSGIDNKFTTVQFTGEVLKTPVSLDMLGRIFNGSGKPIDNGPPILPEAYLDISGSSINPSERTYPEEMIQTGISTIDVMNSIARGQKIPLFSAAGLPHNEIAAQICRQAGLVKRLEKSDNLLEGGGEEDNFAIVFAAMGVNMETAQFFKRDFEENGSMERVTLFLNLANDPTIERIITPRIALTTAEYLAYECGKHVLVILTDMSSYADALREVSAAREEVPGRRGYPGYMYTDLATIYERAGRIEGRKGSITQIPILTMPNDDITHPTPDLTGYITEGQIYIDRQLYNRQIYPPINVLPSLSRLMKSAIGEGMTRKDHSDVSNQLYANYAIGKDVQAMKAVVGEEALSSEDLLYLEFLEKFERKFVAQGAYDTRNIFQSLDLAWTLLRIFPRELLHRIPAKTLDQFYSRDAGN

SEQ ID NO: 110903 - protein, 52 aa, Glycine max
  Coding DNA Sequence Number=SeqID_19218
MDDQVTSLNELRVRRDNVLAEWVGCALSPLLSGSTSSRVLHLFSELAASLSE

SEQ ID NO: 110904 - protein, 109 aa, Glycine max
  Coding DNA Sequence Number=SeqID_19219
MIQVSSHAVGSPCINYPLSPVKPELSPSEILVSTLVPPLCTIFALTVPPFPRLDLRRKKDKYVMIQDGNESWIDEPNALEEYYIMGGEGAFPKLESGRFGIWEKALMCY

SEQ ID NO: 110905 - protein, 113 aa, Glycine max
  Coding DNA Sequence Number=SeqID_19220
  Gene Ontology: Mol. function=protein-tyrosine kinase activity; Biological process=protein amino acid phosphorylation
  Homolog annotation: Hit_ID=A7QIG5; Match level="QueryCoverage=100%, HitCoverage=12%, E-value=3e-23, Identity=48%"; Hit description =Chromosome chr12 scaffold_103, whole genome shotgun sequence
MEVTEKYDVFSFGVICLEIIMGKHPGDLISSLLSSSSATITDNLLLIDVLDQRPPQPLNSVIGDIILVASLAFSCLSENPSSRPTMDQVSKNLMMGKSPLADQFPMIRLGQLL

SEQ ID NO: 110906 - protein, 282 aa, Glycine max
  Coding DNA Sequence Number=SeqID_19221
  Gene Ontology: Mol. function=protein-tyrosine kinase activity; Cellular component=intracellular; Biological process=protein amino acid phosphorylation
  Homolog annotation: Hit_ID=A7QIG5; Match level="QueryCoverage=62%, HitCoverage=22%, E-value=3e-39, Identity=45%"; Hit description =Chromosome chr12 scaffold_103, whole genome shotgun sequence
  Pfam annotation: Domain name=Pkinase; Domain location=11-260; Score= -101.1; E_value=0.015; Accession=PF00069.16; Description=Protein kinase domain
  Pfam annotation: Domain name=Pkinase_Tyr; Domain location=67-259; Score=-167.7; E_value=0.038; Accession=PF07714.8; Description =Protein tyrosine kinase
  Pfam module annotation: Pfam domain module=Pkinase::Pkinase_Tyr; Domain location=11-260::67-259
MKKAKKERTSLKSDMIRSKGNEGTYYSGFISKEESGDWGFAGDRSGVGASPWISGESHARRNRKTASLASLAHSSPQFACLSKTISLASAASIVTARDQAAAEKGGSLNQILRNDTEAAAFDWEKRVNVVKAHVSDFWTVKILKPGSHTWTEFAGTFGYAAPELAQTMEVTEKCDVFSFGVLSLEVIMGKHPGNFISSLLSSPSAKIAYNWPLIDVLDERPPQPPKKSIVGDAILVASLAVSCLSETPSSRPTMEVSKMLMTGKSPLADQFPMIRLGQLLYH

SEQ ID NO: 110907 - protein, 97 aa, Glycine max
  Coding DNA Sequence Number=SeqID_19222
MVSERGIGREIYRCEKEALRMGMVHNCIYRIEWVAFMMSASLHRDRIRKCVRDAYRENLIDLRYVEPFLYGHVCKTSSLVALRKFMANVSHRIYIIF

SEQ ID NO: 110908 - protein, 417 aa, Glycine max
  Coding DNA Sequence Number=SeqID_19223
  Gene Ontology: Mol. function=triacylglycerol lipase activity; Cellular component=chloroplast stroma; Biological process=lipid metabolic process
  Homolog annotation: Hit_ID=A4ZX88; Match level="QueryCoverage=80%, HitCoverage=74%, E-value=1e-114, Identity=63%"; Hit description =Phospholipase A1
  Pfam annotation: Domain name=Lipase_3; Domain location=202-360; Score= 174.8; E_value=2.3e-49; Accession=PF01764.16; Description=Lipase (class 3)
  Subcellular localization annotation: CTP_CleavageSite=23; ConfidenceScore=5.60e-01
MKLTIKTPHPLPSPQSNTLLKPRCITTTTQTSKPTSNKNLHMSNDTRQAALRLEKMINLEEEHNTNNYFPSMQSSKLGKRWKEYHGMSNWEGLLDPLDDNLRAEILRYGHFVETAYKSFEFDPSSPNFANSRFPKKALLERCGLPKTRYKVTKYLRATSGIQLPSWVDKVPRWVAKQTSYVGYVAVCHDKEEIKRLGRRDVVVAYRGTTTCLEWLENFRASLTNLPIPCSSKRAFEKNGVMDGSGAMVESGFLSLYTSSLPAKVSLQEMVRREISRILDTYRGEQLSLTVTGHSLGAALATLTAYDVKTAFPELPVTVISFGGPRVGDRRFRRQLERQGTKVLRIVNSDDVITKLPGFVFDDDVASAGGVHVAGFPSWIQKRVEEAQLVYAEVGRNYGYVAGILRTLETRMLPRVTS

SEQ ID NO: 110909 - protein, 766 aa, Glycine max
  Coding DNA Sequence Number=SeqID_19224
  Gene Ontology: Mol. function=protein serine/threonine kinase activity; Cellular component=cytoplasm; Biological process=protein amino acid phosphorylation
  Homolog annotation: Hit_ID=A9PEX5; Match level="QueryCoverage=100%, HitCoverage=100%, E-value=0.0, Identity=70%"; Hit description =Putative uncharacterized protein
  Pfam annotation: Domain name=Pkinase; Domain location=365-697; Score =231.6; E_value=1.8e-66; Accession=PF00069.16; Description=Protein kinase domain
  Pfam annotation: Domain name=Pkinase_Tyr; Domain location=365-691; Score=-34.1; E_value=2.6e-10; Accession=PF07714.8; Description =Protein tyrosine kinase
  Pfam module annotation: Pfam domain module=Pkinase::Pkinase_Tyr; Domain location=365-697::365-691
MERVAEPKVLPRSLPVLVEVSNAHTDAIREAGQRLNGQDVSSVRGIPGREGNQFLKARDGPMKRLASIREVAQLSNARIVLVREDMGFDTRCQEPPSPAPTRMWKGKGSLPEAVELVPDIEKLKGGNDSFVETGPSSFAGASHPPEPVDTDLMRTVFVPIGQTKSEAGCLLKSVSLKGPFLEDLSIHVPAKKPSLAVVSPAESMVEESNEMGNLSSPFLGARASQNTENSPLAPDSEEKECVWDASLPPSGNVSPHSSIDSTSVVRTMSIANSCASTYRSDAVTSDGMLSLDRNCDSTKGSVRGDSLESAKTSASRASDSSGLSDDSNWSNITGSANKPHKGNDPRWKAILAIRTRDGILGMSHFRLLKRLGCGDIGSVYLSELSATRCFFAMKVMDKASLASRNKLTRAQTEREILQLLDHPFLPTLYTHFETDRFCCLVMEYCPGGDLHTLRQRQPGKHFSEYAARFYAAEVLLALEYLHMLGVVYRDLKPENVLVRDDGHIMLSDFDLSLRCAVSPTLIRNFDSDPSKRGGGAFCVQPACIEPSSVCIQPSCFMPRLFAQKNKKSRTPKAEPGMPSSTLPELVAEPTTARSMSFVGTHEYLAPEIIKGEGHGSAVDWWTFGIFLHELLYGKTPFKGSGNRATLFNVVGQQLRFPESPATSYASRDLIRGLLVKEPQHRLGVKRGATEIKQHPFFEGVNWALIRCSTPPEVPRPVECDLPAKFEPVDTVGVGNINNSNNSSKRMVGNNNTDMKSGGKYLDFEFF

SEQ ID NO: 110910 - protein, 45 aa, Glycine max
  Coding DNA Sequence Number=SeqID_19225
MGTGVWLCDVDGGWRWDMPQFECVVVVGFGKKLDMGYVLIRDEFT

SEQ ID NO: 110911 - protein, 112 aa, Glycine max
  Coding DNA Sequence Number=SeqID_19226
  Gene Ontology: Mol. function=protein binding; Cellular component =signalosome; Biological process=red or far red light signaling pathway
  Homolog annotation: Hit_ID=A7PKB3; Match level="QueryCoverage=61%, HitCoverage=26%, E-value=6e-18, Identity=65%"; Hit description =Chromosome chr15 scaffold_19, whole genome shotgun sequence
  Subcellular localization annotation: CTP_CleavageSite=13; ConfidenceScore=5.12e-01
MEQLVKQASASPNANALTSVLVEATSHLNLFAFSQFLALPNLLQLQVTENSVYLDMLRLFAHGTWSDYKIATIVVVMTTVAITTIANDGHANSSSDNSDGDDDHANGGGDSH

SEQ ID NO: 110912 - protein, 40 aa, Glycine max
  Coding DNA Sequence Number=SeqID_19227
MWGAAFSVRMLTRKRKGFEEVHLLASRDMLGSIIIASSWR

SEQ ID NO: 110913 - protein, 374 aa, Glycine max
  Coding DNA Sequence Number=SeqID_19228
  Gene Ontology: Mol. function=protein-tyrosine kinase activity; Cellular component=intracellular; Biological process=protein amino acid phosphorylation
  Homolog annotation: Hit_ID=A7Q7J1; Match level="QueryCoverage=96%, HitCoverage=69%, E-value=4e-72, Identity=40%"; Hit description =Chromosome undetermined scaffold_60, whole genome shotgun sequence
  Pfam annotation: Domain name=Pkinase; Domain location=182-373; Score=- 21.3; E_value=2.4e-07; Accession=PF00069.16; Description=Protein kinase domain
  Pfam annotation: Domain name=Pkinase_Tyr; Domain location=182-374; Score=-104.4; E_value=5.1e-06; Accession=PF07714.8; Description =Protein tyrosine kinase
  Pfam module annotation: Pfam domain module=Pkinase::Pkinase_Tyr; Domain location=182-373::182-374
MAGSLTLWTRRDYFNSLHGTLPISIRMVDMTNNIISGEIPPELGYLSSLKLTNNHSPLPLPGIDVDFSYNNLKGPIPDGFPASSLIGNKDVCSDNWYIQTGLKFQPCPAHDHIVLGNLLVIVLPVLISLIMAFLLCLRHIFLETKNKDTKATATTKNGDLFSIWNYDGSIAYEDIIRAIEDFDMKYCIGTGAYGSVYKAQLPSGKVVAVKKLHGFEAEVPAFDESFRNEYMEKGSLFSVLFDDVEAMELDWKKRPSVGDFGTARFLSLDSSNRTIVAGTIGYIAPELAYTMVVSEKCDVYSFGVVALETLMGSHPKELLSSLQSASTDNGITLCEILDQRLPQPTMSVLLDIVRVAIVAFACLNPNPSSRPTMK

SEQ ID NO: 110914 - protein, 191 aa, Glycine max
  Coding DNA Sequence Number=SeqID_19229
  Homolog annotation: Hit_ID=A7PML4; Match level="QueryCoverage=99%, HitCoverage=63%, E-value=3e-48, Identity=51%"; Hit description =Chromosome chr14 scaffold_21, whole genome shotgun sequence
  Pfam annotation: Domain name=DUF569; Domain location=1-42; Score= -47.8; E_value=0.017; Accession=PF04601.4; Description=Protein of unknown function (DUF569)
TQIRLKTCHGQYLRANGGLPPWRNSITHDIPHRTSTSNWVLWEVDLVELRPNPPNPIENTTPIATPNPSMDSTELDSPTYSDDVSFNIDLKSSKVPIENEDLKENESPKKDGRVIFYNIGDENGDVPSANEEKFFTFKGSSVEDLKEKLKEETGHDDILVCCRNPLNAKLYPLRLQLPPNNTDIHVVVTPS

SEQ ID NO: 110915 - protein, 196 aa, Glycine max
  Coding DNA Sequence Number=SeqID_19230
  Gene Ontology: Mol. function=pectate lyase activity
  Homolog annotation: Hit_ID=Q40319; Match level="QueryCoverage=100%, HitCoverage=100%, E-value=5e-29, Identity=56%"; Hit description =Pectate lyase homolog
  Pfam annotation: Domain name=Pec_lyase_N; Domain location=26-79; Score=79.1; E_value=1.4e-20; Accession=PF04431.4; Description =Pectate lyase, N terminus
MARSANKVTFIFLVAFAITIPCLEAGIAEFDDFLKAQASEAQVIALKSYQPDPINVTAEFNIHVHRALMEEENDTRRELKQKYHGPCMATNPIDSCWRCRKHWAQDRFRETGSSRPTTTLQRKSHRHYASPEVWSKWQWKSENDLFINGATFLQSGAPLGKLPFNKGLMMKPRPGAEASRLTRFAGTLNCKLGKPC

SEQ ID NO: 110916 - protein, 184 aa, Glycine max
  Coding DNA Sequence Number=SeqID_19231
  Gene Ontology: Mol. function=protein binding; Cellular component =integral to membrane; Biological process=protein amino acid phosphorylation
  Homolog annotation: Hit_ID=A2Q5T8; Match level="QueryCoverage=93%, HitCoverage=28%, E-value=1e-35, Identity=50%"; Hit description =Leucine-rich repeat; Leucine-rich repeat, cysteine-containing type
  Pfam annotation: Domain name=LRR_1; Domain location=13-32; Score=4.2; E_value=52; Accession=PF00560.24; Description=Leucine Rich Repeat
  Pfam annotation: Domain name=LRR_1; Domain location=37-59; Score =10.2; E_value=4; Accession=PF00560.24; Description=Leucine Rich Repeat
  Pfam annotation: Domain name=LRR_1; Domain location=69-91; Score =15.4; E_value=0.22; Accession=PF00560.24; Description=Leucine Rich Repeat
  Pfam annotation: Domain name=LRR_1; Domain location=93-114; Score =6.7; E_value=17; Accession=PF00560.24; Description=Leucine Rich Repeat
  Pfam module annotation: Pfam domain module=LRR_1::LRR_1::LRR_1::LRR _1; Domain location=13-32::37-59::69-91::93-114
MVPSCLGNHSSQFLQFLVLKGNQLIGPIPQTYTITNALRIIDLSNNNLPGQLPRALVNCRMLEVFELSNLQALDLSLNSLSGKIPQQLEELTFLSYLNVSLNNLSGPIPQNKQFATFEGCSFEGNQGLCGNQLFKKCEDDAGSPFAPPSATEDDHDSGFYIEFDWTVVLIGYGVDFDNAKFRFN

SEQ ID NO: 110917 - protein, 315 aa, Glycine max
  Coding DNA Sequence Number=SeqID_19232
  Gene Ontology: Mol. function=hydrogen ion transporting ATPase activity, rotational mechanism; Cellular component=proton -transporting two-sector ATPase complex; Biological process=proton transport
  Homolog annotation: Hit_ID=Q9LJI5; Match level="QueryCoverage=92%, HitCoverage=82%, E-value=1e-161, Identity=94%"; Hit description =Probable vacuolar proton pump subunit d 1
  Pfam annotation: Domain name=vATP-synt_AC39; Domain location=3-312; Score=307.9; E_value=1.9e-89; Accession=PF01992.7; Description=ATP synthase (CAC39) subunit
MGLGLAEGLIPTTWETEVRIPVWREPSPLHTTTIVEKCTLKLVDDYKNMLCQATEPLSTFLEYITYGHMIDNVVLIVTGTLHERDVQELLEKCHPLGMFDSIATLAVAQNMRELYRLVLVDTPLAPYFSECITSEDLDDMNIEIMRNTLYKAYLEDFYRFCQKLGGATAEIMSDLLAFEADRRAVNITINSIGTELTRDDRRKLYSNFGLLYPYGHEELAVCEDIDQVRAVMEKYPPYQSIFAKLSYGESQMLDKAFYEEEVKRLCLAFEQQFHYAVFFAYMRLREQEIRNLMWISECVAQNQKSRVHDSVVFIF

SEQ ID NO: 110918 - protein, 125 aa, Glycine max
  Coding DNA Sequence Number=SeqID_19233
  Gene Ontology: Mol. function=protein disulfide oxidoreductase activity; Cellular component=cytoplasm; Biological process=cell redox homeostasis
  Homolog annotation: Hit_ID=A2Q2R1; Match level="QueryCoverage=97%, HitCoverage=98%, E-value=2e-37, Identity=59%"; Hit description =Thioredoxin domain 2; Thioredoxin fold
  Pfam annotation: Domain name=AhpC-TSA; Domain location=13-107; Score=- 22.5; E_value=0.077; Accession=PF00578.12; Description=AhpCTSA family
  Pfam annotation: Domain name=Thioredoxin; Domain location=20-122; Score=114.2; E_value=3.9e-31; Accession=PF00085.11; Description =Thioredoxin
  Pfam module annotation: Pfam domain module=AhpC-TSA::Thioredoxin; Domain location=13-107::20-122
MGSYFSSISATVVEAENPHVRAFHSAESWQTHFKQIKDSPKLLHFTVSWCPPCKFIAPLFNEMAAMFTDAEFIKIDVDELSDVAKEFKVEAMPTFVLWKKGKEVDRVVGAEKDELKNKIEKHYQL

SEQ ID NO: 110919 - protein, 1410 aa, Glycine max
  Coding DNA Sequence Number=SeqID_19234
  Gene Ontology: Mol. function=sequence-specific DNA binding; Cellular component=nucleus; Biological process=electron transport
  Homolog annotation: Hit_ID=A2Q5S2; Match level="QueryCoverage=64%, HitCoverage=94%, E-value=0.0, Identity=64%"; Hit description =Quinonprotein alcohol dehydrogenase-like
  Pfam annotation: Domain name=PQQ; Domain location=1008-1042; Score =1.7; E_value=9.7; Accession=PF01011.12; Description=PQQ enzyme repeat
  Pfam annotation: Domain name=PQQ; Domain location=1047-1086; Score =27.6; E_value=4.6e-05; Accession=PF01011.12; Description=PQQ enzyme repeat
  Pfam annotation: Domain name=PQQ; Domain location=1197-1229; Score =6.1; E_value=2.4; Accession=PF01011.12; Description=PQQ enzyme repeat
  Pfam annotation: Domain name=PQQ; Domain location=1307-1346; Score =27.6; E_value=4.7e-05; Accession=PF01011.12; Description=PQQ enzyme repeat
  Pfam annotation: Domain name=PQQ; Domain location=526-563; Score =11.2; E_value=0.47; Accession=PF01011.12; Description=PQQ enzyme repeat
  Pfam annotation: Domain name=PQQ; Domain location=667-704; Score =18.0; E_value=0.036; Accession=PF01011.12; Description=PQQ enzyme repeat
  Pfam annotation: Domain name=PQQ; Domain location=724-762; Score =12.6; E_value=0.31; Accession=PF01011.12; Description=PQQ enzyme repeat
  Pfam annotation: Domain name=PQQ; Domain location=876-908; Score =12.9; E_value=0.28; Accession=PF01011.12; Description=PQQ enzyme repeat
  Pfam annotation: Domain name=PQQ; Domain location=943-980; Score =24.1; E_value=0.00052; Accession=PF01011.12; Description=PQQ enzyme repeat
  Pfam annotation: Domain name=WRKY; Domain location=161-221; Score =130.1; E_value=6.2e-36; Accession=PF03106.6; Description=WRKY DNA -binding domain
  Pfam module annotation: Pfam domain module=PQQ::PQQ::PQQ::PQQ::PQQ::PQ Q::PQQ::PQQ::PQQ::WRKY; Domain location=1008-1042::1047-1086::1197 -1229::1307-1346::526-563::667-704::724-762::876-908::943-980::161-221
MGEVKEENERLKMMLERVEKDYHSLQLRFFDIHHEDVSKKGLADSSTCHDHETEELVSLCLGRSPMVPKKEARIGNSNKLKEDVGPNLTLGLDSKHLLSMEVVSDFSPMNSSEQPKEAEEEVTLSTNQSAKVINVNDDMSDQMPAKRARVSVRARCDTPTMNDGCQWRKYGQKIAKRNPCPRAYYRCTVAPTCPVRRQVQRCAEDLSILITTYEGTHNHPLPVSATAMASTTSAAASMLLSGSSTSHHPTNHNSASFGNAPTTLQSGLSFSHQFDESRTKQVFSPPNHASLHMFPTITLDMTYSASNSSSLTQFHHRLPSTMASISNLKFSPASLSCSQDNNFIPSIWSKGGDTTTPPIIDKIPTRPVIKGNPYFQENFYQQSITNQTPFKEALAETITKAISTDPSLRSVIAAAVSSIVGNGSNSGNQEGAENVLGSGLNLKLGDHLQLASSNPLNQNGKGCLTGYFKSLGQQSQDWLNQGGDLYSRRYAYKERKINPETAPNLRLKWKFNAGKDITATPAIYNGTLYFPSWNGNIYAVKEGNGSLVSKQDLQNLTGLNATGFVRSQFYDPSVVIAVKRTSGELVRKTTLDNHPAALITVWDILHRDIFTSTEKTENWLNHGGNIYNRRYASMEHKISVETVSNLSLKWKFYAGKDITATPAIFDGTLYFPCWNGDIFAVRAKDGSLVWKQNLGNLTGLSATGFVAGVNWTVARATPTIAEVDLLIFGIYGPAVVIAVKRSTGDLVWQTPLDSHNSSVVTMSGTYYKGAYYVGASSLEELTTEECCTFRGSFSKLDIQSGVILWQTFMLPDNHGQRGEYAGAAVWGSSPSIDASRNHIYIATGNLYSAPLDILECQERENNVTQPTHPDECVEPDNHSDSILALDLDDGKIKWYRQLGGYDVWFLSCNNLSTPNCPPGPNPDADFGEAPMMLTIDVNGTKQDTVVAVQKSGFAWALHRDNGNLIWSTEAGPGGLAGGGTWGAATDKERVYTNIANSDGQNFTLKPSNKTTTSGGWVAMEASSGKILWSIANPSNATANGPVTVANGVVFAGSTNQKGPIYAINGKTGKIEWSYETGSTVYGGMSVSDGAYYVGTSSQEEGLPPEERCTFRGSFSKLNIQAGGILWQTYMIPDNHGQKGEYSGAAVWRISPPIDASRNHIYIATGNLYTAPFDILECQERENNVTQPTHPDECVESDNHSNSIVALDLDDGSIKWYHPLGGFGTNDAHNSCQWNKMLLLCRRVVLLGLCTVTTTSSFGLRSLLDHPTRLQLVEGGWQWKHVVERSCGTQLTLASNAKANGPITVANDIVFVGSTNQKGPIYAINGKTGKIEWSYETGSTVYGDMPVSDGCIYLGNGYKIGNGVFLGNVFAGTSLFALCLSKILWIVDTTDTDDRTTDTGVQLADVKQAET

SEQ ID NO: 110920 - protein, 471 aa, Glycine max
  Coding DNA Sequence Number=SeqID_19235
  Homolog annotation: Hit_ID=A7PJ55; Match level="QueryCoverage=98%, HitCoverage=98%, E-value=1e-157, Identity=56%"; Hit description =Chromosome chr12 scaffold_18, whole genome shotgun sequence
  Pfam annotation: Domain name=AATase; Domain location=5-459; Score= -218.7; E_value=0.068; Accession=PF07247.3; Description=Alcohol acetyltransferase
  Pfam annotation: Domain name=DUF1298; Domain location=308-461; Score=- 7.9; E_value=6.5e-09; Accession=PF06974.4; Description=Protein of unknown function (DUF1298)
  Pfam annotation: Domain name=UPF0089; Domain location=12-260; Score= -66.4; E_value=1.7e-05; Accession=PF03007.7; Description =Uncharacterised protein family (UPF0089)
  Pfam module annotation: Pfam domain module=AATase::DUF1298::UPF0089; Domain location=5-459::308-461::12-260
MEHQKEEQLEPVSPVGQYFNSSVLCIYIIGVLEFEVPIDDLQTYALLKDVFLPINPRFSSIMVQDKDGEKRWKQVDVNLTDHVNIPTFPEGKTAESYDKYFHDYLSSIAMEQLPQSRPLWDIHIINYLTSDASSTIIFKLHHALGDGYSLMGALLSCLQRADDPSLPLSFPSLKQSKQEPSSTKSFCRKFSWMCSSAFNTVSDFGWSVLKSSIISDDKTPIRFGDEGADYQPISISSMTFSIDHIRDIKSRLGVTINDVVTGIVFYGTRLYMQDMDSKSKTAHSTALVLLNTRNVEGYQSINDMLNTKATGPWGNRITFLHVPIPKLNETRTTNPLEFIWDTHNIIKRKKQSLGVVLTGTLLKIEGKLRGQEAVAKRIRGTLTKSSAVISNLAGPIQQMALANHPVKGLYFTLAGGPESLVISVMSYMGVLSVTLKTEKDFIDEHKLKLCMQSAFEIILQAAMEIPQETKP

SEQ ID NO: 110921 - protein, 26 aa, Glycine max
  Coding DNA Sequence Number=SeqID_19236
MVNRFEAMGMMLKWCSIIVVVGLFKV

SEQ ID NO: 110922 - protein, 82 aa, Glycine max
  Coding DNA Sequence Number=SeqID_19237
MKKRLVFDLGSPKPGWVREKFDDNPHFRYYEITPPTTTMASVEMMPHGCHGDCGGEGGEEEAVFEGTRAFNGGGYDSQIEKL

SEQ ID NO: 110923 - protein, 103 aa, Glycine max
  Coding DNA Sequence Number=SeqID_19238
  Gene Ontology: Mol. function=metal ion binding; Cellular component =nucleus; Biological process=response to brassinosteroid stimulus
  Homolog annotation: Hit_ID=A7PMV9; Match level="QueryCoverage=83%, HitCoverage=92%, E-value=1e-20, Identity=55%"; Hit description =Chromosome chr14 scaffold_21, whole genome shotgun sequence
  Pfam annotation: Domain name=ZF-HD_dimer; Domain location=29-88; Score=93.3; E_value=7.5e-25; Accession=PF04770.3; Description=ZF-HD protein dimerisation region
NRAYLMRRVKILRRDGSRRCSNNSPVTIVRQVKYGKCCRNLACRIGGHVVDGCTEFVASGAEGTREAMTCATCGCHRNFHMKEEITQVLCACSSHPTTRTVGD

SEQ ID NO: 110924 - protein, 427 aa, Glycine max
  Coding DNA Sequence Number=SeqID_19239
  Gene Ontology: Mol. function=L-isoleucine transmembrane transporter activity; Cellular component=integral to membrane; Biological process=amino acid transport
  Homolog annotation: Hit_ID=Q2HUS3; Match level="QueryCoverage=97%, HitCoverage=97%, E-value=1e-164, Identity=70%"; Hit description =Amino acid/polyamine transporter II
  Pfam annotation: Domain name=Aa_trans; Domain location=37-421; Score =152.5; E_value=1.2e-42; Accession=PF01490.9; Description =Transmembrane amino acid transporter protein
  Pfam annotation: Domain name=Trp_Tyr_perm; Domain location=43-415; Score=-277.6; E_value=0.059; Accession=PF03222.4; Description =Tryptophantyrosine permease family
  Pfam module annotation: Pfam domain module=Aa_trans::Trp_Tyr_perm; Domain location=37-421::43-415
MSEELSCKSSLDVPLLPQWNHHEEKANIASHHSTKNTTVSLFRTCLNGLNAISGVGILSVPYALASGGWLSLGLLFAIATAAFYTGTLMKRCMDKNSNIKTYPDIGELAFGKTGRLIISVSMYMELYLVSAGFLILEGDNLSNLFPIGEIQIAGLAIGGKQLLVILVTFIILPTVWLDNLSMLSYVSASGVFASAFIILSISWTATFDGVGFHQKGTLVNWNGIPTAVSLYAFCYCAHPVFPTLYNSMTNKHQFSYVLFACFLLTTVGYASMAIIGYLMYGSHVESQVTLNLPLDKVSSKLAIYTTLVNPISKFALMVTPITDALKDLLPSTYRNRVTSILGSTVLVMSTAIVALTVPFFGDLMSLVGAFLSITASILLPCLCYLQISGTYKKYGYEVVAIVAIIIAGIVMGISGTYTSIMDIVHHG

SEQ ID NO: 110925 - protein, 1793 aa, Glycine max
  Coding DNA Sequence Number=SeqID_19240
  Gene Ontology: Mol. function=calcium ion binding; Cellular component =mitochondrion; Biological process=multicellular organismal development
  Homolog annotation: Hit_ID=A7QAX6; Match level="QueryCoverage=33%, HitCoverage=90%, E-value=0.0, Identity=57%"; Hit description =Chromosome chr5 scaffold_72, whole genome shotgun sequence
  Pfam annotation: Domain name=LETM1; Domain location=183-405; Score =326.9; E_value=3.7e-95; Accession=PF07766.4; Description=LETM1-like protein
  Pfam annotation: Domain name=Rad21_Rec8_N; Domain location=715-805; Score=75.3; E_value=2e-19; Accession=PF04825.4; Description=N terminus of Rad21  Rec8 like protein
  Pfam module annotation: Pfam domain module=LETM1::Rad21_Rec8_N; Domain location=183-405::715-805
MASRVILQKRRSLFFNPLCSLPTRIIFGFSSVGHAQPLESSELEDDLAAYAASRFISHSSFRVSSFGFISDKIELVYLSRLGWLSRCSRNISTASADQSGLTSSYKGSEQSATIQKKEASPEECDEAVEGLSNIKAKAKAKQMQEPKKSADSILRKLWTRILGIGPAFRTIMSMSRDDWAKKFHHWWDEFKSTLQHYWFGTKLLWADIRISSRLLLKLAGGKSLSRRERQQLTRTTADIFRLVPFAVFIIVPFMELLLPVFLKLFPNMLPSTFQDKMKEQEALKRRLNARIEYAKFLQDTVKEMAKEIQNSQSGEMKKTAEDLDEFMNKVGASTIATSCALQIKNDDKLIQVEGVESLSEAELRQACRDRGLLGLLSVEEMQQQLRDWLDLSLNHSVPSSLLILSRAFSVSGKVRPEEAVQATLSSLPDEVVDTVGVTTLPSEDSVSERKRKLEYLEMQEELIKEEEKKEETEQAKMVESVVGSEERASRTKQIQGESVSRERQEFLRLVRKEMELYDSMVGKEGTEDEQEAKKAYKAARKESDGAIEVAIGDKVSSALVDRVDTMLQTLEKEIDDVDAKIGDRWRLLDRDYDGKVTPEEVVSAAMYLKDTLGKEGIHEFISNLSKDSDGKILVEDIAKLGAQKEEADRDELCSTHSAFFRSNDAVLVSFSFVSFPDADSLLAFVSHAIVGGVVLRLLTEEWGICEVKRDVLLSVYFGQERATWDYMDSCAFGEEAPQEPGGGYRHWRLRSHLLLGVVRIYSRKVNYLFDDCSEALLKIKQAFRSTAVDLPPEESTAPYHSITLPETFDLDDFELPDNDILQGNYVDHHVSTREQITLQDSMEGVIYTTSQFGLDERFGDGDASQIGLDLDEVLLNDKAATSEHDGFGANIQMSHQNDEKKQEIDDLPTAAELSEYAEGPSTPGLEEPNLFGTQMDQGNNEVDYHNSADLISLEAAPKESSDHQRENDVINCSLQNNGNHISFDLHHEDNACDLVEMNSKKEEQEHLACQVVMKDQENLIPNDHCLTLLPLVDSSNKDYTECEGGMINASDVAEKEDLQDGVLMNNDPVSAALDQTITNCVVSAPLMNNENVASSGCSHVTSDQEDLSCKPLSNMDGSWGPGFDGRLEDGNTLSKHEVLNGIEISKSEGQFCPFDDARVSNVISPLRSPGRPEVVDEEAQASQELKEAETLNHVSLEAVQPAESILQPCTSHLGQPSRSFIEDFSISFRLNTPRNCSLRTPPKPFGIFPITKSSEHAGSSKGEKCHVTDVSNPALSYQGTIEPSVFKETPDSGKTDMQLESQIFSDKVESINKSAAADMPEPEKLLSAYQHDGEANHLLMASTPDNQGATEGHTGAAGVKCISGKKRSYTESTLTVQSMDLIESYGGAQSKRTAESVPDDDDLLSSILVGRKSSVLKMKPSPAAPEIASMKCVRSASAPRTSALKRKVHMDDMMVLHGETDTEIDGVEGNNEPMAVQLQENAEVQPTEVVEGNNEPMAVQPQEDAEVQPTEVPVLSESHQSEVNLGSRDIDAHGHMDIISHVEELDSSQNVELNNVRANIEVSEAGNCSVGPGHESSSLTEVFKNDFAASLSRVDKTNDLVDSIHTNILSIPNAENLNTIPILEDDFVEDQSDKNGVGAIECSMETGTQVQTDGLEANDLYASLAIGSKETDEFTDIQASFNGDLPLEENRNNLLGQLNEDQIVASGMECDGKDARSDCIFIENAKVDCLQSEALGLDEKESSLKDAEIPVCQEAGLQITMCPEIRSPFVDQNDESKLNFESGVLHTSFFALS

SEQ ID NO: 110926 - protein, 704 aa, Glycine max
  Coding DNA Sequence Number=SeqID_19241
  Gene Ontology: Mol. function=transcription factor activity; Cellular component=nucleus; Biological process=regulation of transcription, DNA-dependent
  Homolog annotation: Hit_ID=Q5EER4; Match level="QueryCoverage=99%, HitCoverage=100%, E-value=0.0, Identity=58%"; Hit description =AP2/EREBP transcription factor BABY BOOM
  Pfam annotation: Domain name=AP2; Domain location=265-322; Score =44.0; E_value=5.3e-10; Accession=PF00847.11; Description=AP2 domain
  Pfam annotation: Domain name=AP2; Domain location=364-416; Score =60.4; E_value=6.2e-15; Accession=PF00847.11; Description=AP2 domain
  Pfam module annotation: Pfam domain module=AP2::AP2; Domain location =265-322::364-416
MGSMNLLGFSLSPHEEHPSSQDHSQTTPSRFSFNPDGSISSTDVAGGCFDLTSDSTPHLLNLPSYGIYEAFHRNNSINTTQDWKENYNSQNLLLGTSCNKQNMNQNQQQQPKLENFLGGHSFGEHEQTYGGNSASTDYMFPAQPVSAGGGGSGGGSNNNNNSNSIGLSMIKTWLRNQPPNSENINNNNESGGNIRSSVQQTLSLSMSTGSQSSTSLPLLTASVDNGESSSDNKQPNTSAALDSTQTGAIETAPRKSIDTFGQRTSIYRGVTRHRWTGRYEAHLWDNSCRREGQTRKGRQGGYDKEEKAARAYDLAALKYWGTTTTTNFPISHYEKELEEMKHMTRQEYVASLRRKSSGFSRGASIYRGVTRHHQHGRWQARIGRVAGNKDLYLGTFSTQEEAAEAYDVAAIKFRGLSAVTNFDMSRYDVKSILESTTLPIGGAAKRLKDMEQVELSVDNGHRADQVDHSIIMSSHLTQGINNNYAGGGTATHHNWHNAHAFHQPQPCTTMHYPYGQRINWCKQEQQDNSDAPHSLSYSDIHQLQLGNNGTHNFFHTNSGLHPMLSMDSASIDNSSSSNSVVYDGYGGGGGYNVMPMGTTTAVVASDGDQNPRSNHGFGDNEIKALGYESVYGSATDSYHAHARNLYYLTQQQSSSVDTVKASAYDQGSACNTWVPTAIPTHAPRSTTSMALCHGATTPFSLLHE

SEQ ID NO: 110927 - protein, 844 aa, Glycine max
  Coding DNA Sequence Number=SeqID_19242
  Homolog annotation: Hit_ID=A7R290; Match level="QueryCoverage=91%, HitCoverage=92%, E-value=0.0, Identity=48%"; Hit description =Chromosome undetermined scaffold_409, whole genome shotgun sequence
  Pfam annotation: Domain name=TolA; Domain location=74-461; Score= -151.9; E_value=0.067; Accession=PF06519.2; Description=TolA protein
  Subcellular localization annotation: CTP_CleavageSite=50; ConfidenceScore=5.04e-01
MAAPTEIIDVDAENSPTPTTISPQDSKSNRAKTTTRKRKKVPSVLQSLKSAEEKQAHIETLEKELDALFRYYKEAMAQKVRVELSLCGGSRNVVVAALMEESDLPLSKLVDEINDKLNGEVSNGAIVLAEPVTYATVKSSVLFVGQRVTYGVSNADADVLEDHAESCLWCWETRDLKLMPKSVRGELGVRRTCRRRIHERIMAVSEMIAALKKQESQPDYNDGLIKASAKVNKAFPEADIRLLVDGLLQKNSEDMDKKRASQENKLLIKQLERNRKEAEKEKEKESMHNELQRETLLNESNLKLSQDEARNDEKASEKKKQQKKQVDEAEKDQRRKEKAEAELKKKRSLQKQASIMERFLKRSKNSPSPSEKDKVSTKSTASDLLRCKNKSLFESATLSMDCTLASSSDVMLEDIRKTHFSSWRSLGQLIRLNRKQRWGLRQKPRTKVFKELKLSAIKTAVHDVELDMEKHVNRLGECSSDISSCPMNEDSSPPDTKKYSRGRQLLQFDKSHRPAFYGVWPAKSHVVGARHPLRKDPSLDYEVSSDEEWEEEEPGESLSDCDKDEEECQEECTKSDEESEDGFFVPDGYLSEDEGAQVDRMQIDDDIEGADSSPSCKNDIEIEEFCALLRQQKYLNNLTEHALRKNQPLIISNLINDKDLSSDHNISGTPKLEQMCLQVLSMYVIPGISCIEISEDKMQDEDQEVCLSTGKGVASLISGVAVIPDSDLPIIVTTIQSCSQGMNKVLVSLQQKFPSVSKSLLKNKVREVSDYVDNRLQVKKEVLDKLGLAVKPEKSSVGPKSIAAFFSKRCLPPTGEGAKPGETSPLPLKSSFAIDERPQSSYDI

SEQ ID NO: 110928 - protein, 924 aa, Glycine max
  Coding DNA Sequence Number=SeqID_19243
  Gene Ontology: Mol. function=catalytic activity; Cellular component =nucleus; Biological process=metabolic process
  Homolog annotation: Hit_ID=A7PHH0; Match level="QueryCoverage=62%, HitCoverage=82%, E-value=0.0, Identity=76%"; Hit description =Chromosome chr17 scaffold_16, whole genome shotgun sequence
  Pfam annotation: Domain name=DUF298; Domain location=577-791; Score =20.2; E_value=4.8e-06; Accession=PF03556.6; Description=Domain of unknown function (DUF298)
  Pfam annotation: Domain name=PPR; Domain location=120-154; Score=3.1; E_value=3.3; Accession=PF01535.11; Description=PPR repeat
  Pfam annotation: Domain name=PPR; Domain location=186-220; Score =34.2; E_value=4.8e-07; Accession=PF01535.11; Description=PPR repeat
  Pfam annotation: Domain name=PPR; Domain location=19-53; Score=24.9; E_value=0.0003; Accession=PF01535.11; Description=PPR repeat
  Pfam annotation: Domain name=PPR; Domain location=221-255; Score=0.3; E_value=7.2; Accession=PF01535.11; Description=PPR repeat
  Pfam annotation: Domain name=PPR; Domain location=287-321; Score =51.9; E_value=2.2e-12; Accession=PF01535.11; Description=PPR repeat
  Pfam annotation: Domain name=PPR; Domain location=322-356; Score=9.5; E_value=0.58; Accession=PF01535.11; Description=PPR repeat
  Pfam annotation: Domain name=PPR; Domain location=424-458; Score =10.5; E_value=0.45; Accession=PF01535.11; Description=PPR repeat
  Pfam annotation: Domain name=PPR; Domain location=85-119; Score=14.9; E_value=0.13; Accession=PF01535.11; Description=PPR repeat
  Pfam module annotation: Pfam domain module=DUF298::PPR::PPR::PPR::PPR: :PPR::PPR::PPR::PPR; Domain location=577-791::120-154::186-220::19 -53::221-255::287-321::322-356::424-458::85-119
MELFEILELEHDGFDVGGSTYDALVSACVGLRSIRGVKRVFNYMVNSGFEPDLYVMNRVLFVHVKCGLMLDARKLFDEMPEKDMASWMTMIGGFVDSGNFSEAFGLFLCMWEEFNDGRSRTFTTMIRASAGLGLVQVGRQIHSCALKRGVGDDTFVSCALIDMYSKCGSIEDAHCVFDQMPEKTTVGWNSIIASYALHGYSEEALSFYYEMRDSGAKIDHFTISIVIRICARLASLEYAKQAHAALVRRGYDTDIVANTALVDFYSKWGRMEDAWHVFNRMRRKNVISWNALIAGYGNHGQGEEAVEMFEQMLREGMIPNHVTFLAVLSACSYSGLSERGWEIFYSMSRDHKVKPRAMHYACMVELLGREGLLDEAYELIRSAPFKPTTNMWATLLTACRMHENLELGKLAAENLYGMEPEKLCNYIVLLNLYNSSGKLKEAAGVLQTLKRKGLRMLPACTWIEVKKQSYAFLCGDKSHSQTKEIYEKVNNMMVEISRHGYVEENKALLPDVDEEEQRILKYHSEKLAIAFGLINTPHWTPLQITQGHRVCGDCHSAIKFIAMVTGREIVVRDASRFHHFRDDIKSGHAYIGGEEGYRQDSDIQKAKVSREALTQLSKLVESRVTTGAVTAWKLVLAGRFSLLHPWCDFVEVQKKPSMHKCYMGHEHKDAAHSKSCSMQHFHRSVIWSQKVGCGSHPQNHTTLIWQVESVGLWGCPEAPLACHELAGNAADSFGSDADLLLFIQKNQRYNISEDTWQQVLAFSWCTRDSLEAYDPEGAWPVLIDDFVEHMYRMQGSYYDNSNFHCNCGDPESQSCVFDDPLPGLRSFSGLKRKLPEDLSKSDDMDSNDMILSNCKRSRAHDAVDLEDNPPGNTADDCMETSRQNSPLCSSMSPCAVEGCLSKGFAGLLSTRSFVQFGRERRASF

SEQ ID NO: 110929 - protein, 192 aa, Glycine max
  Coding DNA Sequence Number=SeqID_19244
  Gene Ontology: Mol. function=nucleic acid binding; Cellular component= nucleus; Biological process=mRNA processing
  Homolog annotation: Hit_ID=A9PHS8; Match level="QueryCoverage=95%, HitCoverage=66%, E-value=6e-88, Identity=79%"; Hit description =Putative uncharacterized protein
  Pfam annotation: Domain name=RRM_1; Domain location=19-90; Score =31.6; E_value=2.9e-06; Accession=PF00076.13; Description=RNA recognition motif. (a.k.a. RRM, RB
MSTSNQHQFRYTQTPSKVLHLRNLPWECSEEELRELCKPFGKIINTKCNVGANRNQAFVEFADLNQAISMVSYYASSSEPAMVRGKTVYIQYSNRHEIVNNKSPGDIPGNVLLVTIEGVEAGDVSIDVIHLVFSAFGFVHKIATFEKTAGFQALIQFTDAETASSARDALDGRSIPRQGLLKLGSQDTVDLP

SEQ ID NO: 110930 - protein, 530 aa, Glycine max
  Coding DNA Sequence Number=SeqID_19245
  Gene Ontology: Mol. function=transcription regulator activity; Cellular component=nucleus; Biological process=mRNA modification
  Homolog annotation: Hit_ID=A7PMY8; Match level="QueryCoverage=89%, HitCoverage=94%, E-value=1e-174, Identity=61%"; Hit description =Chromosome chr14 scaffold_21, whole genome shotgun sequence
  Pfam annotation: Domain name=PPR; Domain location=165-199; Score =31.9; E_value=2.3e-06; Accession=PF01535.11; Description=PPR repeat
  Pfam annotation: Domain name=PPR; Domain location=227-261; Score =41.2; E_value=3.6e-09; Accession=PF01535.11; Description=PPR repeat
  Pfam annotation: Domain name=PPR; Domain location=312-346; Score =40.7; E_value=5.1e-09; Accession=PF01535.11; Description=PPR repeat
  Pfam annotation: Domain name=PPR; Domain location=347-380; Score=5.8; E_value=1.6; Accession=PF01535.11; Description=PPR repeat
  Pfam annotation: Domain name=PPR; Domain location=383-417; Score=4.5; E_value=2.2; Accession=PF01535.11; Description=PPR repeat
  Pfam annotation: Domain name=PPR; Domain location=449-483; Score=9.0; E_value=0.66; Accession=PF01535.11; Description=PPR repeat
  Pfam annotation: Domain name=PPR; Domain location=64-98; Score=22.2; E_value=0.0019; Accession=PF01535.11; Description=PPR repeat
  Pfam module annotation: Pfam domain module=PPR::PPR::PPR::PPR::PPR::PP R::PPR; Domain location=165-199::227-261::312-346::347-380::383 -417::449-483::64-98
  Subcellular localization annotation: CTP_CleavageSite=34; ConfidenceScore=5.33e-01
TITNLGTLRQIHALMIVNGFTSNVGFLRKLVLTTAMSMVGPAATTAVTQYAVQMFAQIPQPDTFMWNTYIRGSSQSHDPVHAVALYAQMTHRSVKPDNFTFPLVLKACTKLFWVNTGSVVHGRVFRLGFGSNVVVRNTLLVFHAKCGDLKVANDIFDDSDKGDVVAWSALIAGYAQRGDLSVARKLFDEMPKRDLVSWNVMITAYTKHGEMECARRLFDEAPMKDVVSWNAMVGGYVLHNLNQEALELFDEMCEVGECPDEIGEKVHAKIMELNKGKLSTLLGNALVDMYAKCGNIGKGVCVFWLIRDKDMVSWNSVIGGLAFHGHAEESLGLFREMQRTKVCPDEITFVGVLAACSHTGNVDEGNRYFYLMKNKYKIEPNIRHCGCVVDMLARAGLLKEAFDFIASMKIEPNAIVWRSLLGACKVHGDVELAKRATEQLLRMRVDQSGDYVLLSNVYASHGEWDGAENVRKLMDDNGVTKTRGSSFVEAYRIEPNPVNGRTLLGACIVYGDVELAKRVNEELLRLRRDE

SEQ ID NO: 110931 - protein, 128 aa, Glycine max
  Coding DNA Sequence Number=SeqID_19246
MEDSLENWISQLEMEEYDDVLNESHHGSFDEQEFLREILEEQPENLSPQRENICSTSPTNSTVSFDEAISFNYASGSTLHKSNSSNSIKSLKRSSSSSVSPASTTTYLLSFDTSIVEPITLKPSPKLD

SEQ ID NO: 110932 - protein, 242 aa, Glycine max
  Coding DNA Sequence Number=SeqID_19247
CTLCGGAHRSGLCIPTEETSHEVNYMGNHPRQNFSAGGFSGLQHGQPYQQHNQWRTHAGNQPLVQVKEFDEKRNPCAKRPFLHALSELLFVLNALTPDHWLDGPAKRILDFQMNALSQAVALSTFIFSVELSVELAKGGCALSKYYGVATYPSAGGRRRTHGCVFQERKMRGVATNVYSRKTSEKPKKNVTDCATMFPFDFRHVAELHRLPNDGCYVPWGGQAKVQKMMLSLYASMGSFAPD

SEQ ID NO: 110933 - protein, 315 aa, Glycine max
  Coding DNA Sequence Number=SeqID_19248
  Homolog annotation: Hit_ID=Q6WAY6; Match level="QueryCoverage=82%, HitCoverage=64%, E-value=2e-12, Identity=37%"; Hit description =Putative uncharacterized protein
MGSNQTPLLKKRFYQVKIKSLEVASLRELGQLMGQLQCQVFHKTYGKIWDLATIEVSVEAIASLTQYYDQPLRCFTFGDFQLVPTVEEFEEILGCPLGGRKPYLLSRFYLSMARVARGLVDLAAIDAFLAYHHTKESPVIAILADVYDMFDRRCSPVYYKVTSYAPRKERRTGRFPNVPLMGTRGCINYNPVLAIRQLGYPMRGAPSEESITPFIAWGFSDPNARVLQEVQKAWGAVQSKDKELRGSSNGIAGGYHKWLRVRTQKLDWLPKLKAAREEEAETLEESEEVQTLKAKLERAQVVKENSSQWPSKSGQ

SEQ ID NO: 110934 - protein, 36 aa, Glycine max
  Coding DNA Sequence Number=SeqID_19249
MKNIPDLGVVFAFEEGRQKRGSCSYVPSIEKGIRPT

SEQ ID NO: 110935 - protein, 162 aa, Glycine max
  Coding DNA Sequence Number=SeqID_19250
MHALLGSFNRGNWFDSKVLDSAGLSYRAFTRNQGAITEGEHHKDNCYYYSINNFDWKQEPVMYDYHEKERAPDLESILADFMTYQRIQFERNQSSAGYQWESFRQSEYQNKSEGVLNLDDLLMQFKDMVESIQQTFRRTETHISKLIDDMTNVAARKEEEHT

SEQ ID NO: 110936 - protein, 106 aa, Glycine max
  Coding DNA Sequence Number=SeqID_19251
KGEERQKEFRRLVLGEFFLAKGEGNENDESHKFCFQDDDKGDDKKLKGQSKNEFKIFKIESRTLQDSRGKLISRIKNQESRFKIQDSRIKRRLNQDKYEKVFSKIE

SEQ ID NO: 110937 - protein, 142 aa, Glycine max
  Coding DNA Sequence Number=SeqID_19252
  Homolog annotation: Hit_ID=Q6L477; Match level="QueryCoverage=50%, HitCoverage=11%, E-value=1e-09, Identity=35%"; Hit description =Putative uncharacterized protein OSJNBa0009L15.8
ASPLPSTVKQTRKASRLQSLSTRPPSAERPVVHIDPSIGKADGPHRKKLRTYLGIVARDKVDVTYENWKEVPIAQKDLIWEDIRAEFEILEASDSRTKRKLLQTVDERWRQFKSELMRKWALAADQDGVDDTVCEKYDISKE

SEQ ID NO: 110938 - protein, 85 aa, Glycine max
  Coding DNA Sequence Number=SeqID_19253
MADAKFAGLLGLGKPLVEILPPGQLRGFLPVVGLARVGGAGLWPRAKFRMGFVGDLEGRDESKRQGLNLSGSWQQGHSATYNTPS

SEQ ID NO: 110939 - protein, 98 aa, Glycine max
  Coding DNA Sequence Number=SeqID_19254
MTGRLLVGSLTFDCRIMHYIIVRILMPRSSNLAQASEEDLILMWAFLTGHPIDWAHLVRYRMHKALRSVKRSFAIGVGAVTSFGYRKDVDGQWLKKDA

SEQ ID NO: 110940 - protein, 108 aa, Glycine max
  Coding DNA Sequence Number=SeqID_19255
LTVNAVEEWESRGLKQIGDVSTSRRFILEALREADVIDLDGNKGDLCLMHPGASHDVETCPIVEELLQGMINRGQIEIHSAKKEEGEGHYHLEALRLPALNSKDAYTL

SEQ ID NO: 110941 - protein, 40 aa, Glycine max
  Coding DNA Sequence Number=SeqID_19256
MAGHGRDQNRDVLNRITTVLETLVQECDVEPAEYRGLMAF

SEQ ID NO: 110942 - protein, 17 aa, Glycine max
  Coding DNA Sequence Number=SeqID_19257
MDTRLRVIGDPMNEVQQ

SEQ ID NO: 110943 - protein, 75 aa, Glycine max
  Coding DNA Sequence Number=SeqID_19258
  Homolog annotation: Hit_ID=Q7PDL8; Match level="QueryCoverage=89%, HitCoverage=8%, E-value=8e-08, Identity=38%"; Hit description =ERYTHROCYTE MEMBRANE PROTEIN PFEMP3
  Subcellular localization annotation: CTP_CleavageSite=51; ConfidenceScore=5.69e-01
VRTCSPLKASACSPLKASACSPLKARTCSPLKVRMCSPLKARACSPLKVMACSPLKERVCSPFKARVLVPNGPPF

SEQ ID NO: 110944 - protein, 120 aa, Glycine max
  Coding DNA Sequence Number=SeqID_19259
  Subcellular localization annotation: CTP_CleavageSite=41; ConfidenceScore=5.14e-01
MNFVFVYVSSTFEFGAMRSDYLVQFSILNLFRSPMNCVFVQASSTHDFGAMRSDCLLQFSILNPFSEPMNCVFIHASSTHEFGAMLSDCLVQFSILNPFSNPHELRFRSCLLHPRVWSHA

SEQ ID NO: 110945 - protein, 174 aa, Glycine max
  Coding DNA Sequence Number=SeqID_19260
MSGFTHDSPQISANINYPLAPYASEPYNAQWNARGLLVTSTRCVRVVFSEKWRLSRCKIHLLVGVLGIAFVDNWAVGVAGGDTEGVPKCFQGVYHQLLALQWHIRAKARSRLDCDGEFHVSPPRSGVIDILIGSVRHIGWRIVERQAIWWEGVLVLNLHIMGAARTSQIFAYHI

SEQ ID NO: 110946 - protein, 75 aa, Glycine max
  Coding DNA Sequence Number=SeqID_19261
  Subcellular localization annotation: CTP_CleavageSite=34; ConfidenceScore=5.04e-01
MKIAEIQVVGMSPPPLRLHNHSQTHLKLSGRLPLQALVSTDLHTTKSFKISGTLTFLSLELSRHVEASRKGQNIL

SEQ ID NO: 110947 - protein, 17 aa, Glycine max
  Coding DNA Sequence Number=SeqID_19262
AFWQELRRSEFFISIED

SEQ ID NO: 110948 - protein, 125 aa, Glycine max
  Coding DNA Sequence Number=SeqID_19263
  Subcellular localization annotation: CTP_CleavageSite=36; ConfidenceScore=5.30e-01
MEEPSKKRKGSSSTTAAAAHRRHGPSGAPTAPIHPSLSSPGSSTLFSSDDQRLWYLSQFSSRIILDPKYLDVEFFNDETFDCYQVFQNSGLVDFMSLKLPYYPELVKVFYCNLKIQDDLIISEVP

SEQ ID NO: 110949 - protein, 65 aa, Glycine max
  Coding DNA Sequence Number=SeqID_19264
MSQPTLRREGEAKSKNVSSKEKKHGVATSVYSRKMLEKPKRARPGELLLQTEVTLLTQASWLLHP

SEQ ID NO: 110950 - protein, 219 aa, Glycine max
  Coding DNA Sequence Number=SeqID_19265
  Gene Ontology: Mol. function=motor activity; Cellular component=cell projection
  Homolog annotation: Hit_ID=UPI00016621D1; Match level="QueryCoverage =84%, HitCoverage=40%, E-value=3e-13, Identity=30%"; Hit description =UPI00016621D1 related cluster
VLTLRGLHVLALRRLHVLAFRGLHVLDFRGLHVLAFRGLHALTFKGLHVLAFKGLHVHAFRGLHVLAFRGLRILGFGGLHILAFRGLHVLAFRGLHVLDFIGLGVLNFRGLHILALRGLHVLTFRGLHALAFRGPHVLIFRGLHALTFRGLHILAFRGLHVLAFRGLHSLAFRGLHILAFGGLHVLDFRGLHVFAFIRLQVFVFRGLLVAQLGLCPQDT

SEQ ID NO: 110951 - protein, 170 aa, Glycine max
  Coding DNA Sequence Number=SeqID_19266
MGLSKDNSGITSLINAKGNRGKYGLGYKPTQADMKRSIAGRKSGGQSSSWRQESEGSPPCHISRSFISAGLGDKGQVVAICEDNVPSTLEVVQPCPPDFQLGNWRVEERPGIYAMSIISDDESPEGTNTWDPLINFEQETNQTEDEGNEDVGLPPELERMVAHKDQGGIL

SEQ ID NO: 110952 - protein, 145 aa, Glycine max
  Coding DNA Sequence Number=SeqID_19267
MLQSIIKDRSFTSELQVVAPPGSIPSVEQFMEREHEGPTTQVPQHVKDGSSEATVPEPFTVEEEAGETQVRQEATATFERSREVTSYPPTLVVDLSSSQHAVNPSTPILEIPEDPTTPILTLNTSPPATPVLHLTDEEDAQAQDT

SEQ ID NO: 110953 - protein, 213 aa, Glycine max
  Coding DNA Sequence Number=SeqID_19268
VRKAWEVVQKEDKEFRGSNNGPIGGYHEWLKAHVQALDWLPSLRTAKREEVEAPKEDEEVARREEHGWNKFRGALWGSNSELKLWKEERDQSREDNLILKDELKACFRSKKSLSQRLCETKTNMLAIISKYQEELNLATTHEHRVADEYAQVYAEKEARGRVIDSLHQEATMWMDRFALTSNGSQEIPQLLAKAKAMADTYSAPVEIHGLLSY

SEQ ID NO: 110954 - protein, 125 aa, Glycine max
  Coding DNA Sequence Number=SeqID_19269
MASRKRKAPSTPTQVRFDRSRFTSQEAWERYTNIIVPRKLQPERNMVVYYTEFDEFEEELERHHWDEELTDFGDGNIDVAIVKEFYTNLYDPEEKLPKQVRVRDPSCCGRGGITLCLFQICTPEA

SEQ ID NO: 110955 - protein, 471 aa, Glycine max
  Coding DNA Sequence Number=SeqID_19270
  Gene Ontology: Mol. function=RNA-directed DNA polymerase activity; Biological process=regulation of transcription, DNA-dependent
  Homolog annotation: Hit_ID=A5BZZ9; Match level="QueryCoverage=95%, HitCoverage=49%, E-value=1e-71, Identity=37%"; Hit description =Putative uncharacterized protein
  Pfam annotation: Domain name=MP; Domain location=1-126; Score=-33.0; E_value=0.018; Accession=PF01107.9; Description=Viral movement protein (MP)
MNIAVSINIYTSVVLQVAIKPLIDMGIDAAVLMCLRDIRHNQFEDSLIGTVETSLGQGPIYFNCYPNKTVSLMDINILDSLFLNIHFHGLDMKEGSIPAALIYRIQYKVMNTCASRVLLKPQKGETTLFITDMTKANVSLPRKIKWDEVTLPERWVMDKATPSIPRPAPTIEHIKQDNSGKVEITFNRRNSFSSRIEASRTRSIPVGLTRSESHNQFPTVNLQGIDTTSSIPRTTYNQKQEDDQKSIQSPTYSSMEPDDVSDNFSIDKETLRKDFYSPENEPQRRWFFQHYKGTNRKQIQDKFYEFVERVKINVHFFDWFHAYAIRNDIDYPWKQDIIGDPTTNVITNWQVKDGELIQSELPPATQYQLPNIKDSNNKPVMAIPFKTKDVSEEVTSKDIKSLMEQANYTNKYLQALGETIKTKVVPKQKSIEETSPSIPIEKPLFKPFKVSEKAKRKIRELRKTKSLIEGV

SEQ ID NO: 110956 - protein, 107 aa, Glycine max
  Coding DNA Sequence Number=SeqID_19271
  Subcellular localization annotation: CTP_CleavageSite=58; ConfidenceScore=5.34e-01
MVHDISVKVKLEVTGTSTALNVFGSRRRNDVTRSIFCPNFCKMVTSMLQLDLMNLFVKARAWFNPITQGMAILIANTSTTFHRDERLENTHATHGKWENARVTHEQT

SEQ ID NO: 110957 - protein, 208 aa, Glycine max
  Coding DNA Sequence Number=SeqID_19272
  Gene Ontology: Mol. function=oxidoreductase activity; Biological process=metabolic process
  Homolog annotation: Hit_ID=A0AE15; Match level="QueryCoverage=95%, HitCoverage=52%, E-value=2e-36, Identity=45%"; Hit description =Putative L-idonate 5-dehydrogenase
  Pfam annotation: Domain name=ADH_zinc_N; Domain location=72-202; Score=96.7; E_value=7.3e-26; Accession=PF00107.17; Description=Zinc -binding dehydrogenase
SRLARRGQPPPGPDLLGSAARDPHTDGGFAERITVRAEQVVPLPDGLDTRRAVLAEPLGVAIHAVHRAGDVTGAHVLVSGCGPVGLLTILAVRAAGAARVSAVDLSPLARERALALGADVALDAAEQLGQDVTVAFEASGAPASLEAILRVVARAAVVVQAGNLPPAPVSVALGPIVSKEIDYRGTYRFVSEIEEAVELLARSELAEG

SEQ ID NO: 110958 - protein, 176 aa, Glycine max
  Coding DNA Sequence Number=SeqID_19273
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=50%, HitCoverage=75%, E-value=2e-24, Identity=67%"; Hit description=LacZ protein
METAGYGPAVRSHEDFARLAVRRGLGHREHALDPTPQAGRDLARTVFAGADRPGADGTGGRPDAVVAMNDLAVVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAVWWLRAA

SEQ ID NO: 110959 - protein, 111 aa, Glycine max
  Coding DNA Sequence Number=SeqID_19274
  Gene Ontology: Mol. function=transferase activity, transferring groups other than amino-acyl groups; Cellular component=cytoplasm; Biological process=biosynthetic process
  Homolog annotation: Hit_ID=A1R6S8; Match level="QueryCoverage=88%, HitCoverage=25%, E-value=6e-42, Identity=84%"; Hit description =Putative chalcone synthase
  Pfam annotation: Domain name=Chal_sti_synt_C; Domain location=1-111; Score=21.0; E_value=3.2e-05; Accession=PF02797.6; Description =Chalcone and stilbene synthases, C-te
MAWNIGDNGFEMVLGTYVPHIIDEHITGALAPLLAHDPSLAERPYREIPHWAIHPGGRSILDKVEAKLALEAAQLVPARETLRDYGNMSSATVLFVLKGDPRGRATGGGGA

SEQ ID NO: 110960 - protein, 125 aa, Glycine max
  Coding DNA Sequence Number=SeqID_19275
  Gene Ontology: Mol. function=transcription regulator activity; Cellular component=intracellular; Biological process=regulation of transcription, DNA-dependent
  Homolog annotation: Hit_ID=A0QP45; Match level="QueryCoverage=98%, HitCoverage=47%, E-value=2e-12, Identity=34%"; Hit description =Transcriptional regulator, GntR family protein
  Pfam annotation: Domain name=UTRA; Domain location=1-93; Score=32.4; E_value=1.6e-06; Accession=PF07702.4; Description=UTRA domain
MAIEEVWLSEDLFPGLASEDLSGSLYELLETRYGVAVYRHDRRISAISVDAVHAELLDIEVGAAALFATQIGVDRRGRRLELGRSIYRGDRFDFTTVTFAAGRQGPAPGRSHRPVNSRTNREVRP

SEQ ID NO: 110961 - protein, 83 aa, Glycine max
  Coding DNA Sequence Number=SeqID_19276
MSARGAWETSKYTSAISGTIRFTATSLCIQMNLHGRFSARWSGQLLGLALCIFEGTPQLQALSENHDITISLRNFGALELFWE

SEQ ID NO: 110962 - protein, 240 aa, Glycine max
  Coding DNA Sequence Number=SeqID_19277
ARRAQQRVVDVLAVGVALRLGVGGLRGGDGGELRPSRPRRPDGVGHLASQRLERVEVPTDRAGGLHAERPLAGLGAALLRLERRERRIEGGQPGAAPVLGGGGRQRGLAVVLPRGLCPFAQRRLVQQVGAGAGGELPHVRAPRRGSAEGHLRLLLAVVLGAGQQRGGARAGQRGGLVDRGAERRLLPVLVEHLHVRRDAGVERELAQQLPGDGVDGADQGAVHTAGGLELAALEQGAAHP

SEQ ID NO: 110963 - protein, 174 aa, Glycine max
  Coding DNA Sequence Number=SeqID_19278
RGLRQPHEGEHEAQAEADRTGRGGEPQRLQQAADDRFREEPLRHHAPLPARVGDEGIQHHEHREADEEREHQPARVLGRDHAQVGEVLGGRLRGVRGGRRPVGGGGVSGRPVGRCVRAGARHLLPSRRRGAVEGRSGLRGAAVGLGGDDGGGHEVPSVTGREPASGPGLQEPTL

SEQ ID NO: 110964 - protein, 315 aa, Glycine max
  Coding DNA Sequence Number=SeqID_19279
MAAVDGDGHAVQRVHVQQRLSHLHGGEAVRVGELGGVDHGAVVVDPHGDPVAVGDAQLAEEGAGDRGPQRAVAHVVRVDDAPDLIALALGRVRRQPHQCGPVDARTDGLEAGRAGGEARAGEGVDVPAVEGVGLLGAGATVAGLVDLADLVDAEDRLEMGERAVVGRDHVVPGAGAGHDRQPLGAHPGIDHGDEDGPLRPIGQHLGEAVGALPDVVGRDVVGDVVDPERGIDADGHAVHGADRAVVETEIGLQHQGAHGGTSGHARATLGKSRPGSPPLTRMPLKRLSTVGADHLGPGALRGDQAYRYRRPRGGA

SEQ ID NO: 110965 - protein, 66 aa, Glycine max
  Coding DNA Sequence Number=SeqID_19280
  Subcellular localization annotation: CTP_CleavageSite=26; ConfidenceScore=5.02e-01
MIVRVLSPRPAAQQRPQDHRAPAPQRAGTRTGPFLPPRRASLTCDDHATEVAYITPDAAPSGVCRK

SEQ ID NO: 110966 - protein, 271 aa, Glycine max
  Coding DNA Sequence Number=SeqID_19281
  Homolog annotation: Hit_ID=A7MQY8; Match level="QueryCoverage=57%, HitCoverage=28%, E-value=7e-08, Identity=27%"; Hit description =Putative uncharacterized protein
LAVAAQHDRVGLDADRAQCGHGVLGGLGLQLLGGADEGHEGDVHEEHAVAAEVLAHLPGSLEEGLRLDVAHGAADLGDDDVHVVPGLGAHRLLDRVGDVGDHLHRVAEVLAAPLPGDHGGVHLPGGDVRVGGEVLVEEPLVVADVQVGLGAVLGDEHLAVLEGVHGARVHVEVRIELLHRHPQAAAAQQHAERGGGQPLAEARDHAAGDEDVLGDARVPEGLARGGRADPRNGSGARLGGVRAGICHGLSTYQPRGSAASTSSSWARRSCA

SEQ ID NO: 110967 - protein, 290 aa, Glycine max
  Coding DNA Sequence Number=SeqID_19282
ADHDVAHAAAHLAADHHAAVAAHHRAAGDGDVLGRDAVRGALRAGLERDAVVPHVDVAVADAHVAAGFRVDAVGVRRLGGVVDVQVREGDVLAEGGVHRPGRRVAQGDIPDRDPLALVQADQGGTRMGQLLTAMAEGVPPSLPAAVDRAQPGDRHVPLAVRVQAGRVDPADGPLPARLDRGVQRRIRHELQQRPGLEVQLDAAAQAERTGAVHAGGHAHPAASGGCGLVEGALPLRRRDGGVDEVLRGRGDGHGGAFRGGRADGRRGAAGRGRRRLRCRMRHRPLRRIRR

SEQ ID NO: 110968 - protein, 285 aa, Glycine max
  Coding DNA Sequence Number=SeqID_19283
MAVQRGGGLRETAGPPERRGRCASPASRSSLGAHELGGQLAAEPREHHRHPELPLALGDPPSQLRAGLERLVGERGAEVMGDAHRGPGQEGGTADESRRRLPFHAEVAEHPDQHEIVPHEVQRMGHAVQRHPVDVLFPALPVPERHRVPEGHGVEVVPDLQGSLDTLRGTVPEGGGHVDVRCGVPGEVRPEDVLERAGEPDGGGRGAAGLDAQLAAGDADGDVVGLDLCPGPARAAAPGPIGPGRRREMELHPLGEPRGAAAHQLPHPVEAGGGGGGDGVVTGHG

SEQ ID NO: 110969 - protein, 108 aa, Glycine max
  Coding DNA Sequence Number=SeqID_19284
  Gene Ontology: Mol. function=structural constituent of ribosome; Cellular component=ribonucleoprotein complex; Biological process =translation
  Homolog annotation: Hit_ID=A1R8T6; Match level="QueryCoverage=82%, HitCoverage=90%, E-value=6e-32, Identity=77%"; Hit description=30S ribosomal protein S17
  Pfam annotation: Domain name=Ribosomal_S17; Domain location=35-103; Score=110.3; E_value=5.7e-30; Accession=PF00366.11; Description =Ribosomal protein S17
MTDNTQAETPAVEELAKEGAQASSSERPYRKTLRGFVVSDKMDKTIVVAVEERVKHARYGKVTTKTSKFKAHDEENTAGIGDRVLVMETRPTSATKRWRLVEILERAK

SEQ ID NO: 110970 - protein, 297 aa, Glycine max
  Coding DNA Sequence Number=SeqID_19285
  Subcellular localization annotation: CTP_CleavageSite=27; ConfidenceScore=5.01e-01
MSTTTKRQRRGGIVRSVPSAQITERARPAAESSKSRRSGLEPSPAGSFTASDVVIIDGLLWSGLRGRGLRDAVPPHAVGERHAGPVGEVDRGGGVEHVQIGAGADPEVADVGAAQRERPAAGGGAERLGEREVHLQHRGGDAEGHRAGVAGAGVAVAGDREHRAGVQQLPGGGQGCAGGEVAGRQRGRDRRPGAHGEPARAVAGRGGAGGGRGERVDVGRAEVVHVVHAPGPELGGERDAAAAAELVAVHPQPEAGRGAGAQHPGGLGGVEAPSSQNTSIQRTCGATAASISPETSS

SEQ ID NO: 110971 - protein, 277 aa, Glycine max
  Coding DNA Sequence Number=SeqID_19286
PRKNSIQVTATAEQPEPRHPRQGEQQPEGEGDHGGERRDLERPPQPVPEEGEVVGAEIHHPLVRIQLAVRVELPQRPRQQREDRHDAEDRQQQDATPPLRAGSVEEDLGGGGGRRGSAHARISSRSFLAVRRPAVLMRASPPARSSQFVDPQCSCLCSCRDVERGAVARAALAARGDRPLDDAAERGAAEGEDQIDRTGDEEHQHRLGVADVQRLGDPGDLLHRDRGAQGGADHGADEHVDQRLHHRAERLRQHHEAQRPEEAQADRPGRLRMPDRH

SEQ ID NO: 110972 - protein, 192 aa, Glycine max
  Coding DNA Sequence Number=SeqID_19287
MPSALRACCRSPRSGSRGGSASPDPPARSHRPIASTRGDSRGESHRDPHVVHDHLDVLAAELVEQGQHLLLVPGQEAAVEPGFRRLRDDVDLVPALEHGQIRRVAQGAGDEVAGPAGQRQERPDVLLVPAGARDLGDPVEQGAHAGDELDREIVLVDRGDRAGEAHDGVLVVGDRAVAGTASNSCSPGDPLV

SEQ ID NO: 110973 - protein, 245 aa, Glycine max
  Coding DNA Sequence Number=SeqID_19288
MARTDRRHWIRAFQGVPKGTRQDGRGKQLIALIIGIGFPATATAETPEQNGLETHSDTELTELFGDAGVAEKDIAGLIAKIRSGEVPESMQPDSTPAEESTEEVKGGYVTVYRYADGSATTVTSTSGNQADDLKPGTIATQAIAVKGVGCSSKKTSGSTTTYTGCNVEAAYLIGTAKFKFDGKRSGGKFTITRVYGGGCNYLTKCGSPKIVRKTSSSSQHAQAEMAVHGTPIKGVGWTQIKLIDT

SEQ ID NO: 110974 - protein, 215 aa, Glycine max
  Coding DNA Sequence Number=SeqID_19289
  Gene Ontology: Mol. function=oxidoreductase activity, acting on the aldehyde or oxo group of donors, disulfide as acceptor; Cellular component=mitochondrial alpha-ketoglutarate dehydrogenase complex; Biological process=metabolic process
  Homolog annotation: Hit_ID=A1SQC1; Match level="QueryCoverage=61%, HitCoverage=33%, E-value=2e-47, Identity=69%"; Hit description =Pyruvate dehydrogenase
  Pfam annotation: Domain name=E1_dh; Domain location=1-153; Score= -35.8; E_value=1.3e-07; Accession=PF00676.11; Description =Dehydrogenase E1 component
MGLQRDGVVGTGDLSTDAAVLALFGDGASSEGEVAESFTFAASFQAPVVFYTQNNQWAISVPTQVQSRVPLAQRSRGWGIPSVRVDGNDVLAVLGAVRTALDSARDGRGPVFVEALTYRMAAHTTSDDASRYRPAAEGGGMGREGSDPPPAPPPRPARRDRRAVRRPLRRGGPRPRHAAPPPHPRHGGPGPGAHVRPPLRRAPSDRRRRARRVPR

SEQ ID NO: 110975 - protein, 305 aa, Glycine max
  Coding DNA Sequence Number=SeqID_19290
  Gene Ontology: Mol. function=nucleic acid binding
  Homolog annotation: Hit_ID=Q4AME1; Match level="QueryCoverage=96%, HitCoverage=26%, E-value=3e-31, Identity=30%"; Hit description =Helicase, C-terminal
MFTLPDELDAEDHHQDFYDTIAFLAGPERADRVREHLAQVREGMLQGTDEGTRRAEEATARAQAELQRVMSRTERLGSTAVADGMLREMEMPSLELRPGDLEVWAAADAIGRRAHGMDMFEFWRSSPFPVNLMDPSAYVAQRRTLDLAHEGDEDLAALLHLRRRGLLSWDDVHRFREIDPGNPKLRAMIDAAMERGVWKLAWLPPSLPYTAPGGPFATEGARSFTKRLVFSAWSVVPKAISALFSYETDRRLSAFAPGQGRGGPALYDGPRASPLLRFAVADGKLMNLPHLALLHHRIPAARGIH

SEQ ID NO: 110976 - protein, 55 aa, Glycine max
  Coding DNA Sequence Number=SeqID_19291
HVISSTVSDPSFLGDPAVPSSEGKDGNSHPGSRFMVSSDFGSGLVEWLDMMYVRV

SEQ ID NO: 110977 - protein, 394 aa, Glycine max
  Coding DNA Sequence Number=SeqID_19292
  Homolog annotation: Hit_ID=A5C0H3; Match level="QueryCoverage=90%, HitCoverage=57%, E-value=7e-14, Identity=24%"; Hit description =Putative uncharacterized protein
  Pfam annotation: Domain name=Transposase_23; Domain location=54-124; Score=2.2; E_value=0.00067; Accession=PF03017.5; Description =TNP1ENSPM transposase
MYHCVFSVKDSFEEQATQGSFVPHGRQDVLAAAIGRLEHPGRVRGIGAGNDPETGDSDRCGLYIEADPARLVAIGRVYEGSTVVHNTPLLLGQVKVSVEEVRDADAPVPVPTDEVSLVRQALHTFLAWPTHLVKSLSQQVAVSPPKPPPKPDPEVDDPLYLMTLTIPELFLRPYQVRWDATVFGVVNPDFPLYIKYEDLSEIAHGGQCLSISVLQLWILHLTETCMRAGNSDIYGFLEPQSIQRSGQSQFESESYIKSWMRSSQCDVYLGAYLNGFHCSGHWQMVVILPKEHLVVWFCSLHNRPDNYLKGIINSAIKGLDDAPQPKSKAPAWWIVVKCNRQKGTTECGYYVMHWMSTIILGSFRNNWEAYFNDPRPLEPERLKALRIQWAQFYL

SEQ ID NO: 110978 - protein, 71 aa, Glycine max
  Coding DNA Sequence Number=SeqID_19293
MEQTRQRSEEARGGEHAREESNKAASKDKHCFKINTRLLQRTKPCFKITLRSSLASKQSDSKTCKALVIDY

SEQ ID NO: 110979 - protein, 103 aa, Glycine max
  Coding DNA Sequence Number=SeqID_19294
RADALSAGAFKTQSSYGNAKRSCALSAPYETAKNYKAIRCICPYLASSPYIPAPLLFIAFIYTIQMKALRAAIALSAFIFSIEFSIELAKRGCALSEYCVSDT

SEQ ID NO: 110980 - protein, 202 aa, Glycine max
  Coding DNA Sequence Number=SeqID_19295
MGDGEGVGQDQLAGPGRDHDRADHGVRAGPHDELHEPLGDPLHLRARVGVQAQGHHLAGHLAVQHLLLADPHHRDLRAGEDRGGDLRGDQRGDRVAERVVHRDAALHGGDRGERVDAGAVPGGIDAAHRGAGDAIGLDVPGVPHPHPGALQSEITGPGDPAERHQHVAARDLLARGEGHDHAVLGAARGRGAGAGAHGHAAA

SEQ ID NO: 110981 - protein, 199 aa, Glycine max
  Coding DNA Sequence Number=SeqID_19296
VDGIDKLDEPEQRDRVIARLRGETRPVPAAEHDDAVLARRVRAEPQLLAGADHAVGDMAVRLPRRDREVAGQHGPGQRDDHQIARGEVVRAADDAAAGALLAGLGILGVVGVLVVLGADVDAHPVDGLAVLLRLAHELEHAAHHERAGHLGAEDALLLEADGDQRGRDGLGAGALGQCGVLGEPGQGNADRIPAARGIH

SEQ ID NO: 110982 - protein, 220 aa, Glycine max
  Coding DNA Sequence Number=SeqID_19297
MAAWTNNGAATTLGLRRGRPSVALPDYDPESSRQHTVRRRNLAHDCRGGGARAGWDSIGHMSAWSPVSRARTSAPRRRPSVMVTWNPPPEEPNASCPICSKPVWFFRNKNGGCAYFDAIGKPWPLHPCMEKQQSAEDRRAAIEARAAYDRALETSPRFRARQTARVAVLDSVSRVDQQRTGSSFTTAAPAKQESDDDEPLDWMGGAGRFLRPVAVMPVEL

SEQ ID NO: 110983 - protein, 250 aa, Glycine max
  Coding DNA Sequence Number=SeqID_19298
  Gene Ontology: Mol. function=DNA binding; Cellular component =intracellular; Biological process=regulation of transcription, DNA -dependent
  Homolog annotation: Hit_ID=A0K0I6; Match level="QueryCoverage=75%, HitCoverage=75%, E-value=2e-57, Identity=60%"; Hit description =Transcriptional regulator, IclR family
  Pfam annotation: Domain name=IclR; Domain location=62-187; Score =97.5; E_value=4.2e-26; Accession=PF01614.9; Description=Bacterial transcriptional regulator
LPNRTYVLGPRLIWLGEAATRQLGPTGRPFLQHLADELGESANMAALDGQMIVYVGQVQSNRSMRMFTEVGRRAFPHATGVGKALLATLPNAEVEKIVRGTGMPQPTSKSAASLEELFERLDVVREQGFAIDDEEQELGVRCYAMAVPGERSRIAISVSGPSSRVDADFGERAVPLLREVAQQVAEEMDLVPGVPAGDAARACRGIVEPVAADRLGRRRGGNLSAPGQELQGADHHAVRVRAEEPPCARA

SEQ ID NO: 110984 - protein, 107 aa, Glycine max
  Coding DNA Sequence Number=SeqID_19299
  Gene Ontology: Mol. function=oxidoreductase activity; Cellular component=cytoplasm; Biological process=metabolic process
  Homolog annotation: Hit_ID=Q5YY94; Match level="QueryCoverage=87%, HitCoverage=23%, E-value=8e-40, Identity=75%"; Hit description =Putative dehydrogenase
  Pfam annotation: Domain name=ADH_N; Domain location=25-102; Score =77.2; E_value=5.4e-20; Accession=PF08240.3; Description=Alcohol dehydrogenase GroES-like domai
MRAVTWQGTEHVSVETVPDPTIQQPTDALIRVTSTAICGSDLHLYEVLGPFMSPGDIIGHEPMGIVEEVGAEVRSVRPGDRVVVPFTISCGQCASSLSIPSTSRGGP

SEQ ID NO: 110985 - protein, 308 aa, Glycine max
  Coding DNA Sequence Number=SeqID_19300
LLEPTARGRATARRDGSGEASASHGAHAGHRSGRRPRTARRPFAEGSGTEPSETPIDSDPEAAPSAAAPTEMPGRARGASSPEGSTATPIATSAIATMIPRDRRVFMSGMVATGDEIGARGAELAPQVAHVHVHHVRGAVVVVAPHLGQQQIAGEHLVRVLEEHPRHRELARGELHGALLPLGGAARDAGAQVEGEIAELEHVRADAAGPGGGLAGPQLHPGQQLLEAEGLGDVVVGAVLEALDGVVHAGARGDHEDRDLHVHAAQRLEHLEAVHARQPHVQDQQVHVPGGGEVEGGDAVLHHGGGEA

SEQ ID NO: 110986 - protein, 265 aa, Glycine max
  Coding DNA Sequence Number=SeqID_19301
LVPGPPSRSTVSISLIAGGDAGDLVAAVVAHIGGVLAGQRRVVLGAHVAAAAPGLVADAEVGHRPRLVAAVGAAQGRHRRVVGAGEVLDPVAHLRDRAGADVPVDVRLGVQQLHEVHELVGAEGVVLDDVAPVGVDHAGPLLARADAVAPVVVVGEAAAGPAQVRDLQRAQRLDHVIADAARVRDLGVLAHVEAAVDAAAQVLGEMAVEVPADGGAGQVEVDHHTGRAVGGGGRRAGGARRRGSRSASRSARRRGRRSGAGRLGH

SEQ ID NO: 110987 - protein, 335 aa, Glycine max
  Coding DNA Sequence Number=SeqID_19302
  Gene Ontology: Mol. function=nucleic acid binding
  Homolog annotation: Hit_ID=Q0S1Z5; Match level="QueryCoverage=52%, HitCoverage=30%, E-value=3e-26, Identity=40%"; Hit description =Possible helicase
MRRVLRASSRANPEAPSDGGGSVPAAPAAAGQHHGAVRAGPPPLPRHRRGHRRLRAPGPLARDDGVPPHRRGDPRRLRDHVPGRRGAAAAADHLAEGHRDRRGGRVRVPEQLLRACERSVRDDAAGVSAAAAVRSARREPSSLEDYPRLAGEALGLARPRSPRRKGGAQSQRPLPFVGPGERLWVLDVPYGTQVEGASWHPAVKMHLFVGRSLPAHLAPYAPGPHTLGRFLENTLNPESPAPNPAPAEHLEPRKNQFEAADAIAERALAGGRQFLLADEPGVGKTISAVLGATAVGDVRGARRVLVVADRPAAITIGHWCRTITALGDGDLEWGG

SEQ ID NO: 110988 - protein, 243 aa, Glycine max
  Coding DNA Sequence Number=SeqID_19303
MSAPCSSGRSSTGVAIVLSTTTGTPGGVGDLRDRAEVRHGEDGVADRFEEDAAGALAQRCRPGRGVQGVHEGHLDAEIGEAVAEQVRGAAVELVRGHEVVRSRAGGGHEREQGHGHGRLPGAEGERARPALEVGDAALEHGVGGVAVAAVDVAGPGQGEGVSGGGEVVELVGDGLVDGHGHRVLRRAGGVAGVDLPGGEARAAAGRGVGAVRGRGRDDVGGHRGGPLCGVVRHPAVLAAPEHP

SEQ ID NO: 110989 - protein, 372 aa, Glycine max
  Coding DNA Sequence Number=SeqID_19304
HADRRRRLGEHRASHLQGLALEFGVWNDAIDRPCLVRALRRILLGEEEHLAGELLPGLACHVGRAVSGVEAADVGVGLLEATVLRRGDGQVAHHVQGVSAACRPPRHDRDDDLGHEPDEPLHLEDVQAADYGTARAVDDRRLRVRVLVAVASADALVAAGAERPAAVLRARPVPGEQDRADAGVLPSDVEGAVQLVDGMRPEGVAHLRAVEGDAHRGQVLLGALPVRGLDAVHRAVVGDVGEARPAVLRRGHLPPAVRIEGVGDPTGQGDGRGGHDLQGSPAVAGAGSVTSRPQVSTSQRSPSMRNVARSVPSCTNPAAQATRPEAEARGSGGVRSPPHRARFASAPATHYPRGHAHPFLLCASAASTASRL

SEQ ID NO: 110990 - protein, 259 aa, Glycine max
  Coding DNA Sequence Number=SeqID_19305
  Gene Ontology: Mol. function=glutaminase activity; Biological process= glutamine metabolic process
  Homolog annotation: Hit_ID=UPI000045BE5C; Match level="QueryCoverage =33%, HitCoverage=25%, E-value=3e-13, Identity=47%"; Hit description =COG2066: Glutaminase
NSISRPASATRPAGGRVARRARRPAEGKRPARPPLPDDHGARDGAAALRRDRQARRLADPRRERRRAGAGRDGVPRARRAGAAPARAARRGPRPRAAPRLPRRSRDPHPAGLSRGRCPGPACTVGPVNSASTALDLYLSRLTTALSTATATGEPEVVVPDRGITGDVETQGDIPELSFLSGARQDHLSVAICSVDGEITRSGTDHTFPIQSISKAFAYGAAIDLHGMDHVNSLVDEEPSGEQFNALSLDPVTKKPKNPL

SEQ ID NO: 110991 - protein, 63 aa, Glycine max
  Coding DNA Sequence Number=SeqID_19306
MTFLGLVVARVAVVGVSVYLDLPFYLFFCLHRDSFVAPLAVLWPDMYLKVESFLQKYSVIGRQ

SEQ ID NO: 110992 - protein, 199 aa, Glycine max
  Coding DNA Sequence Number=SeqID_19307
MAEKTKSRLNQGDNSQNADMVVDPPSPIARHEKWKKARTNKFGQMTSAAAQEIADKIGAFVPHGRQDILNTAIGRPEHPGRVRIGGHGVTIPSYFGHASCGSHSSLPTITAKRLVEIIQTIKQEVKKEVEDENKDRMDKMKMKLDAIKSELSQIHTQQSASPRPSNPDIFVARVSTKESCAEAANNVVGNERCTFIHVV

SEQ ID NO: 110993 - protein, 219 aa, Glycine max
  Coding DNA Sequence Number=SeqID_19308
  Gene Ontology: Mol. function=3-dehydroquinate dehydratase activity; Biological process=aromatic amino acid family biosynthetic process
  Homolog annotation: Hit_ID=A4W7Y8; Match level="QueryCoverage=57%, HitCoverage=41%, E-value=4e-48, Identity=76%"; Hit description =Putative exported protein precursor
VKCRGAGYFEWNAVARGGGLGFSPGGFPAKPNALGTLVGASYSRRAVERAGDALRAVLRHGHYKRAGARALGLLTALPGFAATPAPVPAAIANHEGPIRIAVIRNLGSDDNTTQFVAGAIQEGKKLGFKVSTFLSNGDDAKFQDFVNQAISQKGAIRTPPRWVKKAVDAGIKVAVFDTADDASLTNLSFGQLAKDFNGKANIVKLWGGGASRRMERRQG

SEQ ID NO: 110994 - protein, 75 aa, Glycine max
  Coding DNA Sequence Number=SeqID_19309
MFFICWIYKHFPSVAESTTDPDYDEDSPRAGRWIATKKTMKSILHRRTGSAWTDSGFRMSVGFHMGSTDWSGTSI

SEQ ID NO: 110995 - protein, 179 aa, Glycine max
  Coding DNA Sequence Number=SeqID_19310
MAPTRHPLDPDKSNRALGFPALITGLCQSFGVPVAPTKVIRPPITRAFIEKYCTQRQAQGDAPQAAGAPPPPHQAGPVGSFDVEQYLRHLVRQQAANHRAHVQTHDCLYQLSLSMQSQGFASFSCPTPDQFRAEVAWPGDWPEAQAGEAPPGAPNDGEEAHEDEEMADLLDFLGGSGAT

SEQ ID NO: 110996 - protein, 127 aa, Glycine max
  Coding DNA Sequence Number=SeqID_19311
MDILALLIFGVVLFPNVDWLVDRAAIDAFLAFYDYKESPVVAILADLYDTFDRRCEKNSARIVCWTRGCINYNPVLTIRQLGYPMRGAPSEEGLIPFIIRGFNSTNTGGASEGPQGMGNVTKKGQGT

SEQ ID NO: 110997 - protein, 124 aa, Glycine max
  Coding DNA Sequence Number=SeqID_19312
MGVSLAIGGEVTFLASQGSFPLCVSQHALLRASEARLTCALSIGGKMRGVATNVYLWKTSKNRRKPVIKNIPSSGVVFTLEEGISTSHVDKSGALAPTYPPSKRKSDLRSSFLRVNQVILFTWK

SEQ ID NO: 110998 - protein, 52 aa, Glycine max
  Coding DNA Sequence Number=SeqID_19313
MGEFFLRVFGCGETERELSLKRKPSCGALDEILRDCEFWLSLAQQEGSEDDA

SEQ ID NO: 110999 - protein, 101 aa, Glycine max
  Coding DNA Sequence Number=SeqID_19314
MQRYLMVIRTFCQLEASEPVDMQRLTSSSAPLSSKDNKSDDMRRYLIVIHTFCYLEASEPIDMQRLTSSSAPFPKMSVSSGRDCENVSFAIRQTQGSGSKQ

SEQ ID NO: 111000 - protein, 79 aa, Glycine max
  Coding DNA Sequence Number=SeqID_19315
MAILIANTSRTFHRDERLGNMHAMHGKYMRARKIISSYLHSGAQCPMCAVKNVIWTSRLPVTKDETNIQCMRDDMMHDI

SEQ ID NO: 111001 - protein, 210 aa, Glycine max
  Coding DNA Sequence Number=SeqID_19316
  Gene Ontology: Mol. function=nucleic acid binding
  Homolog annotation: Hit_ID=Q8FIL9; Match level="QueryCoverage=53%, HitCoverage=13%, E-value=1e-41, Identity=73%"; Hit description =Exodeoxyribonuclease VIII
MTMITPSSKLTLTKGNKSWYRAPPRGISDPNDPKWVKGIQTRDSVNQNQQETEQNDQKAEQNSPNTQQNEPETKQPEPVVQQEPEKICTACGQSGGGNCPDCGAVMGDATYQEIFDGENQPEVQENDPEEISNSCSPGDPLVLERPPPRWSSNSPYSESYYNSLAVVLHVVTGKTLALPNLIALQHIPLSPAGVIARGPHRSLFLNSCAA

SEQ ID NO: 111002 - protein, 322 aa, Glycine max
  Coding DNA Sequence Number=SeqID_19317
  Homolog annotation: Hit_ID=Q6WAY6; Match level="QueryCoverage=54%, HitCoverage=28%, E-value=1e-16, Identity=35%"; Hit description =Putative uncharacterized protein
MDGLVDLAAIDAFLAYHDHKEIPIVAMLADLYDTFDRRCEKSGTWIVCCTRALYVWLVSHLFRQEVRHACPLESYRSCTEKGGTNWDQLLANKEGASINWFPQWKEGRIGVLISCGGFPNVPLMGTRGCISYNLVLAIRQLGYPMRGAPLEEEIAPVISRGFNKTNVETLQKVWIGSRVLRTAKGEEVEAPEEDKEVQTPGQNSSKLKQSKKATTKALEQETKRARREEHGRNKFRGALWGSNNELKLQREERDQSWVDSLILKDKLKACSRSKRNLSQRLCETETNMLAIISKYQEELNLATAHEHKVADEYAQVYAEKEA

SEQ ID NO: 111003 - protein, 107 aa, Glycine max
  Coding DNA Sequence Number=SeqID_19318
MYSLDFRIVIIKKGEIVEAMPSKIILMMPNVEAMPSKVILMMPKNQELRKFQRFKNLVSRIKIQDSRIKFQESRFKNNQDQDSRLKIQESREDSIKISSKKVFQNIE

SEQ ID NO: 111004 - protein, 68 aa, Glycine max
  Coding DNA Sequence Number=SeqID_19319
MLIDHGNALAYACCVCSCGAKCTDLPGSLALALGHVRMLDVEYVRGGQSALIFHGLWHLLWATFIRRM

SEQ ID NO: 111005 - protein, 110 aa, Glycine max
  Coding DNA Sequence Number=SeqID_19320
  Subcellular localization annotation: CTP_CleavageSite=55; ConfidenceScore=5.02e-01
GGLRSLLSLRPSIPFKLDPALRLVTLFAHLLKDSLAPRSIRSEPGLRTFSHRFLSPSHRQQSALIPWCGVKGRVPFLSCPKTCFILIGERLSRGKVLHIGPAALSRLPSV

SEQ ID NO: 111006 - protein, 355 aa, Glycine max
  Coding DNA Sequence Number=SeqID_19321
  Homolog annotation: Hit_ID=Q6WAY6; Match level="QueryCoverage=97%, HitCoverage=55%, E-value=7e-15, Identity=24%"; Hit description =Putative uncharacterized protein
MLADLYDTFDRRCEKSSTRIVCYTPALYVWLVLNLFRREVRHACPLESHYSYTEKGGASWDQLLANKEEASVNWFPRWKEGRTGVLISCGGFPSVPLMGMRGCISYNPVLAIRQIGYPIRGAPLEEELALVISQGFNKINMETLQKVCKAWEVLQKKDKELRGSNNGPIGGYRKWLKAHVQGLDWLPSLRTAKREEDEAPEEDEEVQALRMELKQAQTVKERFKSAALKIRKENAELRDINIATTKAWGGETKRARREEHGRNKFRGALWGSNSELKLGKEERDQSQVDSLILKDELKACSRSKRSLSQRLCETETNMLAIITKYQEELSLATTHEHRVADEYAQVYAKKEARGR

SEQ ID NO: 111007 - protein, 49 aa, Glycine max
  Coding DNA Sequence Number=SeqID_19322
MAPKTCSLPASAPDRTNSSCWTKLGQDRIKTNIQQLGYRTPIPPDSTTN

SEQ ID NO: 111008 - protein, 202 aa, Glycine max
  Coding DNA Sequence Number=SeqID_19323
LRSYPREIEASLCIPGKGFILNTEGQPWKLLKKDLTTLAQTWSVFSYLNLAHTSHTSDLSTDRARLVYGLITRMDMNIGGLISGQMIMMAQSNPSRLGFPALITAFCRSRGVGSDALTSYENLRPAIDLAYIIKSCWNANDQTVKFPEAWKTKLRAADAPSSFAPITDIPASSTSAPLLALADLFAQSSQTSDAKLQSLFEG

SEQ ID NO: 111009 - protein, 100 aa, Glycine max
  Coding DNA Sequence Number=SeqID_19324
MIMRSQDIYSSQDEATTSPSSSESEEAKGEESSEEIYPQEEGRPLMVKEECKEFQYNLGTHMGHLGVEEKSPAFQEPRDLRSNPFQGGENDAILPRKGIG

SEQ ID NO: 111010 - protein, 103 aa, Glycine max
  Coding DNA Sequence Number=SeqID_19325
MTTFKVPNKTLTILREKLPKIITHKWKFGNLLEAPNTLPMKGLFGIKFESNEAFLSPIALKVVGPCFLTQILQAYMATHKQRNKETSNNQRPKNKIKVKPIDF

SEQ ID NO: 111011 - protein, 139 aa, Glycine max
  Coding DNA Sequence Number=SeqID_19326
MDDEEGVQEQMKADLSALKDQMVSITEAMLKLQKTLEDNATATASNAVREAEPVLQPTINLGQDRNPTLFGRRYSPQAYPYGLPPDFTPPAVPEDVSQAPTFEGQLPPYADYPLQEDDEEDTHLGPLLPLKDPSPHELP

SEQ ID NO: 111012 - protein, 196 aa, Glycine max
  Coding DNA Sequence Number=SeqID_19327
MTTLTQIWMTLLLNNIQPSDHNSDLPLPKCQLVYAILTRMSIHVAQLIADAIYLFAGMAPTRHPLDPDKSNRALRFLALITGLCQSFGVPIAPSKAADALPPHQAGPAGSFDTEQYLRHLVRQQVANHRAHLQSQGFTSFLCLTPDQYRAEVAWPRDWLEARAGEAPAEAPDEADEAREDEEMTDLLDFLGGSGAT

SEQ ID NO: 111013 - protein, 252 aa, Glycine max
  Coding DNA Sequence Number=SeqID_19328
  Gene Ontology: Mol. function=sugar:hydrogen symporter activity; Cellular component=periplasmic space; Biological process =carbohydrate transport
  Homolog annotation: Hit_ID=A8GC27; Match level="QueryCoverage=100%, HitCoverage=76%, E-value=1e-123, Identity=88%"; Hit description =Periplasmic binding protein/LacI transcriptional regulator precursor
  Pfam annotation: Domain name=Peripla_BP_1; Domain location=10-249; Score=-51.9; E_value=0.014; Accession=PF00532.12; Description =Periplasmic binding proteins and sugar
MMFGAAAHADTRIGVTIYKYDDNFMSVVRKAIEKDAKASPDVTLLMNDSQNDQSKQNDQIDVLLAKGVKALAINLVDPAAAPVVIDKARANDIPVVFYNKEPSRKALDSYEKAYYVGTDSKESGVIQGELIAKHWQANPAWDLNKDGQIQFVLLKGEPGHPDAEARTTYVVKTLNEKGIKTQQLQMDTAMWDTAQAKDKMDAWLSGPNANKIEVVIANNDAMAMGAVEALKAHNKTTIPVFGVDALPEALAL

SEQ ID NO: 111014 - protein, 85 aa, Glycine max
  Coding DNA Sequence Number=SeqID_19329
  Subcellular localization annotation: CTP_CleavageSite=33; ConfidenceScore=5.06e-01
ALLFKETSPIVSTKVSHPSLSRCLLPKERIGLSAAQNQPNLFMVTSPYATLFVLLHVPYGIQIQSSLLPMIEVKIRNVCFPYSNK

SEQ ID NO: 111015 - protein, 44 aa, Glycine max
  Coding DNA Sequence Number=SeqID_19330
MASFSQLQSQMQSQGPPEPLVGPGPFGPRETILRRVTLTGAACT

SEQ ID NO: 111016 - protein, 80 aa, Glycine max
  Coding DNA Sequence Number=SeqID_19331
MFLTPPWLEYFEFEAEIFSEFSRHLEKNRRKNPTKDQAECFDDAKGLHVSQRLPKGYMFLKALFKTKKSKIFKMDDQDSF

SEQ ID NO: 111017 - protein, 264 aa, Glycine max
  Coding DNA Sequence Number=SeqID_19332
MASRKRKATSTPTQEVERCHWVEELTDFADGNIDVAIVKEFYANLYDPEDKSLKQTPVIVEEGESLCAYSRFALLRPDPQELAAKLYIPGRGFELNVDGYPMKILRKNMTTLAQTWSVLSFSNLIPTSHTSDVTLDRAIPIYGIIMKMDMNVGYLISHQISLIAQHDTFRLGFPALITALCKARGVQSDLRSLESLSPAINLAYIKKNCWNLDDPTVTFRGPRKARGKRSEAPSTSASETGGPSSSTLPPSSSTKILVIPPTPS

SEQ ID NO: 111018 - protein, 76 aa, Glycine max
  Coding DNA Sequence Number=SeqID_19333
MQKKQEECRGKVYKAQAQKSLTHREGIAKVRVSSSGLTQSSAKHTSTKSKVVRICRLAHPVAKPNHVVEILNKSGA

SEQ ID NO: 111019 - protein, 82 aa, Glycine max
  Coding DNA Sequence Number=SeqID_19334
  Subcellular localization annotation: CTP_CleavageSite=72; ConfidenceScore=5.09e-01
MRVQIGTRPSWAFQDVPPEGGCFWRKQPSSPGRAGWQASPSFSINRGRREEQKCSNLLVSENHLKLVRKIVSVKKIQVEALP

SEQ ID NO: 111020 - protein, 96 aa, Glycine max
  Coding DNA Sequence Number=SeqID_19335
MPAKVVVYEDPLSMKGSGVVYTRGRVLNPSLQPPTPFYSQNRGGGCARLSQASYCFLQKVPDGPRWNDAILPPQGHWIEDSKKIGPKMQEKALGFS

SEQ ID NO: 111021 - protein, 135 aa, Glycine max
  Coding DNA Sequence Number=SeqID_19336
  Pfam annotation: Domain name=Transposase_23; Domain location=46-114; Score=-16.6; E_value=0.077; Accession=PF03017.5; Description =TNP1ENSPM transposase
  Subcellular localization annotation: CTP_CleavageSite=29; ConfidenceScore=5.13e-01
MASFSQLQSQMQSQGPPEPLVGPGPSGPRVSTKGSCVDPSGNDPETGDSDRCGLYIEADPACLVAVGRVYEGSTLVHNTPLLPGQVKVSVDEVKDAHAAVPIPTAEVRWDATVFGVVNPDFPLYIKHEDLFEIAH

SEQ ID NO: 111022 - protein, 69 aa, Glycine max
  Coding DNA Sequence Number=SeqID_19337
MLTTFSTRHVRSFYGGSGRQRRRREGRHHPLGNKPWKKELHHQECALDKKLEEDALMEKKKERRGEPRN

SEQ ID NO: 111023 - protein, 156 aa, Glycine max
  Coding DNA Sequence Number=SeqID_19338
  Homolog annotation: Hit_ID=A2Q377; Match level="QueryCoverage=78%, HitCoverage=22%, E-value=2e-07, Identity=29%"; Hit description =Nucleic acid-binding, OB-fold
IPPGSYPASVSNSFKASKLLINDPILEIQEFKERLLDLGFEVSPVLLPGDQASSQVLGGSQLSSKDSFLSKAEVKSISKINDIFEDVVCVTVGIISKIVMDNHSWCYPACLQCHRKTDIQTGPFTCGCGKDNDQPDRECAELIGQTADDVNRVKIE

SEQ ID NO: 111024 - protein, 60 aa, Glycine max
  Coding DNA Sequence Number=SeqID_19339
CFISKRPFRGNTGSNKIEENHSKCINLTQRVSSSTVSDPSFLGDPTVPSSEGKDGNSHPG

SEQ ID NO: 111025 - protein, 128 aa, Glycine max
  Coding DNA Sequence Number=SeqID_19340
FPESLILDSYRFILLARSDALAGFDQVFGAIAGELLSIWKESAMYNHHEKGRAPDLESVLANFMTYQASSKEGSSNLDDLLMQFKGTIDSMQQAFKRAKTQIGKLVDDMTKVMTRREEEYAEIKAHQE

SEQ ID NO: 111026 - protein, 165 aa, Glycine max
  Coding DNA Sequence Number=SeqID_19341
  Pfam annotation: Domain name=Transposase_23; Domain location=51-121; Score=-4.3; E_value=0.0035; Accession=PF03017.5; Description =TNP1ENSPM transposase
  Subcellular localization annotation: CTP_CleavageSite=34; ConfidenceScore=5.27e-01
MASFSHMQSQLQSQMQSQGLVVPPEPLVGPSGPRVSTKGSCVDPSGNDPETGDSDRCDLYIEADPARLVAIGRDYEGSTVVHNTPLLSGQVKVSVEEVTDADAPVPVPTDEVSIVRQTLHTFLAWPTHLVAVSPAKPPLKPDPEVDDPLYLMTLTILELFLRPYQ

SEQ ID NO: 111027 - protein, 81 aa, Glycine max
  Coding DNA Sequence Number=SeqID_19342
MTQMQFANTRAREIVSFLDTTFWGSKVPNGIKTEPTQDAYAKDGTQRVRFVPLFRGPIWEGAKKPLVIIPKVVISLLMVSR

SEQ ID NO: 111028 - protein, 214 aa, Glycine max
  Coding DNA Sequence Number=SeqID_19343
MERSMIDAASGGALGDMTPAEARNLIEKMASNSQQFSTRNDAIVIRGVHEVATNPSASSETKKLEGKLDALVNLVTQLALNQKSVPVARQPGAIEQPEAYAANIYNRPPQPQQQNQPQQSNYDLSSNKYNPGWRNHPNLRWSSPQQQQQQPAPSFQNATGPSRPYIPPPIQQQQQPQKQPTVEAPPQPSLEELVRQMTMQNMQFHKRPEPPFKA

SEQ ID NO: 111029 - protein, 162 aa, Glycine max
  Coding DNA Sequence Number=SeqID_19344
MNLNESIQDMQKRFTRIVNHHASIGKIFPNEDLVNKEHEMELMRLNQHEENDKKKKVTALKASSSIQEESDKEDSIEIDEDDDLSLFKRIEKSEKKGFNEKKAKKAYITWDDNDMDSSENSENEVVNLSLMAKSYESNEEVTSSNNNLSISFDELQMHLPIT

SEQ ID NO: 111030 - protein, 175 aa, Glycine max
  Coding DNA Sequence Number=SeqID_19345
MAPRKLFAKRSRKDAAAEGTCAAPEFDNHRFRSAEHQQRFEAIKGWSFHRERRVQLRDDEYTDFQEEIARRHWTSLVIPMAKFDPDVVLEFYANAWPTEEGMRSWVRGQWIPFDADALSQFLGDPLVLEECQECEYSQRRNRADGFDEEAIAQLLCIPGQDFARTGSANSIGDIL

SEQ ID NO: 111031 - protein, 228 aa, Glycine max
  Coding DNA Sequence Number=SeqID_19346
ICAPGYGGHGFLSTVLGLPPDIGGRPTVRAHPERKAITHQLCIPGQDFTRAAAKRRVWIMRTNMTTFTWIWMTLLFSNILPGDHNANLPLQMYRLGSRPQDAQWARRSPTGPWGFQLWLWASVVLQGARFTPADGSGSRLQDTQWTRRSPTGSWSCQALITGLCQFYRVPVTSSKGIRPPTNRAFIKKYCVPRQAQGEIPQQPGDGRQRATDAPPSPLEFASAHPQKG

SEQ ID NO: 111032 - protein, 89 aa, Glycine max
  Coding DNA Sequence Number=SeqID_19347
MILHEIRRPNSLKSVPSGVSDCRNLPFGGRATRDSRVRLPWEKNAQSRHQCLFEENVGKTGKSTRVFTLLLRILNGNQTYVVLLELNVG

SEQ ID NO: 111033 - protein, 215 aa, Glycine max
  Coding DNA Sequence Number=SeqID_19348
  Homolog annotation: Hit_ID=A2Q5X7; Match level="QueryCoverage=66%, HitCoverage=17%, E-value=1e-09, Identity=29%"; Hit description =Ovarian tumour, otubain, putative
VESAHWSLKRLLQNSVGDICSVWEAMNNMMTLQHTQIKASFETSTHVVGHVFKVTLFKKILGMVSRQKSFTLWICHEEYPRYFMCIFSDQGLCGTQVTITEEMETISKRFEQLDVFGKVHLKSKLQEIAYPGMNSMCPPPEKDSIENIIDVKADGNYGYQAIAVLLGMGEKSWSLVRNHLHKELTSWSEEYINLVGGIQRFEELKLSLYVDGLTM

SEQ ID NO: 111034 - protein, 84 aa, Glycine max
  Coding DNA Sequence Number=SeqID_19349
  Subcellular localization annotation: CTP_CleavageSite=37; ConfidenceScore=5.00e-01
MTIDSPPLLRFPWIRARLTGASSKGGKCMESPPTFICGNRRKNRRKPVIKNIPDSGVVFTFEEGRQKRGSCSYAPSIEEEIRPT

SEQ ID NO: 111035 - protein, 141 aa, Glycine max
  Coding DNA Sequence Number=SeqID_19350
  Homolog annotation: Hit_ID=A5BP71; Match level="QueryCoverage=53%, HitCoverage=19%, E-value=1e-12, Identity=48%"; Hit description =Putative uncharacterized protein
  Pfam annotation: Domain name=zf-CCHC; Domain location=114-131; Score =19.9; E_value=0.0015; Accession=PF00098.14; Description=Zinc knuckle
MKAKYIVQSLLKNLEKIKNKLVRTSFACMTSTPQACGYVSVNYYQYIDVVYTNEHILKAYSAQWWPLGNEAAIPPSNDAWTLIPDPTTIRAKGRPKSTRIRNEMDWVEPSEHRIKCSRCGAEGHNRRRCPMQSERGSCSNH

SEQ ID NO: 111036 - protein, 50 aa, Glycine max
  Coding DNA Sequence Number=SeqID_19351
QFRAEVAWPEDWSEAQAWEALAEAPGDAEEVHMDEEMTDLLSFLGGSGAT

SEQ ID NO: 111037 - protein, 98 aa, Glycine max
  Coding DNA Sequence Number=SeqID_19352
MAEDVPQLPEDVPQLDEDVPDASDGSPDRIGAADGAESDGVASDGTAADDEGFPGGPRDPSVLIGFVDHVAHSIWRGQRPDLKLVSHARKVDNLGDRL

SEQ ID NO: 111038 - protein, 135 aa, Glycine max
  Coding DNA Sequence Number=SeqID_19353
MSNHKSTESALKNLEVQVGQLAKQIADKSSNSFVANTENNPKEECKVVMTRSKRFVEAEDEESVVHKKKAVEKKEKSRSDKAINEGKEVPYPVVPSKKEKDHHLARFLDIFKKLEITMPSGEALQQMLLDKVASE

SEQ ID NO: 111039 - protein, 133 aa, Glycine max
  Coding DNA Sequence Number=SeqID_19354
MTSRKRARTDDIPSSSILAPQLSAIGPDVQHSQTLVSMLQSLFKGQLLIMYSLQELAHNRPIIPMEHFLEQLEVVPPSPPLIIISDASSNEIVAPPDSPVGETLDPPNSLVGGIIDLSDSSSGEAVALTDSLV

SEQ ID NO: 111040 - protein, 102 aa, Glycine max
  Coding DNA Sequence Number=SeqID_19355
DKQGVKGPAKLVHWSEPDDDPLYQMALTFPKLFLKPMQVSWDSTVFGVYNDEIPLYIKHEDISEIAHVGQCLNIFVIQIWILHMNELSLQSDNAYVYGFLEP

SEQ ID NO: 111041 - protein, 74 aa, Glycine max
  Coding DNA Sequence Number=SeqID_19356
GGRMNENAIHGAPKKGFEMENCTKQSLRMAPNSKGSKLEGGGHMNENCNSWGSEKGLRKENCTKQSLRIAPNSK

SEQ ID NO: 111042 - protein, 25 aa, Glycine max
  Coding DNA Sequence Number=SeqID_19357
MTLVSTPSFFLHIKLIDTVDLEGGP

SEQ ID NO: 111043 - protein, 139 aa, Glycine max
  Coding DNA Sequence Number=SeqID_19358
MARRDQVWSFCTHDTRRYLTVICTPIARQTQLCPMARRDQVWSFCTHDTRRYLTVICTPLLGRHSCVRWHAETKFGHSAPMIRGDTLRHSCVRWHAETKFGHSAPMIRGDTLRYLHPFARQTQLCPMATQRPRLVILHP

SEQ ID NO: 111044 - protein, 166 aa, Glycine max
  Coding DNA Sequence Number=SeqID_19359
  Subcellular localization annotation: CTP_CleavageSite=48; ConfidenceScore=5.24e-01
MSQNFMDYATIPSLTSGMLRNFTDCTTMLPSTFGMLRNITDCLMMGVKYSKRSSEGCMPPNKWSPDEIRGQWRTHPSNQFNRDHGRPSNRPQQQGTSLYDRMTKLEETLAQFMQVSMSNQKSTESTIKNLEVQVEQWAKQLADRSSRSFGANTEKNPKGGVQGCYD

SEQ ID NO: 111045 - protein, 15 aa, Glycine max
  Coding DNA Sequence Number=SeqID_19360
MQYLGSDPRSSPKEQ

SEQ ID NO: 111046 - protein, 32 aa, Glycine max
  Coding DNA Sequence Number=SeqID_19361
MQGPEDDSVSCLCQPVSLRMFDRGFIILGLLD

SEQ ID NO: 111047 - protein, 65 aa, Glycine max
  Coding DNA Sequence Number=SeqID_19362
SGGANTIPLRVMQLSPVILVTLADSKQMLVAPSFLSLGGAYLHGTAWLFLYGNGIGPTTEGCRGV

SEQ ID NO: 111048 - protein, 78 aa, Glycine max
  Coding DNA Sequence Number=SeqID_19363
MPFVDEKIKKGYRKFGVAEAEAATFEVTEKKKQRLEWERLLILNFSRNPSSVVVNDLFFSISMTCSYGTEIENIKNKK

SEQ ID NO: 111049 - protein, 87 aa, Glycine max
  Coding DNA Sequence Number=SeqID_19364
QQQSLQRQQATEAPPQPFIEELVRQMTIQNMQFQQKTRASIQSLTNQIGSGNQIQVPPPVATPAPEPVKLYSTPEKEDEIVAQKRAS

SEQ ID NO: 111050 - protein, 108 aa, Glycine max
  Coding DNA Sequence Number=SeqID_19365
MGEVEEVQEQMKADTEALKEKMATMMEAMMSIKEIMEVSAAYRTRARARVMGEVQDVQEKMKADMEAMKEKMATMVEAMMIMKKIMEANTVAVATTSTVAKVNPDAPI

SEQ ID NO: 111051 - protein, 692 aa, Glycine max
  Coding DNA Sequence Number=SeqID_19366
  Gene Ontology: Mol. function=acyl-CoA reductase activity; Biological process=bioluminescence
  Homolog annotation: Hit_ID=A1TVR5; Match level="QueryCoverage=40%, HitCoverage=56%, E-value=4e-91, Identity=60%"; Hit description =Putative acyl-CoA reductase
  Pfam annotation: Domain name=LuxC; Domain location=468-691; Score= -85.8; E_value=0.00024; Accession=PF05893.5; Description=Acyl-CoA reductase (LuxC)
  Subcellular localization annotation: CTP_CleavageSite=41; ConfidenceScore=5.03e-01
MGTGFDDMSAESHPFHPQRAAAGAAPSPVAERHHARRRFCRHAHRMRGVLRLPALTCPPFRPQNAACSKGCPGCGTGVTARPHSLFAPFCEFCAFTQPLAGRYAAVQRGHLHDRSVNHRRAAGVYAARRNHGSGFQPAGATAVRVAIRTQSSLRPLRPPARPHAADGKTVAADSGGADYGLSPDAGGLRSLDADQFPPALYGRISAPADGDPVSTQQRAAQLFAGPLSDAGDARMWHARQRSDGGCAGAETAASDRRAGAGAGQRPTLCPAGCQLQFCPPAGRTGASAAAFQAAAGQPHPRHRGALQQTLGVPRSHCINMYGMTELSTQFYDAGNEICPPVKSGPHWIRTRVVNPLTGADVPEGETGVLVHHDLAHFNSVSSILTEDAGVMVPGGLLAGDGIVSRCRAGADMKVYAGHLPGIRHSEMAWHSLHFGQQGSALEVCVPVLSEAQIATLAASVRDNARRYLHTLSVARITALIDEAIARLLDRSHPLRQQAERLLPLVTGYDAEMLRLGLTGYLKTFREPQLRRFLAEDFGNVQMLDDFQPRPKGGFARAFGPQLLLQVWAGNVPGLPLWSLIAGLLVKAGSVGKVASAEPLMAGWFAQLLAEIDPQLGECLAVVWWQGGDERTEQQWFREADVVMAYGGEAALMAMQRRLPPATRFLPHGHKISFGMVARSALDVRRGTALARQ

SEQ ID NO: 111052 - protein, 71 aa, Glycine max
  Coding DNA Sequence Number=SeqID_19367
MEKCTKHSLHMASTLMGGGRMNEKRNSWGSEKGWRMHERKRNSWCSEKGLRMENCTKQSLRMTPNSWVEDA

SEQ ID NO: 111053 - protein, 222 aa, Glycine max
  Coding DNA Sequence Number=SeqID_19368
MTLSAGREHDAYRPMRIHEGVEEIIAREQRVIAIGNQHGGFDLHSRVDRRDANLQQRKEGHVELGHVAELYQCGLATVQPLRLKCGREVVHRLIKVTIGDTPIAVDNRHGIAVRMVRQDVGQRQILPVAFFSVATGKILRPAGKGNGHQSSLVQTKHVEHGGKLHTGFTPFAHRRGGRHNARASKQANGIFMQPRAADGHHPLAVPFAVAPADDAAEQLAIK

SEQ ID NO: 111054 - protein, 71 aa, Glycine max
  Coding DNA Sequence Number=SeqID_19369
MEALEQFKWRMISRRSKFNNGSSRAIQMVHNFSLGCPIQAHNISRRSKLNNGSSRNSNGHNFSLRGRIQAL

SEQ ID NO: 111055 - protein, 169 aa, Glycine max
  Coding DNA Sequence Number=SeqID_19370
  Subcellular localization annotation: CTP_CleavageSite=9; ConfidenceScore=5.05e-01
GSQPQRHPVDLKKSNRALGFLALVTGLCRPYRAPVPPSKFMSSWHRDCARKTPSGPEEGQQGLGVASSKYGSLKVIRPPYQSSFHQEVLRPQAGAGRNTTSALGWPVVGNRRTAITSRVHLCSSTKRFEYCLHHMADCRNLPFGGRATRDSRDACSTKGIRAESPPTFI

SEQ ID NO: 111056 - protein, 157 aa, Glycine max
  Coding DNA Sequence Number=SeqID_19371
  Homolog annotation: Hit_ID=A6FJQ2; Match level="QueryCoverage=24%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPTRTCQKKHPLGLTLGAFRLILLKDGSVLFAKRYRARIRNHGHSCFLCEIVIRSQFHTTYEPEA

SEQ ID NO: 111057 - protein, 79 aa, Glycine max
  Coding DNA Sequence Number=SeqID_19372
  Gene Ontology: Mol. function=transporter activity; Cellular component= outer membrane-bounded periplasmic space; Biological process=transport
  Homolog annotation: Hit_ID=A4WAB6; Match level="QueryCoverage=97%, HitCoverage=34%, E-value=8e-23, Identity=64%"; Hit description =Extracellular solute-binding protein, family 3 precursor
MVAGRLDGTLVMSAAGFAFAGKPVEDDTILGSGIGFGLRKGDSKLKGELDAAIAKVQADGTVTKLAAKFFPGIDVSVSK

SEQ ID NO: 111058 - protein, 199 aa, Glycine max
  Coding DNA Sequence Number=SeqID_19373
  Gene Ontology: Mol. function=oxidoreductase activity, acting on NADH or NADPH, NAD or NADP as acceptor; Biological process=electron transport
  Homolog annotation: Hit_ID=Q5PHS8; Match level="QueryCoverage=100%, HitCoverage=100%, E-value=1e-88, Identity=81%"; Hit description=FMN -dependent NADH-azoreductase
  Pfam annotation: Domain name=FMN_red; Domain location=2-198; Score= -23.6; E_value=0.002; Accession=PF03358.6; Description=NADPH -dependent FMN reductase
  Pfam annotation: Domain name=Flavodoxin_2; Domain location=2-194; Score=210.9; E_value=3.1e-60; Accession=PF02525.8; Description =Flavodoxin-like fold
  Pfam module annotation: Pfam domain module=FMN_red::Flavodoxin_2; Domain location=2-198::2-194
MSKVLVLKSSILAGYSQSNQLADFYADEARAKGDEVTVRDLAAQPIPVLDGELVGALRPSDAPLSPRQQDALALSDELIAELQAHDTVVIAAPMYNFNIPTQLKNYFDLIARAGVTFRYTEAGPEGLVKGKRAVILSSRGGIHKDTPTDLLTPYVKLFLGFIGITDVDFVFAEGIAYGPEVATKAASDAKNAIKQIVAA

SEQ ID NO: 111059 - protein, 165 aa, Glycine max
  Coding DNA Sequence Number=SeqID_19374
  Gene Ontology: Mol. function=hydrolase activity
  Homolog annotation: Hit_ID=Q6D5P6; Match level="QueryCoverage=78%, HitCoverage=41%, E-value=1e-62, Identity=84%"; Hit description =Putative uncharacterized protein
MKGMPPKLMSDDGKHIVIRPLAYCREKDIVRFAEARQYPIIPCNLCGSQPNLQRQVVADMLRDWDKRYPGRIETMFSAMQNIVPSHMADINLFDFKGIKHGDAVVDGGDIGFDRESLPAQPVGWQADEDDQPDLSARLDDRAAAQARESAAVAARVRESVADRSG

SEQ ID NO: 111060 - protein, 627 aa, Glycine max
  Coding DNA Sequence Number=SeqID_19375
  Gene Ontology: Mol. function=transferase activity, transferring acyl groups, acyl groups converted into alkyl on transfer; Cellular component=mitochondrion; Biological process=carboxylic acid metabolic process
  Homolog annotation: Hit_ID=A8GCY8; Match level="QueryCoverage=56%, HitCoverage=63%, E-value=1e-152, Identity=73%"; Hit description=2 -isopropylmalate synthase
  Pfam annotation: Domain name=HMGL-like; Domain location=311-589; Score=307.3; E_value=3e-89; Accession=PF00682.10; Description=HMGL -like
  Pfam annotation: Domain name=Sigma54_activat; Domain location=1-148; Score=162.3; E_value=1.3e-45; Accession=PF00158.17; Description =Sigma-54 interaction domain
  Pfam module annotation: Pfam domain module=HMGL-like::Sigma54 _activat; Domain location=311-589::1-148
GAFTGAQKRHLGRFERADGGTLFLDELATAPMLVQEKLLRVIEYGQLERVGGNQSLQVNVRLVCATNEDLPALAAAGRFRADLLDRLAFDVVQLPPLRERRSDILVMAEHFAIQMCRELGLALFPGFSERAQLTLLQHSWPGNVRELKNVVERSVYRHHSTEQALDTIIINPFAPRSAPAVTEPAAEQRENALPALPLDLRQWQNQQECALVEASLQQARYNQRRAAELLRTGITEGVALRQLSVLHAGLSAMREPRPAGYCRLQADLKETPMLTQPAEKYRPWPVINLADRQWPSRHITRTPRWLSTDLRDGNQALATPMDSARKLAFWQLLLRCGFKEIEVAFPAASQTDFDFVRLLIEQQHIPHDVTIQVLTQARGDLIDRTFAALRDAPQAIIHLYNATAPLFRERVFRQSKAEIVELACAAARQIRARCAAQPATRWTFQYSPETFCFTEPEFALEICEAVAAIWQPGPQRPMIINLPATVEVNTPNVYADQIEYFCRHFSQRSQVAISVHPHNDRGTGIACAELALLAGADRVEGCLFGNGERTGNVDLVTLALNLYTQGVTPELDFSDMREVLEVVTRCNQLPVHPRHPYAGELVFTAFSGSHQDAIRKGFAERSARNEV

SEQ ID NO: 111061 - protein, 102 aa, Glycine max
  Coding DNA Sequence Number=SeqID_19376
  Gene Ontology: Mol. function=siderophore-iron transmembrane transporter activity; Cellular component=cell outer membrane; Biological process=siderophore transport
  Homolog annotation: Hit_ID=A8GFY7; Match level="QueryCoverage=94%, HitCoverage=13%, E-value=2e-34, Identity=75%"; Hit description=TonB -dependent receptor precursor
MHYVPPVAAFETPTLNELSYRAADQAGLNLNLQPATSNTVELGSKKRLGNGLLTAALFQTDTKNEIVSDSSYEGRTSYKNAGETRRRGLELGLDQQFAMTGT

SEQ ID NO: 111062 - protein, 428 aa, Glycine max
  Coding DNA Sequence Number=SeqID_19377
ENIENRAGSTSPGGKRSVQQREDFLSGAGFAEAREAALNAVVVGFSVQAAHCLSRQRDATLLLQLLMQLLMQVVIVVVNACTRGRESECGKTAFKEYSKFASGTFAGMTGGTLGASAGIGICFAVGIATAGAGGVACAAVGSLVAGSAASSATQHPVAPDSLQGAAKIRAGSASPGGKRSVQQREDFVSGAGFAEAREDALNAVVVGFSVQAAHRIGRQRNVVAQLVRLTRRGFHADTGGNPAHHHLRHATLLQLLVQIGIVERAPAPPSLPAEQHRDAAADCGPARRPPRSPAPPAAVSRETPASMTIRAVWASNVVTAMAADTVQQPVVTLGAIAGDELQAGSGRLITGFAAILRIGHALYQAQRLQAGDRSTHRLAAHPFARGQLGHCHCAVAHQIPQHGNLRPGEIARRGRFTQAAHQFAIDAA

SEQ ID NO: 111063 - protein, 797 aa, Glycine max
  Coding DNA Sequence Number=SeqID_19378
  Gene Ontology: Mol. function=cholinesterase activity; Cellular component=membrane; Biological process=signal transduction
  Homolog annotation: Hit_ID=A8AGI0; Match level="QueryCoverage=58%, HitCoverage=90%, E-value=1e-149, Identity=57%"; Hit description =Putative uncharacterized protein
  Pfam annotation: Domain name=Abhydrolase_3; Domain location=96-301; Score=-69.9; E_value=0.0042; Accession=PF07859.4; Description =alphabeta hydrolase fold
  Pfam annotation: Domain name=COesterase; Domain location=2-480; Score= 292.6; E_value=7.6e-85; Accession=PF00135.19; Description =Carboxylesterase
  Pfam annotation: Domain name=HAMP; Domain location=637-706; Score =32.7; E_value=1.3e-06; Accession=PF00672.16; Description=HAMP domain
  Pfam annotation: Domain name=Peptidase_S15; Domain location=76-300; Score=-105.4; E_value=0.021; Accession=PF02129.9; Description=X-Pro dipeptidyl-peptidase (S15 family)
  Pfam module annotation: Pfam domain module=Abhydrolase_3::COesterase:: HAMP::Peptidase_S15; Domain location=96-301::2-480::637-706::76-300
MTAEGELRGLMDDELFTFKGIPYAAPPVGALRWRPPQPVVPWQTLRDATAWGDASWQNRDYCVAAGGGDPGRFSEDCLYLNVWTPDVEPATPLPVMVWLHGGGFSIGAGSLDPYRGKALAAQGVVVVTLNYRLGHFGFFAHPALDAQYLPGKVVNNFALLDQIAALQWIQRNIPAFGGDRHNVTLFGESSGARSVLSLCCSPLAEGLFHKGIVQSAYSLPDVPHKQAQQTGLQVAAHFNLAADASAEQLRALPADSFWPLERPLALGPVAISGDAVLPRPMLDTFMAGKQHRVPLMIGSNSDEASVLDYFGVDARSVLQQLRSKSRLSYRLLKWLYDIHDDSLLGRAVARDMAFTVMPLLVAQSQHSIGMPAWRYWFDYVSENARHLYPHGTWHGNEIPYVFNTLATLPPPGDWYYSASDIAFAGRVSAWWVAFARDASEFSHRLRLDGEPDWPVWRPGEDLTLAFGHDGLFSVHSLNALGEGNEIDRQLVNQMTALSKGNDQYFRVVTRLSRVMEGRTAGNAPTAEAFAPVQQALDNMKQQLTQFKAMAPGPMDSETVNNVISSWQKLLDEGIAPQVALAQQASLDAWRAQANNVTPPLSRAFGASAEAFNQAASSKLDETRVTVDTLTSMTKVIIVSAVVFGLLILLFTDRYLVTMLVKPLDRIRNHFTVIAQGDLSQPVEEFGRNCVGKLVPLLRAMQDSLREAVSAIRSGTENIYRGAAEISAGNNDLSSRTEEQAAALEQTAASMEQLTATVKFNADNARQASALAETATGTAQQGGRLVGEVVTTMQGISG

SEQ ID NO: 111064 - protein, 91 aa, Glycine max
  Coding DNA Sequence Number=SeqID_19379
  Gene Ontology: Mol. function=NAD(P)+ transhydrogenase (AB-specific) activity; Cellular component=1-2nm peptidoglycan-based cell wall; Biological process=electron transport
  Homolog annotation: Hit_ID=P0AB69; Match level="QueryCoverage=100%, HitCoverage=19%, E-value=4e-43, Identity=93%"; Hit description =NAD(P) transhydrogenase subunit beta
  Pfam annotation: Domain name=PNTB; Domain location=1-91; Score= -280.0; E_value=0.00026; Accession=PF02233.7; Description=NAD(P) transhydrogenase beta subunit
MDEINDDFSDTDTVLVIGANDTVNPAAQDDPRSPIAGMPVLEVWKAQNVIVFKRSMNTGYAGVQNPLFFKENTQMLFGDAKASVEGILRAL

SEQ ID NO: 111065 - protein, 251 aa, Glycine max
  Coding DNA Sequence Number=SeqID_19380
  Gene Ontology: Mol. function=amino acid transmembrane transporter activity; Cellular component=integral to membrane; Biological process=amino acid transport
  Homolog annotation: Hit_ID=A4W9Z5; Match level="QueryCoverage=52%, HitCoverage=28%, E-value=2e-43, Identity=69%"; Hit description =Arginine/ornithine antiporter precursor
MAAVAGPAALLIGWLITGVGILFLSLAMLLLTRLRPELDGGIFTYARAGFGELTGFCSAWGYWLCAVIANVSYLVIVFSALSFFTDTPDRIVFGDGNTWQAMLGASVLLWLVHWLVLRGVQTAASINLLATLGKLVPLLLRGGGLRPRAAQKRCRACDAAGGAGRAAGLSAGNAAVAWRGAACGTGADAQSVDGRSDGTAAGSLGRCGDCGWPDYLGMRGLSQLDHYGGRSPVPRRAAGRVSAQHCPAKPP

SEQ ID NO: 111066 - protein, 156 aa, Glycine max
  Coding DNA Sequence Number=SeqID_19381
  Pfam annotation: Domain name=Asr; Domain location=113-129; Score=7.3; E_value=6.9; Accession=PF06392.2; Description=Acid shock protein repeat
  Pfam annotation: Domain name=Asr; Domain location=130-147; Score =12.0; E_value=0.87; Accession=PF06392.2; Description=Acid shock protein repeat
  Pfam annotation: Domain name=Asr; Domain location=38-57; Score=10.5; E_value=1.7; Accession=PF06392.2; Description=Acid shock protein repeat
  Pfam annotation: Domain name=Asr; Domain location=58-76; Score=10.2; E_value=1.9; Accession=PF06392.2; Description=Acid shock protein repeat
  Pfam annotation: Domain name=Asr; Domain location=77-94; Score=10.7; E_value=1.5; Accession=PF06392.2; Description=Acid shock protein repeat
  Pfam annotation: Domain name=Asr; Domain location=95-112; Score=10.7; E_value=1.5; Accession=PF06392.2; Description=Acid shock protein repeat
  Pfam module annotation: Pfam domain module=Asr::Asr::Asr::Asr::Asr::As r; Domain location=113-129::130-147::38-57::58-76::77-94::95-112
MKKLFALVIAAAMGLSSVAFAAETTTAAAAATTAAPAKHKAVHHKKAAAQKAQAAKKHKKVEKKAPAAQKAQAAKKHHKKATKPAAQKAQAAKKHHKKATKPAAQKAQAAKKHHKATKPAAQKAQAAKKHHKKVTKPAAQKAQAAKKHHKAKKAAK

SEQ ID NO: 111067 - protein, 58 aa, Glycine max
  Coding DNA Sequence Number=SeqID_19382
MTSPATGEFPTGNSDLQKQHIPLPFPPRSISNKIMEEAEKEILETFREVEVLCSQLVW

SEQ ID NO: 111068 - protein, 112 aa, Glycine max
  Coding DNA Sequence Number=SeqID_19383
MTKSKGKDPLEGLRGPMTRARARKAKEALQQVLSILFEYKPKFQGKKSKVDMIKSKGKDPLEGLGGPMTRARGRKAKEALQQVLSILFEYKPKFQGEKSKVVNCIMAQMEED

SEQ ID NO: 111069 - protein, 96 aa, Glycine max
  Coding DNA Sequence Number=SeqID_19384
ENDRAYPAQGVAAQIRTLLYKHEGCTELISIVQRAISGVSSGLFVNTGCIQWLLDLRTNTILVDFLPGLRDVVTSGTTSVIGIRISIGIRAGTQNH

SEQ ID NO: 111070 - protein, 121 aa, Glycine max
  Coding DNA Sequence Number=SeqID_19385
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLGSLWQLGQSITRRLAHGDKKAVARVPSSNS

SEQ ID NO: 111071 - protein, 98 aa, Glycine max
  Coding DNA Sequence Number=SeqID_19386
  Homolog annotation: Hit_ID=A5C6R1; Match level="QueryCoverage=100%, HitCoverage=15%, E-value=2e-17, Identity=39%"; Hit description =Putative uncharacterized protein
  Pfam annotation: Domain name=zf-CCHC; Domain location=22-38; Score =3.6; E_value=0.44; Accession=PF00098.14; Description=Zinc knuckle
  Pfam annotation: Domain name=zf-CCHC; Domain location=4-21; Score =20.1; E_value=0.0014; Accession=PF00098.14; Description=Zinc knuckle
  Pfam module annotation: Pfam domain module=zf-CCHC::zf-CCHC; Domain location=22-38::4-21
MSIVQCFYCKGHGHFASHCPKKFCNYCKKGHIIKECQIRPPRRNATAFTATNGSSTTPVYGDQNPPALGLSGGNNLPITAIGDISSYLTNVYVSPDLT

SEQ ID NO: 111072 - protein, 95 aa, Glycine max
  Coding DNA Sequence Number=SeqID_19387
MWTTTGTYKELKSLVLGTYPLKTEENEERTMDLEERLRIFAKIGEKLAAQLAQASKVASSRSNSLLEESSGGPKWAWLLFAPPFLLNAPPFSIFL

SEQ ID NO: 111073 - protein, 155 aa, Glycine max
  Coding DNA Sequence Number=SeqID_19388
  Subcellular localization annotation: CTP_CleavageSite=61; ConfidenceScore=5.09e-01
MGIPNRGFQGYNQGNSSGFHQGGAGFNHGPPGFNQGRNFTQGSGWRNQGNQYKEHRNQQPYQQPYQPPYQHPSQGPNQQEKPTNIKELLLQFIQETRSHQKSTNAAIRNLEVQMGQLAHDKAERPTITFGANTEKNPKEECKTVLTRGQKKAQEE

SEQ ID NO: 111074 - protein, 60 aa, Glycine max
  Coding DNA Sequence Number=SeqID_19389
MERIERIKKEEEERRGNEVEVLPNRDCDHSRHHSLFDVLRTIVGISLIIICTSIFFIYHR

SEQ ID NO: 111075 - protein, 341 aa, Glycine max
  Coding DNA Sequence Number=SeqID_19390
MAESPYTRFRLARQVKSRQRREFEAREEDEEVQALKSELGKAKLAKEKFKLAATHIRKECAGLREENATTARALEQEAKRARKEEYGRNKFHGALWGSNNELKLRREERDQSRVHSMVLKEELVACSRSKRSLSQRLCETETNMLAIIAKYQEELGLATAHEHRIADEYAQVYAEKEARGRVIDSLHQEATMWMDQFALTLNGSQELPRLLAKAKAMANTYSTPEEIHGLLGYWKNTITKRTTRHPYHTRSKSRTMGDQEETQEQMKADMSALKEQMASMMEAMLGMRQRMEKNAATAAAVSLAAEANPTLFATVHHPPLNIVGRGRDTLGHDGNPHLGYN

SEQ ID NO: 111076 - protein, 185 aa, Glycine max
  Coding DNA Sequence Number=SeqID_19391
MDAGLLTFQEDRPNVRTNPLARLICWGARKREVDSPGGRFLFAALPKSEIRELHDMETCLGVEELLQRMIDQGRLEVGGEGREEQHICMQSTDGSGVARPKPLVIYFTKGTASQKPGHPLAARPVPFPYQNSHAVPWRYTPSREKEEEATDVSSLSAKVTNITGLSGVTRSGRVFAPPDLQSSPR

SEQ ID NO: 111077 - protein, 152 aa, Glycine max
  Coding DNA Sequence Number=SeqID_19392
  Homolog annotation: Hit_ID=A6FJQ2; Match level="QueryCoverage=25%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVEKAAAFVIRISFANDSYLPAEIANGDEHVKASAIRAVCVLGALPLPRSLTRCARSFGCASGISSLKG

SEQ ID NO: 111078 - protein, 91 aa, Glycine max
  Coding DNA Sequence Number=SeqID_19393
MQLPETVTACLCVRRKYRIRRHSPFRLRNCWEGRSVRASSLLRQLAKGGCAARRLSWVTPGFSQSRRCKTTASAKLACLQVDSRGSPGYRS

SEQ ID NO: 111079 - protein, 232 aa, Glycine max
  Coding DNA Sequence Number=SeqID_19394
  Homolog annotation: Hit_ID=Q6WAY6; Match level="QueryCoverage=36%, HitCoverage=14%, E-value=8e-09, Identity=38%"; Hit description =Putative uncharacterized protein
MGTRGCINYNPMLAIRQLGYPMRGAPSEEIITSFIARGLNEANAKILQKIRKAWNRVGRKDKELRGSSNGVIDGYHKWLKSRTQGITWLPNLKSLSEKEVEIPEESEKVSNELKLRKVERDESRMESLVLEDKLKACQRSKRSLMEQLSKIEENMLIIIDQYKEKVNLAVSHGQMLEDEQAKLLHGEAMKWMNIFALTLNESQELPRLLARAKAVADTYSASDEVHGLFNFC

SEQ ID NO: 111080 - protein, 212 aa, Glycine max
  Coding DNA Sequence Number=SeqID_19395
MAPRKLSTKRSRKDAAAEETSAAPEFDNHRFRSAEHQQRFEAIKGWSFHRERRVQLRDDEYTDFQEEIARRRWTSLVTPMAKFDQDIVLEFYANAWPTEEGVRDMQSWVKGQWIPFDADALSQFLGYPLVLEEGQECEYSQRRNRADGFDEVAIAQLLCIPGQDFAWTAAGRRVRIMRTNMTTLTQTWMTLLLSNILPNDHNSDLPLPKCQL

SEQ ID NO: 111081 - protein, 134 aa, Glycine max
  Coding DNA Sequence Number=SeqID_19396
MEENSESALSTNKEAISNATRNLMESSILAQDERWRHCPYTCKSDGKWCFQWRTATLGLRHGPDSYGRQQWGIFRNGRKPDGPMPREAAAVRQRMQALSGMIGRKASVGGFLSSPSNPRAQPWTGGGNYQAGVR

SEQ ID NO: 111082 - protein, 149 aa, Glycine max
  Coding DNA Sequence Number=SeqID_19397
  Homolog annotation: Hit_ID=Q6VG41; Match level="QueryCoverage=64%, HitCoverage=20%, E-value=5e-07, Identity=32%"; Hit description=Gag polyprotein
  Pfam annotation: Domain name=zf-CCHC; Domain location=62-79; Score =20.6; E_value=0.0012; Accession=PF00098.14; Description=Zinc knuckle
  Pfam annotation: Domain name=zf-CCHC; Domain location=82-99; Score =25.3; E_value=0.00023; Accession=PF00098.14; Description=Zinc knuckle
  Pfam module annotation: Pfam domain module=zf-CCHC::zf-CCHC; Domain location=62-79::82-99
  Subcellular localization annotation: CTP_CleavageSite=45; ConfidenceScore=5.42e-01
MALVTNPFLGRISSKKNGPQHRGKSYSTPSKQYGNRPNNKRIIALGFAGGSGRKPATFSTQISCYKCGKLGHISSNFADKVMTCFNCRQKGHIQRDCSYPKKGQSGGGLNDQTRHPKTMERFFTLNGVKALKSKDLIQVSKDMMFISAN

SEQ ID NO: 111083 - protein, 53 aa, Glycine max
  Coding DNA Sequence Number=SeqID_19398
MHASGALSRMSPCCKSGALNGWLAKLADWLSEKLKINTSQTCLINLKLKGNDY

SEQ ID NO: 111084 - protein, 312 aa, Glycine max
  Coding DNA Sequence Number=SeqID_19399
TCKRNLKDSGTLKRVAWGLDVGTRVWPNQKIVPENNVVLYYTEFGEFTEELEHWNWHKELTNFMDGSIDVAIVKEFYANLYDPEDKSPKQVKVRGHLVMFDANTLNTFLKTPVIIEEGEELPTYSRFALLRPDPQELAAKLCIPGKGFELNADGLPLKIPRKNLKTLALTSHTSDITLDRAKKMLDFPALITALCKARGVTSDSLTLESLGLAINVAYVKKYCWNLDDPTVTFRGPRKAMGKRSEVLPSFEIPPSAAPSSSNIPPIPTSAPTFLPAPSVPVPPIGSSSFTSETIFSMLQSLHRGQIIIIQRL

SEQ ID NO: 111085 - protein, 101 aa, Glycine max
  Coding DNA Sequence Number=SeqID_19400
QLPLVRTNEAAPSEPAPAGVEPMPAEPQNLVVNPPPSPELEVVLPSPPLIIISDASLDEAVAFPNTPVEETTDPPASPIRGIANLSNSSSGEAVALTDSPV

SEQ ID NO: 111086 - protein, 137 aa, Glycine max
  Coding DNA Sequence Number=SeqID_19401
  Gene Ontology: Mol. function=peptidase activity
  Homolog annotation: Hit_ID=A5C7C5; Match level="QueryCoverage=62%, HitCoverage=13%, E-value=5e-12, Identity=37%"; Hit description =Putative uncharacterized protein
  Subcellular localization annotation: CTP_CleavageSite=20; ConfidenceScore=5.12e-01
MPSTSQGPKKGRMSSSRGPRTKLGTCKKNLQDSGTLKRVAWGLDVGIRKTRMQIFIEAIDLNIWEAIEQGPYVPSIIAGSATIEKPRADWTEEERRLVQYNLKAKNIITSALGIDEYFRVSNCKSAKGYVGYTTSNT

SEQ ID NO: 111087 - protein, 111 aa, Glycine max
  Coding DNA Sequence Number=SeqID_19402
  Subcellular localization annotation: CTP_CleavageSite=73; ConfidenceScore=5.76e-01
VLQWLLFLSAVPPVQLLTGVVRNGKSTARTSALASVAVTLRVTTTPAALNAPLQGASHSPFRLRNCWEGRSVRASSLLRQLAKGGCAARRLSWVTPGFSQSRRCKTTASEL

SEQ ID NO: 111088 - protein, 114 aa, Glycine max
  Coding DNA Sequence Number=SeqID_19403
TKRCRPGPRLRARSAAPGALASGAGRVWEPGRRGRWADPSGPALRVSGDARTAPRAGRRPAWLPASATGSCGRRRDSPPMALPPAGTPARWTANPATTGRGRAAPRRPGRGDGR

SEQ ID NO: 111089 - protein, 68 aa, Glycine max
  Coding DNA Sequence Number=SeqID_19404
MAEKTKKRLDEVAQSGSTKGVIDRPSPIRRHVKWKMARTKKSGQTTSEAAKKIAEKIVSQGSFVPQGR

SEQ ID NO: 111090 - protein, 80 aa, Glycine max
  Coding DNA Sequence Number=SeqID_19405
MKKNYTTWIWHGEVTDMQSGSQSEPFDVEMGDRLEDMIRDLGQECFQEAHALVPGMGGVDKVSPHYLSSAQSAFRGQHTA

SEQ ID NO: 111091 - protein, 94 aa, Glycine max
  Coding DNA Sequence Number=SeqID_19406
MSGFTRDPPQISASPHQLDLAPYASGPYNAQWNVSGLLHDKHTLRSSRILRETKVDEPWLGLWLPLNYQVVFSIGRVLHPIRSHYTDPPNEGNH

SEQ ID NO: 111092 - protein, 85 aa, Glycine max
  Coding DNA Sequence Number=SeqID_19407
  Homolog annotation: Hit_ID=A0ST23; Match level="QueryCoverage=31%, HitCoverage=55%, E-value=2e-08, Identity=100%"; Hit description =Putative reverse transcriptase
MDQLDPYDLRTTFAHTYHIKLIDTVDLEGGPVGKPVVPAALMNRPTRGERRFAYWALAECILAYYVGTDEGVSEVLHVAEKKGCT

SEQ ID NO: 111093 - protein, 70 aa, Glycine max
  Coding DNA Sequence Number=SeqID_19408
  Subcellular localization annotation: CTP_CleavageSite=39; ConfidenceScore=5.55e-01
MAVATRGARGGSSFRSLFSFRIFISAMFSLLFVATLSVLLTTNPSTSNDDPGSSHPLVMHTCIGNPFFGH

SEQ ID NO: 111094 - protein, 174 aa, Glycine max
  Coding DNA Sequence Number=SeqID_19409
  Homolog annotation: Hit_ID=Q6WAY3; Match level="QueryCoverage=88%, HitCoverage=6%, E-value=5e-08, Identity=33%"; Hit description =Gag/pol polyprotein
  Pfam annotation: Domain name=G-patch; Domain location=1-42; Score =26.7; E_value=8.8e-05; Accession=PF01585.14; Description=G-patch domain
MVARVMLGHGYEPGMGLGKDSHGNADVVDIRGNPYKCGLGYEHGKPGRRNAPSRLRADRAWPGHVSQCFTSARIMFEEEVAAIGEEAPQDPPSFVRPCHPNFQVGNWHVMSQSEVYTADSICEDRSFEDPNNEGSIIDFDREVSQTINEEEEKDVLSPELERLIAQEEREMKPH

SEQ ID NO: 111095 - protein, 83 aa, Glycine max
  Coding DNA Sequence Number=SeqID_19410
MTKLVFCLSSRPAASWMTKGADNRKGADNRKVSPRVIGPAALWMTQGCMSHDLRVSMTKDYGAADKSKALAPTYPPNEELRPT

SEQ ID NO: 111096 - protein, 181 aa, Glycine max
  Coding DNA Sequence Number=SeqID_19411
  Homolog annotation: Hit_ID=Q2HW90; Match level="QueryCoverage=67%, HitCoverage=30%, E-value=9e-16, Identity=34%"; Hit description =Putative uncharacterized protein
MGQLQRQAFRKAYGKIWDLARVEVSMESIASLSQYYDQPLRCFTFEDFQLVPTVKEFEEILGCPLGGRKPYLFSGFYPSTTRVAKVVKISAQELDRANGLSFIDILALLIFGVVLFPNMEGLVDLAAIDAFLAFHHGKESPLGYPMRGAPLDESITPFIARGFSDHNARVLQGVRKAWDAA

SEQ ID NO: 111097 - protein, 117 aa, Glycine max
  Coding DNA Sequence Number=SeqID_19412
MQLPREPLNKRPRGLARKSMAGINFAELYGVAIVNSSCEGKRGTSREHIACVYARRTPNMLAIIAKYQEELGLATAHEQRIADEYAQVYAEKEARGRVISTLYTKRQPCGWIDLLLP

SEQ ID NO: 111098 - protein, 85 aa, Glycine max
  Coding DNA Sequence Number=SeqID_19413
  Homolog annotation: Hit_ID=Q6L3Q5; Match level="QueryCoverage=67%, HitCoverage=13%, E-value=6e-07, Identity=43%"; Hit description =Putative leucine-rich repeat resistance protein, identical
MSLKWRQFKYELKSKGYDESRTKEEMIAHIPDPRVDPSQYRDLVHYWCSEKGQKIIQNDGQSQAKGAANQLKACILQVNQNNNSS

SEQ ID NO: 111099 - protein, 66 aa, Glycine max
  Coding DNA Sequence Number=SeqID_19414
FDGHEPWAPVSTKDKERVRQEGAPPQVQRGGPCAEKDIPRALVLINMDGEELPSPVNFDVVKKYYT

SEQ ID NO: 111100 - protein, 239 aa, Glycine max
  Coding DNA Sequence Number=SeqID_19415
ADRFDEEAIAQLLCTPGQDFTRTAAGRWVRIMRTNMTTLTQMWMTLLLSNVLPSDHNSDLPLPKCQLVYAILTRMSVHVAQVIADAIYLFADMPSTRHPLDPDKSNRALGFPAFITGLCQSFGVPITPSKVIRPPITQAFIEKYCTPRQVQGDAPQAADASPPPHQADPVGSLGMERAKVRSFCVSYPDQFRAEVAWPGYWPEAQAGEAPAGSPSDAEEACMDEEMTDLLGFLGGSGAT

SEQ ID NO: 111101 - protein, 78 aa, Glycine max
  Coding DNA Sequence Number=SeqID_19416
MEQLLQTQVYSTNEENQGRGQGHGQGQGHGQSSINFKEEKSQQEVMAKATQDQDLLAMIELKKRKTKLKNKVKKVTLY

SEQ ID NO: 111102 - protein, 67 aa, Glycine max
  Coding DNA Sequence Number=SeqID_19417
MALKKLSAKRSRRDTAVEGTSGETGLVREGTGPMGLTRRPLPSCYVYQVRILPGPLQGDGCGSCAPA

SEQ ID NO: 111103 - protein, 72 aa, Glycine max
  Coding DNA Sequence Number=SeqID_19418
MAPVTMGEYCHCSVQCWSGSFQFIGSQEAPNAECPLSSVKRINAEEDDQATSRRPAPRAPEPAPGDLIDLKK

SEQ ID NO: 111104 - protein, 70 aa, Glycine max
  Coding DNA Sequence Number=SeqID_19419
MELELLIKRLSESGIDDEEAAEEEGEAAEDDEEAAEEEGEAAEEEEEAAEEEEDAAEETESDDDDSEATP

SEQ ID NO: 111105 - protein, 284 aa, Glycine max
  Coding DNA Sequence Number=SeqID_19420
MRSSVRGQWIPFDADAISQLLGYPMVLEEGQECEYGQRRNRSDGFDEEAIAQLLCIPGQDFARTAAGRRVRIMRTNMTTLTQIWMTVGPQQHPARAGMAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHVQTHDCLYQMSLSMQSQGFASFSCPTPDQFRAEVAWPGDWPEAQAGEAPPEAPGDGEEAHEDEEMADLLDFLGGSGDTWLGDPHDS

SEQ ID NO: 111106 - protein, 233 aa, Glycine max
  Coding DNA Sequence Number=SeqID_19421
  Gene Ontology: Mol. function=chloramphenicol O-acetyltransferase activity; Biological process=response to antibiotic
  Homolog annotation: Hit_ID=P62577; Match level="QueryCoverage=81%, HitCoverage=86%, E-value=1e-111, Identity=100%"; Hit description =Chloramphenicol acetyltransferase
  Pfam annotation: Domain name=CAT; Domain location=6-196; Score=430.3; E_value=2.7e-126; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQFIMPFVMASMSAECLMNYNSTAMSGRRGVIFLSSYWCLEYLSD

SEQ ID NO: 111107 - protein, 292 aa, Glycine max
  Coding DNA Sequence Number=SeqID_19422
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMKQKRVNKSSSDKVPVSKAVSPMKQIASDKLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 111108 - protein, 61 aa, Glycine max
  Coding DNA Sequence Number=SeqID_19423
GTYWVRTSNLPLGSLEAHARCPSLPQCKALRFLHGAFRCPSVGLKGTKCCLSSWPCRREPI

SEQ ID NO: 111109 - protein, 40 aa, Glycine max
  Coding DNA Sequence Number=SeqID_19424
MGKKLKIRVWEAEGKGFITLGKHVSLKISEKKEKEEENQG

SEQ ID NO: 111110 - protein, 73 aa, Glycine max
  Coding DNA Sequence Number=SeqID_19425
ACSELQNKEREGRLKRAIKGINSRKHQQESSQGYYANNQWGKAHQKIMMMDGSNSHKGKLITSKLSFQNYHGM

SEQ ID NO: 111111 - protein, 137 aa, Glycine max
  Coding DNA Sequence Number=SeqID_19426
  Subcellular localization annotation: CTP_CleavageSite=52; ConfidenceScore=5.27e-01
MRTLRPSSAALAQSSWSLLLMALVTGPFLGRIASGQQAKEVPSCHISRSFVSAGLRREGQVVAICDEDSLRRSNLVQPCPPSFQLGNWRVEERPEVYTTSIISDDEDFKKEASQTEDEEDEDVGLPLELERIIAQED

SEQ ID NO: 111112 - protein, 72 aa, Glycine max
  Coding DNA Sequence Number=SeqID_19427
VRWDASVFGVVNPDFPLYIKHEDLSEIAHGGQCLSISVLQLHLTETCMRVGNSDIYGFREPQSIQKSGAIAV

SEQ ID NO: 111113 - protein, 90 aa, Glycine max
  Coding DNA Sequence Number=SeqID_19428
LKYIARGLRDPSNSPLQPFYRKKGEEVAAQLAQATLARPGELGGNLLPLFPIKRLKGAVRRIPQPPGYVFQLFWVKKIVSVKKIQAEVLP

SEQ ID NO: 111114 - protein, 67 aa, Glycine max
  Coding DNA Sequence Number=SeqID_19429
ARTKGEQVAGEALKKQAIGKPSRSIAFYEYDPRAREADPKAVAYLGAYFGVAYIAAYPFDLGGKEIY

SEQ ID NO: 111115 - protein, 120 aa, Glycine max
  Coding DNA Sequence Number=SeqID_19430
KSKNIAYSAATFLYASVVAGLRPAETIDSQADRGFHFIEKAIDGRIGTGTRAILGPTKPCHEQSTQQEQGIFKLRLIPSIALPSSNRLNCIVYSPAKLAADSTSPRVYALFVLASAIERE

SEQ ID NO: 111116 - protein, 52 aa, Glycine max
  Coding DNA Sequence Number=SeqID_19431
MGQGVEERSPTYEEPPDLSQILSKVEGMMQSYLPRVLDRRLQDGGLELLKKP

SEQ ID NO: 111117 - protein, 79 aa, Glycine max
  Coding DNA Sequence Number=SeqID_19432
AGPTGSLGMERYLQHLGQSSTPFVCPTPEQFAAEVAWPGDWPDAQAGEEPAGSPGRMDEPRMDKDMTDLFDFLGGSGAT

SEQ ID NO: 111118 - protein, 134 aa, Glycine max
  Coding DNA Sequence Number=SeqID_19433
GPGLPGINRDTRIYLFCEVISVTAVPPVQLLTGWCVTAKAPPDISAGKCSGHAARRVPFAIQAAQLLGRAIGAGLFAITPAGERGMCCKAIKLGNARVFPVTTLLKAQVEKDEGPSGEGQSPRVEKDEGPSGEG

SEQ ID NO: 111119 - protein, 55 aa, Glycine max
  Coding DNA Sequence Number=SeqID_19434
GLNPNQEGAALTDSSECRPWEYTQFECSFKPVSIPHNWSILAKQHDPDWSRYDFT

SEQ ID NO: 111120 - protein, 86 aa, Glycine max
  Coding DNA Sequence Number=SeqID_19435
STLEDPNIKETFPLRQPPHFLFCKKTLASIATPLGLEFIPQVKKLLDEGFVCKSLNPCALLVSKIGVDGRSPEYEEPRDLRSNPFP

SEQ ID NO: 111121 - protein, 109 aa, Glycine max
  Coding DNA Sequence Number=SeqID_19436
  Subcellular localization annotation: CTP_CleavageSite=51; ConfidenceScore=5.13e-01
MMTKSPKNDFKIESTSSRSSFMRRNQEDSRIKRKGTSTWVVVTKNKRGYISCGSVQVEGTSTWLFKENKGGYIPCGSLLVKVFTRLKRNLKDHRSLADRMQTQVVSKPV

SEQ ID NO: 111122 - protein, 146 aa, Glycine max
  Coding DNA Sequence Number=SeqID_19437
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=72%, E-value=5e-25, Identity=68%"; Hit description=LacZ protein
  Subcellular localization annotation: CTP_CleavageSite=40; ConfidenceScore=5.49e-01
MTMITPSSKLTLTKGNKSWFVTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 111123 - protein, 131 aa, Glycine max
  Coding DNA Sequence Number=SeqID_19438
  Gene Ontology: Mol. function=protein serine/threonine kinase activity; Biological process=protein amino acid phosphorylation
  Homolog annotation: Hit_ID=A7Q0V8; Match level="QueryCoverage=53%, HitCoverage=19%, E-value=1e-14, Identity=62%"; Hit description =Chromosome chr7 scaffold_42, whole genome shotgun sequence
MTGQLNAKSDVYSFGVVLLELLTGRKPVDHTLPRGQQSLLLFPLVRVNFELGVIMVIAVSFGKPVVPAALMNRPTRGERRFAYWALAECILAYYVGTDEGVSEVLHVAEKKGCTGASAEYVIQDIFRFLAH

SEQ ID NO: 111124 - protein, 93 aa, Glycine max
  Coding DNA Sequence Number=SeqID_19439
  Subcellular localization annotation: CTP_CleavageSite=57; ConfidenceScore=5.03e-01
MFMTPRLCISAILGKKTCFREEKSSRSASIMLLRRFRVQICEDFPLFFTVLRLFFVRSSFFNRSDFLIAIEDTQEQKPHFCRPPQEIVNGPTP

SEQ ID NO: 111125 - protein, 274 aa, Glycine max
  Coding DNA Sequence Number=SeqID_19440
  Gene Ontology: Mol. function=nucleic acid binding
  Homolog annotation: Hit_ID=Q7XG75; Match level="QueryCoverage=65%, HitCoverage=31%, E-value=2e-11, Identity=31%"; Hit description=Zinc knuckle family protein
MAQPPPRERTLREMAAPDFTYESLCIQYPDEGVPYVLKTGLIHLLPKFHGHVGEDPHKHLKEFNIVCSTMKPPDVQEDHIFLKAFPHSLEGVAKDWLYYLSPSNLERSMINAASGGALGDMTPTEARNLIQKMASNSQQFSARNDAIVLRGVHEVATDSSSSTENKKLEGKLDVLVNLQFGVNEQPEAYAANIYNRPPQQQNQQQQNNYDLSSNRYNPGWRNHPNLRWASPPQQLMQSYPVRALDRKLQVDWARDAREGPRVLMSLRVDFGPMG

SEQ ID NO: 111126 - protein, 71 aa, Glycine max
  Coding DNA Sequence Number=SeqID_19441
MDRARLVYGLVTNMDMNIRALILGQISSIAQSNSSRLGFPALIIALCRARGVTSDSLTYESLSLTINLGLH

SEQ ID NO: 111127 - protein, 77 aa, Glycine max
  Coding DNA Sequence Number=SeqID_19442
  Subcellular localization annotation: CTP_CleavageSite=34; ConfidenceScore=5.12e-01
MIGTLASPPESTGIILLYMPKPPKFGDFPPSSPRGFTPTTLSIASFMLYPVESYPLHRLNITSFFSRLHLLYFSCCS

SEQ ID NO: 111128 - protein, 285 aa, Glycine max
  Coding DNA Sequence Number=SeqID_19443
QGICESKPTTFRGSGNTDSLLHFLFLAVLIRRIMDTEFQNSNLIPFMSLKLPVYSELVKAFYSNLEIQESILIYEVFGIKMVIDQSLFYELTQLSSEGVPFEGTLNDDWKFDFSVHDARWLVRTNQADMIGRLLAGSSALESRILHYLIDLIAMWAFHTGRQIDWAHLVRYRMHKALRLNAPLPYPHLVTLFLQHFNIPLDTEPYVPIKRTFLIGAAVIASFGYRKSMMALGFDGLQTYVGERFDALELQVDMRFDEMDSRITKVEGDVTYIRTCFDIPPPPPSS

SEQ ID NO: 111129 - protein, 79 aa, Glycine max
  Coding DNA Sequence Number=SeqID_19444
MTKSSKGPIHRITQVNQRSIQRTTQSGIKEQFQEFQDKEFKKKFKTSRRKVLDTKNSRFQGFKDLKNQRSRFQDSKIQE

SEQ ID NO: 111130 - protein, 90 aa, Glycine max
  Coding DNA Sequence Number=SeqID_19445
  Homolog annotation: Hit_ID=A1AG32; Match level="QueryCoverage=72%, HitCoverage=37%, E-value=4e-25, Identity=83%"; Hit description =Putative uncharacterized protein
HLTDLQPPESKNPAEAGFFKKLKLTDKPGSVVDSHSSRPAIAHWLKQPTRVQYGPYHVNPYLALLRVEFTVPRNCYQPRGALLPHPFTLT

SEQ ID NO: 111131 - protein, 339 aa, Glycine max
  Coding DNA Sequence Number=SeqID_19446
  Homolog annotation: Hit_ID=Q2HW90; Match level="QueryCoverage=97%, HitCoverage=64%, E-value=5e-40, Identity=32%"; Hit description =Putative uncharacterized protein
MGPLQRQAFRKVYGKILDLTVAEVFTEAVVSLAQYYDQPLRCFTFGDFQMVPTIEEFEEILGCPLGGRKPYLFSGFLLSLSKVAAVIGDSAKELDRIKQIRNGVVGLPRKYLEDKARDMASQEKWGAFADVLALLIFGVVLFLNVDGLVDLAAIDAFLAYHHSKESLVVAISDLFDTFDRRCEKNSARIVCCLPALCVWLISHLFRQDTRHPCPLQSYRSCAEKGRVVWDQHLAGIGGSTINWFPRWKEGKEGVLFSCGDYPNVPLIGTRGCINYNPALAIRQLGYPMRGAPTEESLSPFLMRDLGAQGLKVIQRIHKAWRSPLRKDKELRGIRNGVIG

SEQ ID NO: 111132 - protein, 151 aa, Glycine max
  Coding DNA Sequence Number=SeqID_19447
  Homolog annotation: Hit_ID=Q2HW89; Match level="QueryCoverage=58%, HitCoverage=8%, E-value=2e-08, Identity=39%"; Hit description =Integrase, catalytic region; Ribonuclease H
MADALATLASMFQLTPHGDLPYIEFQCRGKPAHCCQVEEERDGKPWYYDDQAICRKQRYPPEICEPLLQLLHKTTGSWMRRLAARLFLSGRHNIRVPNESSCDAYATTWKATLILYMTILRTSPMRARMLERTPTMTNPRKILRAGCITLP

SEQ ID NO: 111133 - protein, 102 aa, Glycine max
  Coding DNA Sequence Number=SeqID_19448
  Subcellular localization annotation: CTP_CleavageSite=78; ConfidenceScore=5.12e-01
MAMDHRSLPRHGKFSSTPNAYIIIVILIPGSKVMAILSFAKNKFPKFLSLSNSTTPSAPGLGSSSSMDSFSSWKMNGSGMEKEEREEMPLQGEYESRISSPL

SEQ ID NO: 111134 - protein, 61 aa, Glycine max
  Coding DNA Sequence Number=SeqID_19449
MTKDNNWYLKALHWGNEGYHAKTSSEPRGRLEPYTGAMKWHRHEPQANMGADQKFSPVDVF

SEQ ID NO: 111135 - protein, 106 aa, Glycine max
  Coding DNA Sequence Number=SeqID_19450
MDGFIELMKEHNLETLALLSFKRLAKILLKHKHLDNEGKLELLHMMSNVMSKNKIGLHNAQGKMKCQMKNRSCRIHDVGYNIQDILPENTGGAVQCTMQDKSQVKK

SEQ ID NO: 111136 - protein, 133 aa, Glycine max
  Coding DNA Sequence Number=SeqID_19451
MMDYIAIKITTYPNNFSAQNYPCHVMKLLPEDHRNFPCLFNDEYESWDVQGNTQYQYSLMRAQIQGYQWFFSESDKREFDLIRETYDTKLFQPSYYGKFFIPFPVDHNKKLVQFFQKEKKDKEIYEASGCHGQ

SEQ ID NO: 111137 - protein, 270 aa, Glycine max
  Coding DNA Sequence Number=SeqID_19452
VKEVKRWGCEENGGEREEDDSGWEEKEEGRGCRETSNRGSSVNIKESEKVGVNSNLRGKMRLEEQTVKHGTKLEGHNTEVVDRRHTGTRYRNPSMTYAKDSKAKEIMSEELQHGTSPFYSLQKWNPMMRPGHRLIWVQCWCVPLEVWDIGNFQKLVAAVEDLIEIVEEGSSDVGIRAPHHRGAIESIEEIDSDDNDSDISRAVMAPTPNFRHLLKGFDGDRNADNDDHWSQPLLDGPSLMDYPVDNNQDNWLHLPSIDIRARPEMKKGKK

SEQ ID NO: 111138 - protein, 134 aa, Glycine max
  Coding DNA Sequence Number=SeqID_19453
MVNIHTLVKKAHCLAISHLVLLVDSFLRLRGPFRKAWVAFFHDVHDILIVEDRLHLDAPSFSIVAIEDGEDNDKASSVKSHSCNRVSLEFLALIPNQDAMEAEAREALWREELIEEIEQKVEGLRELEEAGKKN

SEQ ID NO: 111139 - protein, 147 aa, Glycine max
  Coding DNA Sequence Number=SeqID_19454
MVADGVTREVLDILNDEDNNMIFDRATAEKVFHTSHILKAYEEVVEGHERYFGVPTLVEKSKTYIFTFVEIEFGKISKGRRSLRPSYTWTSINGSMWIMEDRWISRLPRAKISPLKGTLVLNELRVSDLMNKDKRGWNGAILMSLFE

SEQ ID NO: 111140 - protein, 844 aa, Glycine max
  Coding DNA Sequence Number=SeqID_19455
  Gene Ontology: Mol. function=nucleoside-triphosphatase activity; Cellular component=cytoplasm; Biological process=protein metabolic process
  Homolog annotation: Hit_ID=Q39889; Match level="QueryCoverage=100%, HitCoverage=92%, E-value=0.0, Identity=87%"; Hit description=Heat shock protein
  Pfam annotation: Domain name=AAA; Domain location=202-396; Score =52.1; E_value=2e-12; Accession=PF00004.20; Description=ATPase family associated with various cellular activities (AAA)
  Pfam annotation: Domain name=AAA_2; Domain location=596-761; Score =365.9; E_value=6.4e-107; Accession=PF07724.5; Description=ATPase family associated with various c
  Pfam annotation: Domain name=AAA_5; Domain location=202-342; Score =1.9; E_value=0.002; Accession=PF07728.5; Description=ATPase family associated with various
  Pfam annotation: Domain name=AAA_5; Domain location=600-758; Score =25.4; E_value=3.4e-05; Accession=PF07728.5; Description=ATPase family associated with various
  Pfam annotation: Domain name=Clp_N; Domain location=17-67; Score =35.8; E_value=1.5e-07; Accession=PF02861.11; Description=Clp amino terminal domain
  Pfam annotation: Domain name=Clp_N; Domain location=96-146; Score =49.0; E_value=1.6e-11; Accession=PF02861.11; Description=Clp amino terminal domain
  Pfam annotation: Domain name=NB-ARC; Domain location=554-799; Score= -130.5; E_value=0.06; Accession=PF00931.13; Description=NB-ARC domain
  Pfam annotation: Domain name=Sigma54_activat; Domain location=570 -755; Score=-173.2; E_value=0.0078; Accession=PF00158.17; Description= Sigma-54 interaction domain
  Pfam annotation: Domain name=Torsin; Domain location=552-830; Score= -145.8; E_value=0.0003; Accession=PF06309.2; Description=Torsin
  Pfam module annotation: Pfam domain module=AAA::AAA_2::AAA_5::AAA _5::Clp_N::Clp_N::NB-ARC::Sigma54_activat::Torsin; Domain location =202-396::596-761::202-342::600-758::17-67::96-146::554-799::570 -755::552-830
MNPDKFTHKTNEALVSAHEIATSNGHAQFTPLHLASSLISDKDGIFSQALSNAAGEESARAAERVINNALKKLPSQSPLPDEVPASNALVKAIRRAQTLQKKRGDTHLAVDQLILGLLEDSQIAELLNEAGVAASKVKSEVERLRGKEGKKVESATGDSTFQALKTYGRDLVEQAGKLDPVIGRDEEIRRVVRILSRRTKNNPVLIGEPGVGKTAVVEGLAQRIVKGDVPSNLSDVKLIALDMGALVAGAKYRGEFEERLKAVLKEVEDAEGKVILFIDEIHLVLGAGKGEGSMDAANLFKPMLARGQLRCIGATTLEEYRKYVEKDAAFERRFQQVYVAEPSVVDTISILRGLKERYEGHHGVRILDRALVVAAQLSSRYITGRHLPDKAIDLVDEACANVRVQLDSHPEEIDNLERKRMQLEVELHALEKEKDKASKARLVEVRKELDDLRDKLQPLMMKYKKEKERIDNIRRLKQKREELNFALQEAERRYDLARAADLRYGAIQEVESAIQELEGNNEGNVMLTETVGPEHIAEVVSRWTGIPVTRLGQNDKERLIGLADRLHQRVVGQDQAVNAVAEAVLRSRAGLGRPQQPTGSFLFLGPTGVGKTELSKALAEQLFDDENQLVRIDMSEYMEQHSVSRLIGAPPGYVGHEEGGQLTEAIRRRPYSVVLFDEVEKAHTSVFNTLLQVLDDGRLTDGQGRTVDFRNTVIIMTSNLGAEHLLTGLSGKSSMQVARDRVMQEVRRHFRPELLNRLDEIVVFDPLSHEQLRKVTRLQMKDVASRLAERGIALAVTTAALDYILSESYDPVYGARPIRRWLERKVVTELSRMLVKEEIDENST

SEQ ID NO: 111141 - protein, 490 aa, Glycine max
  Coding DNA Sequence Number=SeqID_19456
  Gene Ontology: Mol. function=phosphoinositide phospholipase C activity; Biological process=intracellular signaling cascade
  Homolog annotation: Hit_ID=A2Q4S5; Match level="QueryCoverage=67%, HitCoverage=59%, E-value=1e-33, Identity=29%"; Hit description=IMP dehydrogenase/GMP reductase, putative
  Pfam annotation: Domain name=DUF1723; Domain location=113-162; Score =39.7; E_value=1e-08; Accession=PF08330.1; Description=Protein of unknown function (DUF1723)
MAKQIMVRTRGLGRALGQRRQPTASAWRQRVAVIADHVDEPVIPVPDVQDDPIKAPAAIEDIPADTGAEAAEDAHEGFPGGPSDPSVLTLYADHVACCVWTGEERPELKLSSHGRKGLLFAFVERWHQETSSFHLPVGELIITLDDVSSLLHLSVIGDLHAFEPLHVDDAVQMLVDLLMVSPESARAETAQCCGPYVRLQRVRDIYERRCQTGHWTAAARAYLLHLLGCTLFANKSATNVHVVYLEALRDLSMTEMYAWGVAALVHMYDQLNDASMSHSQQLGCWIYEHFPSVADSTADKEYDEDSPRACRWIATKKTVKSIRTLTYRERLDRIRIPDVLDFHVRSCYSGLLRWGPVVVYYQPERVVREFGYTQTIPAPHVDSWVSYDDIHGRWMHYEDHIVPTGEAPQTDIPRVPEPEASLTSAVEPRHVVEVCDDIAERLERHLSLGVVTPGSSTHEVIEECLRLVRSVTQNYLVYVRSRRRRRTDQE

SEQ ID NO: 111142 - protein, 96 aa, Glycine max
  Coding DNA Sequence Number=SeqID_19457
  Homolog annotation: Hit_ID=A7PDC5; Match level="QueryCoverage=80%, HitCoverage=6%, E-value=4e-28, Identity=76%"; Hit description =Chromosome chr17 scaffold_12, whole genome shotgun sequence
MKYSEKFRTVIFSTVVPLLNSKASILDLRVECQDLERYSVINRFAKFHGRGQNDGAETSSSSDANNNAQKSFPLKYVTAVPLPRNLPDRVQCLSLG

SEQ ID NO: 111143 - protein, 120 aa, Glycine max
  Coding DNA Sequence Number=SeqID_19458
MVRTRGLGRALGRVIGRALGREDDHHSDSAHVAEDEPVVVADIDAPGADAGHDAEGFPGGPRDPSVLTEYANHVADRPELKLSSHGRKVQKFGRPAPDVEGLGTATRLSPLITCSIDTSD

SEQ ID NO: 111144 - protein, 120 aa, Glycine max
  Coding DNA Sequence Number=SeqID_19459
  Homolog annotation: Hit_ID=Q2HTA0; Match level="QueryCoverage=95%, HitCoverage=18%, E-value=4e-11, Identity=40%"; Hit description=IMP dehydrogenase/GMP reductase, related
  Pfam annotation: Domain name=DUF1723; Domain location=43-92; Score =52.1; E_value=1.9e-12; Accession=PF08330.1; Description=Protein of unknown function (DUF1723)
DRPELKLSSHGRKVQKFGRPAPEIEGLGTATRLSPLITCSIDTSDWRLISAFVERWHRETSSFHLPVGEVSITLDDVASLLYLPIVGAFHTFEPLHVDEAVLMLVKLLEVFGEEARAETA

SEQ ID NO: 111145 - protein, 204 aa, Glycine max
  Coding DNA Sequence Number=SeqID_19460
MACLLEGCNLHGCIKQALNIIGKDFSGFIPKGTTWFQKKRKQGQQKPFQINDKDPNGKKGRGKHELAHGLAEIKKQHLERTQGRTMKLPGQIGQASGEGVDRAFHGDPNPGLARENGGWRRRRQRMEPALMPSDVLGQLIGARDESKGLDEGGDTGLGQACCCANNELMIEAGATKGIEETIRDGSSVGRVALFSAEGEGAGFE

SEQ ID NO: 111146 - protein, 370 aa, Glycine max
  Coding DNA Sequence Number=SeqID_19461
MGEKDLWFEFKKWGDVREVFIAKKKNRSGRKYGFVRFKGVVDMGMLERQLDNMIIVMDKIAEDEQRQGKKETEHTFRNKGLLKQHPQRMQPPVSYATVVAKGNNNTKKRWFPRHAILTRSISHLTLQLNIPIEETKWYSNAWVGRLRNLVLFDKMEDEIMWVGGEDIMPKYLGDDMVLLTGLTDTRAEEMCKEGACWGIPLHAWDKENIKKIVWVVGEGVEVDDEEYTVHMAEETCHSPDTNKWRMRSMMGSSEEISSDESETGLPLSATYESSESKFPMNINNENGGKLGGAARDKQLSDGQCPTLGSKGNTLWVLTQRPQQPRHRDESCGQSETAGNADSGISKPIQQLQSGGKDTKQTATRGHKEET

SEQ ID NO: 111147 - protein, 23 aa, Glycine max
  Coding DNA Sequence Number=SeqID_19462
MAVFKAYIHKDTDIVYCAQMPHL

SEQ ID NO: 111148 - protein, 248 aa, Glycine max
  Coding DNA Sequence Number=SeqID_19463
DVTNPTLKWEGEKENAYYDLGIDTRLFLEVVDLIHDIEYSVILLKMWWKWVDVDYKSLRYLSNDQDAMDLARGELTGGEELFNDQQIVEFDHSVDDLFDWDNAMAFDDNNESSRKQNEPTVKSKVSNKGKYNASKYEDPSIENPGRCDEDLDGIDDDNMPNHPMRNLIQILRRCTIWRLAMKLMSCTMMLKVARNIVVAVGTETQVAEYEIPTAGNNVANARSAVGGLGSTIPIGNNVAMPTESDIPT

SEQ ID NO: 111149 - protein, 262 aa, Glycine max
  Coding DNA Sequence Number=SeqID_19464
  Subcellular localization annotation: CTP_CleavageSite=35; ConfidenceScore=5.15e-01
RAHMSSDSDSSISNGSLRSLQFFPLTAPIEFPNVRQTEKGLKSPLVLSWCDSFFSLREYYITNTNGEDRFGFLRERKKLRCERYFSQLKHVIEIPNDENARNWVANMVLKFHDDPTLNESKIVVFLRQGDEEKKDPEPKGKSFLTNNTITRKPTKFMNKKQPNGLELALGTRGKSFSVVEAYCLASIALMRGADANPSSVSPNLFESVAPSCALAFSWRLLRERVPTRVVLSHREAVVFQGVVPDVQTVIHQIQGLSGLVLL

SEQ ID NO: 111150 - protein, 104 aa, Glycine max
  Coding DNA Sequence Number=SeqID_19465
MRVLIEYSYSTFKNSQPEKSNGSNQLSAMADLQVLMKGITYFVVVSVNKNFQSKGEEGEGEAEAKVSAKGRVNDAVGHGGIGLDDGGGVGFFSVGEGKEGELNF

SEQ ID NO: 111151 - protein, 232 aa, Glycine max
  Coding DNA Sequence Number=SeqID_19466
  Gene Ontology: Mol. function=nucleoside-triphosphatase activity; Cellular component=intracellular; Biological process=regulation of transcription, DNA-dependent
  Homolog annotation: Hit_ID=A7PDB5; Match level="QueryCoverage=84%, HitCoverage=9%, E-value=2e-73, Identity=71%"; Hit description =Chromosome chr17 scaffold_12, whole genome shotgun sequence
MEAAIRIRHRKEIVDSIHHGLLVLKSDKNASNAQSRMPSYGTQVTVQTESEKQIDKLRRKEEKRNRRGVEHAGDGELSALDFSSLHQASERKKMFDEMIGSGDKFESIAVTALPEGTVRKHFKGYEEVNIPPKPTAPLKPGEKLIEIRELDDFAQAAFRGYKSLNRIQSRIFPTVYGTNENILVCAPTGAGKTNIAMVSILHENKRGKWYKGDNVTEEAERRFLEVGSSALA

SEQ ID NO: 111152 - protein, 124 aa, Glycine max
  Coding DNA Sequence Number=SeqID_19467
MKGDPVNVFKDPAPLIIEVVRSWKSWGILPSLGRLYVSRFEKSLGIWGDLLNPTYGVNEQAIVPSGRLHQITLDKGKLLEGKNDSIETAQQRGIFVKSTISTMGNRKSVRERKPNSRWVDYVTN

SEQ ID NO: 111153 - protein, 134 aa, Glycine max
  Coding DNA Sequence Number=SeqID_19468
  Gene Ontology: Mol. function=protein binding; Biological process=RNA metabolic process
  Homolog annotation: Hit_ID=A7QRG8; Match level="QueryCoverage=58%, HitCoverage=12%, E-value=3e-20, Identity=61%"; Hit description =Chromosome chr8 scaffold_150, whole genome shotgun sequence
MKYSLTTWERAHLTLLTKGTFMSFTAYLITLALGRAKLGDAPAEVPEKKAKEKYIAPHLRARAGNEPEEHTQIRIRVRGLLNRLSESNVESITGELSLIFQILTEEVLASCSSGPRGNQQLRIFALLFYSYLPQ

SEQ ID NO: 111154 - protein, 131 aa, Glycine max
  Coding DNA Sequence Number=SeqID_19469
MCTFSVFVSIPPSLTVSNLLSNPVRTFDTHRETRENFSFDHIIINAANGDNTSVANQRLPPLGQAANLFGMPAIGTPENEIPTTMVKILCQVLNDHSLIVILQKEMNAMKQQNTQEVEYLQKENVVLREQY

SEQ ID NO: 111155 - protein, 99 aa, Glycine max
  Coding DNA Sequence Number=SeqID_19470
MEMAVKFLQDLEDISIHPDREDKWIWKEDASGVYSAGSGYKKLMSTQTDENQDGVFIELWKQNTATLVGISIVDKHFRTTSTAPNNAFPPARGLESKWL

SEQ ID NO: 111156 - protein, 184 aa, Glycine max
  Coding DNA Sequence Number=SeqID_19471
MSYIDLMKVIKSIGYKAFKCLWYRHPLKALCRGSKQLNCDSDILQLAEDVSRLMWLKLEVESVVEGEDEAEVEVEAEVQLYEEGLVEVVVEGVDDDDVGAEETHDDDNIGADEDDNDSSDCSEVSDSDFEESSDWTLDTPSGSEDEGPPKVRFPCFKVPENDEDMKFDVGLQFSSKKQILEEAL

SEQ ID NO: 111157 - protein, 245 aa, Glycine max
  Coding DNA Sequence Number=SeqID_19472
  Gene Ontology: Mol. function=oxidoreductase activity; Cellular component=integral to membrane; Biological process=metabolic process
  Homolog annotation: Hit_ID=A7Q8D6; Match level="QueryCoverage=48%, HitCoverage=50%, E-value=2e-29, Identity=57%"; Hit description =Chromosome chr5 scaffold_64, whole genome shotgun sequence
  Pfam annotation: Domain name=MtN3_slv; Domain location=102-188; Score= 55.9; E_value=1.4e-13; Accession=PF03083.7; Description=MtN3saliva family
MKVSVFLGLNQYFVASDVGHGKMRWYAFHGEPPSSDPFPKGDAAHPMQPNLGQGGCMAIEASDFVPKVVDLAARELIAIASPGQGLIWLDHAKTSTESAVVMNLESRCLGIRPGVMDGAISISAVQKHGSTEDFSSLPYICTLLNCSLWTYYGIIKAREYLVATADGFGIVVETIYVILFLIYAPKGIRVCSRTVILVVILDVAISTIAVVTTQLALQREARGGVVGVMGAGLNIVMYFSPLSCH

SEQ ID NO: 111158 - protein, 542 aa, Glycine max
  Coding DNA Sequence Number=SeqID_19473
  Gene Ontology: Mol. function=hydrolase activity; Cellular component =extracellular region; Biological process=metabolic process
  Homolog annotation: Hit_ID=Q9FF10; Match level="QueryCoverage=99%, HitCoverage=100%, E-value=0.0, Identity=58%"; Hit description =Heparanase-like protein 1 precursor
  Pfam annotation: Domain name=Glyco_hydro_79n; Domain location=22-341; Score=541.0; E_value=1.3e-159; Accession=PF03662.5; Description =Glycosyl hydrolase family 79, N-terminal domain
MRFRIALFLFLASLQATLSQDIEHGSLLVDGAQTKAETGDNFICATIDWWPHDKCDYNHCPWGYSSVVNLDLSHPFLAKAIQALKPLRIRLGGSLQDRVLYDVGSLKSPCHPLQSVKGELFGFSKGCLHMKRWDELNQFFNETGAIVTFGLNLLHGKHQISHNVWEGAWDPTNAYNFIEYTISKGYKIDSWELGNELSGKGIGASVGVAQYGKDLIKLKQILSTLYENSNFKPSLVAPGGFYEKHWYDRLLQVSGSGIINVLTHHIYNLGPGSDEHLERKILDPERLSRVESIFSNLSETIQKYGPWCSAWVGEAGGAYNSGGNDVSNRFLNSFWYLDQLGMASSYSTKVYCRQTLIGGNYGLLNTTTFAPNPDYYRQLMGKKVLAVSSDVSSPFLRTYAHCAKDRAGVTLLLINLSNQTDFILTVRNPVTASVVENEVATGTHKESSFFDKLKKTFSWVGTKGSEVTFREEYHLTPKDGYLRSQTMVLNGIPLELTDEGDLPRLDPVRNNLRSPIYMTPLSIAFVVYPNFDAPACATHRKL

SEQ ID NO: 111159 - protein, 98 aa, Glycine max
  Coding DNA Sequence Number=SeqID_19474
MGRADFRGLKKGYLWKVLIDGGRKDCCRAIVEEGDGLDGVVMDPPDAEIVAGGDKKIKHGDWGFCSSREREREKKYRDAHVQLLEVIHKTHRFRFVQT

SEQ ID NO: 111160 - protein, 928 aa, Glycine max
  Coding DNA Sequence Number=SeqID_19475
  Gene Ontology: Mol. function=nucleoside-triphosphatase activity; Cellular component=intracellular; Biological process=regulation of transcription, DNA-dependent
  Homolog annotation: Hit_ID=Q9FNQ1; Match level="QueryCoverage=81%, HitCoverage=69%, E-value=0.0, Identity=56%"; Hit description=RNA helicase
  Pfam annotation: Domain name=DEAD; Domain location=257-428; Score =115.3; E_value=1.8e-31; Accession=PF00270.20; Description=DEADDEAH box helicase
  Pfam annotation: Domain name=Helicase_C; Domain location=562-637; Score=15.3; E_value=0.0021; Accession=PF00271.22; Description =Helicase conserved C-terminal domain
  Pfam annotation: Domain name=ResIII; Domain location=253-398; Score= -31.5; E_value=0.021; Accession=PF04851.6; Description=Type III restriction enzyme, res subunit
  Pfam annotation: Domain name=Sec63; Domain location=753-928; Score= -64.5; E_value=7.8e-06; Accession=PF02889.7; Description=Sec63 domain
  Pfam module annotation: Pfam domain module=DEAD::Helicase _C::ResIII::Sec63; Domain location=257-428::562-637::253-398::753-928
  Subcellular localization annotation: CTP_CleavageSite=13; ConfidenceScore=5.44e-01
MSTFNPMASCNPRAMTIGSTAGSSSNWYPDSGPDQVVVGNGQGLPTHSTGSTFPFNRSTSLMLHKLLNIPTISKILLSVSHEILLKGHLGSDGLYTFPCMLSSSSAFTSILFRNMSLNSVLPSSSEQADYSLVRSASLNSITASTWRSRLGHPSADSENDHIYHSELFTLTKRMARGEPYKLSFTVPIFEPHPPQYYIHAISDSWLHAEAFYTITFHNLPLPEARTAHTELLDLKPLPMSSLGNSTYEALYKFSHFNPIQTQTFHVLYHTDNNVLLGAPTGSGKTISAELAMLRLFNTQPDMKVIYIAPLKAIVRERMSDWQKRLVSQLGKKMVEMTGDYTPDLTALLSANIIISTPEKWDGISRNWHSRSYVTKVGLMILDEIHLLGADRGPILEVIVSRMRYISSQTERAVRFVGLSTALANAGDLADWLGVEEIGLFNFKPSVRPVPLEVHIQASGFGVPHRSCLNMSISLSIYYIKRGYPGKYYCPRMNSMNKPAYAAICTHSPAKPVLIFVSSRRQTRLTALDLIQFAASDEQSRQFLNLPEETLQMVLSQVSDLNLRHTLQFGIGLHHAGLNDKDRSLILVCTSTLAWGVNLPAHLVIIKGTEYYDGKAKRYVDFPITDILQMMGRAGRPQFDQHGKAVILVHEPKKSFYKKFLYEPFPVESSLREQLHDHINAEIISGTICHKQDAVHYLTWTYLFRRLMVNPAYYGLEDAESEFLNTYLSSLVQTTFEDLEDSGCIKMDEDKVEPMMLGTIASQYYLSYMTVSMFGSNIGPDTSLEMRLLSLALGANLVWIKGVFLHILSAASEFDELPVRHNEEKYNEALSEKVKYPVDKNRLDDPHIKALLLFQAHFSQLELPISDYVTDLKSVLDQSIRVIQAMIDICANSGWLSSSITCMHLLQMVMQVFIPICSAADLSSFMAIG

SEQ ID NO: 111161 - protein, 436 aa, Glycine max
  Coding DNA Sequence Number=SeqID_19476
  Gene Ontology: Mol. function=endonuclease activity; Cellular component=proton-transporting two-sector ATPase complex; Biological process=ATP synthesis coupled proton transport
  Homolog annotation: Hit_ID=A7PDF4; Match level="QueryCoverage=65%, HitCoverage=25%, E-value=1e-98, Identity=62%"; Hit description =Chromosome chr17 scaffold_12, whole genome shotgun sequence
MEVEGISYLDSSLNSDNCEEQSARRDAVGETQLDKQPSAENSNESEANRDDKSDETFLNNSIQSSNIMAENISCQDLGKASVLDGTCDVDVFDGMERCPEKSFEDGDQEIRDLKKISTTEADDNQSVNLVEVNGHCSNQVDFLRFEVSPYTGRIHLYTCILGTDKRPQPLHENFRPEELELLSSVADDEKQAHDEKQKTEFVTVKDNPAYRHALMAFAEEWKNLRSIERRKLLGKPLQLPLAVELCYLSESNNHNNKGLLNGGSKRRRTPLMEISYPLPSDAVWRKVSLRSGLGKKEKEYTQGWSVTDEPLCKLCQKQCLANNAKTPEFFEDLFCNLVCYEEYRMRTSNRFLREELFKIEHGVCTNCQFDCHKLVEDIRPLSLERRREYIEKVAPKVAKRKKMFEKLVNEPTEGNAWHADHIVPVYDGGGRIHFKV

SEQ ID NO: 111162 - protein, 332 aa, Glycine max
  Coding DNA Sequence Number=SeqID_19477
  Gene Ontology: Mol. function=endonuclease activity; Cellular component=intracellular; Biological process=ATP synthesis coupled proton transport
  Homolog annotation: Hit_ID=A7PDF4; Match level="QueryCoverage=84%, HitCoverage=26%, E-value=1e-60, Identity=45%"; Hit description =Chromosome chr17 scaffold_12, whole genome shotgun sequence
MELTEEQRRQVEANRAAAIAKRKAFLESREEEQQQQKNPEGENNSNTNPNPWNLFKCQKFPLSPKPQPPKFLARLEICSPDSFSITPLPLSSFPFPGHQHCLNTLSSTLSQQHVVPSHYTQTSEGEKVCVFKLAEYRAVLKQLKAAAAAEVLLVEEIPWATFNVVECLSRSFAAGRWAPVRPEHLPDDEVDRLIGRLPRTLLERLLPFQHDGLRFALRRGARCLIADDMGLGKTLQAIAIAGCFVEEGSILVVCPAVLRYSWAEELERWLPSCLPADVHLDYVNGSVVLNLFIGCTMKRYASSEDAHAKVGLGLGDLNYKRKYGFAFGSCKK

SEQ ID NO: 111163 - protein, 260 aa, Glycine max
  Coding DNA Sequence Number=SeqID_19478
  Homolog annotation: Hit_ID=A5BA99; Match level="QueryCoverage=80%, HitCoverage=96%, E-value=8e-25, Identity=36%"; Hit description =Putative uncharacterized protein
  Pfam annotation: Domain name=Remorin_C; Domain location=146-255; Score=89.9; E_value=8.3e-24; Accession=PF03763.4; Description =Remorin, C-terminal region
MLWITLTSSSFTSPKSKVEIKEKFQRMDYRLNQRRVSFSDPNSRQHIPDDERVTAVAAAAFSIHSLEEAGLLNLQKMKESPKFPRTKTVREKEWKVSRQPSHGEISTRRSLGQELARATESAIPARRPSGVSPAAGYQNHKGNQVIQHKNDKATLWEKAKIERIQKRYEKTKSKILAWESYRKIQAKMQMDRKKSEWEHKRAIEMQHYKNKIARIDMIAQGAISQLEDHKRKQESKAKEKAKKIRKTGRVPVKCFCFKSL

SEQ ID NO: 111164 - protein, 103 aa, Glycine max
  Coding DNA Sequence Number=SeqID_19479
AAWVEVKVLWVGGDYCGGWFIIRGTPDQWMYDSIMSEEVDMDDQNEEECGVFGTRDNVLQWVRSVAHENGFVAEEKTLLEEILGVENVGVPSSFVGNQWLGGK

SEQ ID NO: 111165 - protein, 395 aa, Glycine max
  Coding DNA Sequence Number=SeqID_19480
  Gene Ontology: Mol. function=transcription regulator activity; Cellular component=nucleus; Biological process=regulation of transcription
  Homolog annotation: Hit_ID=A7PDF3; Match level="QueryCoverage=59%, HitCoverage=63%, E-value=5e-56, Identity=57%"; Hit description =Chromosome chr17 scaffold_12, whole genome shotgun sequence
  Pfam annotation: Domain name=HLH; Domain location=182-231; Score =56.8; E_value=7.5e-14; Accession=PF00010.17; Description=Helix-loop -helix DNA-binding domain
NYDRISELIWENGQLSIHGLGGLQPTNPTQEKPISSGAHDTLESIVQHATFQRYQPSKFTREEGHAPTSNSKNNNSIGAPYYGGEVQGVLSSTRKRTWSNANNSMLEECDILSGCASAGATFCRDNDTTMMTWVSLDQSGRSLKTMEEDSACHCGSEIRDNQDDRDSKAEVGQSNSKRRSRTAAIHNQSERKRRDRINQKMKALQRLVPNANKTDKASMLDEVINYLKQLQAQIQMMNMTSMPQMMVPLAMQQQLQMSMLARMGVAGLGMGMGMNMAAAAQTAGGPIRSLPQFIQPTTTTVCAPPPATAPVFVAPSFMMPPSMIQAPPKPQQLPASSASIASIHLPHPYSAAGLTQPINMDILSNMAALYQQQISQNNHQALSSSMPQPHHEQGR

SEQ ID NO: 111166 - protein, 492 aa, Glycine max
  Coding DNA Sequence Number=SeqID_19481
  Gene Ontology: Mol. function=transferase activity; Cellular component= mitochondrion; Biological process=embryonic development ending in seed dormancy
  Homolog annotation: Hit_ID=A7P4R5; Match level="QueryCoverage=85%, HitCoverage=54%, E-value=7e-63, Identity=33%"; Hit description =Chromosome chr4 scaffold_6, whole genome shotgun sequence
  Pfam annotation: Domain name=PPR; Domain location=160-194; Score =28.6; E_value=2.2e-05; Accession=PF01535.11; Description=PPR repeat
  Pfam annotation: Domain name=PPR; Domain location=336-370; Score =18.2; E_value=0.032; Accession=PF01535.11; Description=PPR repeat
  Pfam annotation: Domain name=PPR; Domain location=371-405; Score =22.6; E_value=0.0015; Accession=PF01535.11; Description=PPR repeat
  Pfam annotation: Domain name=PPR; Domain location=48-82; Score=3.8; E_ value=2.7; Accession=PF01535.11; Description=PPR repeat
  Pfam annotation: Domain name=PPR; Domain location=84-118; Score=29.5; E_value=1.2e-05; Accession=PF01535.11; Description=PPR repeat
  Pfam module annotation: Pfam domain module=PPR::PPR::PPR::PPR::PPR; Domain location=160-194::336-370::371-405::48-82::84-118
MTKDLLVFYCIGTFESACSSTLSATAATSGAPFTVPQSQYLHKGHCVYSCNAILGVLVRANCVNIAKAIYDQVLTKAILKPDVYTYTTMICGLCKVGMVESACKVFEEIPCEPNMVTYNTLVHEFCKKGDMEGATRVFDRLVESKSCKPGDDGRCSPNVVTYNALIEDLRLSGEADEARKMMSRMRLNGLKEDVANNTSLSKGFCIMGNVEAMFSKFILMMPKTQVKNQELNKGYIYLGCNTENKRGYISCGSVQVEGTSTWLFKENKGGYIPCGSLLVKDFTRLLEISRTGGCLGTGRRHGLLPNRPLVRIGKSDETVEHLREMVSRGMRPDVKAYRVVVVNEYCKIRKPSEAVLLLREMVVRGFKPSMSSFNAVFRVLVDEGKLDKRVLLLKQMPKMGCSPNFLFYCTVICGLCKVNGRMQQVEELIPDMLQNRHNLDATMYNCLLAGYCEDGDEEMTPKTGKLKDAKIVSEEMCRRCQLNGKVEATKEH

SEQ ID NO: 111167 - protein, 78 aa, Glycine max
  Coding DNA Sequence Number=SeqID_19482
MASVLPTAEAAGAGAGTEAVAHRCLFPTWVWKTVLVSVGVVWRSREGGLENAMALLGFFLSMLLNAKGHNLLWIRPMR

SEQ ID NO: 111168 - protein, 184 aa, Glycine max
  Coding DNA Sequence Number=SeqID_19483
  Subcellular localization annotation: CTP_CleavageSite=60; ConfidenceScore=5.02e-01
MWLHVRLVRLEPHQPYLPSSQQQKLQWTQPLFVLQQSQQLFQNHLVGSSLFYLCFSLSLSSSLPSSFCINFVLNFSGQFCFPGYFILSTICYLQLMKVLDLNFQFLYAHLFEVEDMMIEDDGQLLLMLDEVVLMVLHRTSVCIVKVVYLGWTQYLNRIPLVARRHMFIVGRVYTFGVFPHGMIL

SEQ ID NO: 111169 - protein, 388 aa, Glycine max
  Coding DNA Sequence Number=SeqID_19484
  Homolog annotation: Hit_ID=A5AXA9; Match level="QueryCoverage=57%, HitCoverage=58%, E-value=1e-20, Identity=29%"; Hit description =Putative uncharacterized protein
MDNNNNNSGFVPNNDTDDDCTFLQTLLEMDPQHFYLPTEEFDSLSQQQQQKNDPFGVEKGNKVSFLQGNNNNDFPIGEGVVPDVVDVEEEEGPPRGAGKELIPEGQGDRFFIHGDDIFFFGEGGVGNNVDPPQENQTQPPNNQDVRSLCPWPPPPEPFSCSCCEVLRQINYTNGVRFDKLEIHGTVGVINHAICHVEDKTSNRPPRDTYQIIDFCNKNTEEIRNFLNVYCKERIEAGFIPIEDPSMSAFYDALCTGMDWTEVSNDVDDDLANGTEQESESEPEAGNGRRASTSRPRRRDMAVQRQRVPRMTLSDLSGVFHLTISAAAVKLDVQSLAKKVRVLVRALNSPDPGVKRRTQDEIRRLQKEIIENCGGITPTGIPMLQFDEE

SEQ ID NO: 111170 - protein, 37 aa, Glycine max
  Coding DNA Sequence Number=SeqID_19485
MRTVWGDTRERFRIGGVDEEEGLAMASGMAEWPLAAN

SEQ ID NO: 111171 - protein, 311 aa, Glycine max
  Coding DNA Sequence Number=SeqID_19486
MVLVESLSSRESVGDESEEASRVDGKVFASPNQSSIVYVGRRRDVLDHSPCGSIKRHSACGVHVHEPGGDELRLLLHPSTGEGLVGITDPATEASDDINSMCQARRARIVVVGGPSQLLPPTRRLDLVRFWHMWCLSSAKIPRGNKNIRSKATENIGAFASCIRGKTSAEDLAPLDLEIEATCRRNNTARERRELQERSADQGDRRILSSESSSSIPTNLEEPVLSTFEATIMAEDIPLRVTLEDYSSSSMPQFFTSIARPDVQATNVSYPHSLIQLIQGNLFHGLPNEDPYAHLATYIEICNTMKIEGVP

SEQ ID NO: 111172 - protein, 940 aa, Glycine max
  Coding DNA Sequence Number=SeqID_19487
  Homolog annotation: Hit_ID=A5AY97; Match level="QueryCoverage=98%, HitCoverage=84%, E-value=5e-60, Identity=27%"; Hit description =Putative uncharacterized protein
  Pfam annotation: Domain name=DUF863; Domain location=142-928; Score= -52.6; E_value=2.1e-10; Accession=PF05904.2; Description=Plant protein of unknown function (DUF863)
MALMGMSANRQCNSYFPGYHSPRYLVFGAEGSTCTSSNGNSERENDCYQLGSLPLSSACHLLGYNKELLKQTILQHEAIFRDQIQELHRIYQKQKELMDEIKRIELHKRSLRLETSLSSSSLYYSQNMPWLTSQSSVLNAELIQLPLASMQEKSRELCPTPLAVPAPTAIKESLEDTKLSGLTCRKVGKKILDLQLPADEYIDSEGESCENERVIKQPPLSTYTSNGISKVVYNTVEKPYRINSNGFADLNLPFKLQKETGVESDDFGASIPHRNHTFHGMLGRMTSGSHNFPNDVIPNLKRRQDHEAYPDLPLPNQGQKHGWLPSGQNGSNLGFLAKFNDMESQSVSIDFISKKLKQVNNCPCFHSTSQIVPGSRTKSPAGTHDPTSGGLLGPSYASCTCAPHKLVSDSDMKSSGISPSVLWKSTTSGPNLDRRNYLPPISAGDLNSGDNFGSSSAGHELRKYVKDSEYVGTHKSINLNIMPTGCFDTTAASFQSVQITGEEDKFQDSRLPWLKAKPVPKGKPNEESQTSTQVDSFLLNPYKSGCMHSDLMFSKVEKSDFCTDKTLAFDLNGKPQTSKVFQSLFKNHWIEEIKISNVNSLCDSDPDMGEQAPAIEHFMKNEKKHKHLAGILDLNSCMNEDENMPIDIDLQAPVSPENKECSPPRGESDENQLEMLLQLAGQEQEQEQEQEQDLEEQEDQTGIAAEALVSISKTVAYDDLQMTTCPSSESSVSSSLHWFSGIVSTIVDHSQCEVKEDFNCTIKDLEDFLPADFDYFEFMSLNLTETKDLDYGCYKSSGPNEQEGGSTSPIQPRKCRTNRRRHGNDFQSEILPSLASLSRYEVTEDLQTIGGLVEAARRTHSATGCLRSAGRNALAKGKRRSCASASNNITDLLLNLKEVNIDTEIAIEKMGFISWGKICRKPRGKRVPTRKHLIFSQVHN

SEQ ID NO: 111173 - protein, 268 aa, Glycine max
  Coding DNA Sequence Number=SeqID_19488
MARIPDKIKDINGLKETLKLAVRITDLWFVGTPDKSEQAEMIIVDSNVVFQHVSSRSTRVVFKLKDLSDQLLSCTLWEDYCLQFLEYLNKCQSDDPIIVLLTHARIKEAQGSYPPSVSNSLKASKLLINQPMAKIQEFKHRYRLEVMVSHKEESTKFLLLDRECAELIGQSTDEVNKLKIADGDVDINASPEALDKLLGYVLAFKVKVQPKFRNVVVLKYSRDLTLINTIIELLPNAESVTGVSFMQQSLSGTADHDPLLGLLLTPTK

SEQ ID NO: 111174 - protein, 164 aa, Glycine max
  Coding DNA Sequence Number=SeqID_19489
  Homolog annotation: Hit_ID=A2Q1D6; Match level="QueryCoverage=67%, HitCoverage=17%, E-value=1e-12, Identity=38%"; Hit description =Ovarian tumour, otubain, related
  Pfam annotation: Domain name=AFT; Domain location=63-159; Score= -45.0; E_value=0.044; Accession=PF08731.2; Description=Transcription factor AFT
  Pfam annotation: Domain name=FAR1; Domain location=77-161; Score= -25.2; E_value=0.03; Accession=PF03101.6; Description=FAR1 family
  Pfam module annotation: Pfam domain module=AFT::FAR1; Domain location= 63-159::77-161
MYMYGAVRGHLFVMLKILHVLLWMYDSIMSKEDDTNDENEDEAGVNEEEHVDCSDAFNTFQMFATRDDVLQWARSVSYEIGFVAMIIRSDINTSMRGRTSFVLIGCERSGQYRPRKKDFVRRDTSSRKRGCPFKLCGKPVVGGQCWMVKLMCGSHNHEFAKSLV

SEQ ID NO: 111175 - protein, 113 aa, Glycine max
  Coding DNA Sequence Number=SeqID_19490
MKEVSDENHETGQIQAKGPSGEGQSPRVEKDEGPNNPCGVYPDLSSFTGSGVYPDLSSFTGSGVYPDLSSFTGSGVYPDLSSFTGSGVYPNLSSLFGSGVNQKLYSLYQTIHP

SEQ ID NO: 111176 - protein, 183 aa, Glycine max
  Coding DNA Sequence Number=SeqID_19491
MKDLSEIAHGGQCLSISVIQLWILHMTETSMRAGNIDLYGFLEPQSIQRSGQSQFESENYIKNWMQNSKWDVYLGAYLNGAHWQMVVILPKENVVIWFCSLHNKPDNYLKDIINRSVLFFNTFALALVSALKGLDDTQQSKSKPPARWIVVKYFTDPRPLEPERLKALRNQWTKYYLKVKNET

SEQ ID NO: 111177 - protein, 297 aa, Glycine max
  Coding DNA Sequence Number=SeqID_19492
MEGSGSEFSEAKTISWARKVELPIFNRSIEEGTNLKGSSFKCDKETKNDEAELAREKKIEKVMEEEVDLLIKGKKHKENRLTNVGCEDDFLDNPISNLIKNEVKFDMDDNSTLEPRQKGGTETIMMIQVIRSPPLSPSPLKPPELSLHEVASRFTVDPPWNDAKEAHPVSVNDSILKDEKEEGGVLEFCKGGPTFYIVGPAQMGYRNGIHKRGAKTWNSNWVAGCILLKLDVCVLDDMLKEHRWKEIEAPTKKSKGALSATSSAKRMIALLSPDVPCSACDQPLSPEGAHLAQRQCK

SEQ ID NO: 111178 - protein, 208 aa, Glycine max
  Coding DNA Sequence Number=SeqID_19493
MEAACRKRQGEDEEEPFSYLRQQTPRCTGVVPVCVFGAPPMQDVALQRRHDLELDIVGGVGVGEFIGLLIELLGLDAFVDKEGSITIVVDDEGLPLPGKDSGIVTGNSDGGVVLGGEDVGGASTDLGAKGGEGLNENDGLDGHVEGTETKSCLGKTTIPVLLTVGLSEKKESHEDSPNGGFNPFSVSLTFGNSIGAVGGKTGGILRNR

SEQ ID NO: 111179 - protein, 170 aa, Glycine max
  Coding DNA Sequence Number=SeqID_19494
MELAEEEEEALLGRRRKTREKTDEDAGERNSSSWEKEEDADEVHLCVPLLLLLHESLILPWCVLNPWLLRVRGFFSVSLLSSAVMSSVVSSTDVENVDNAANEPHKEPHDPVTKDERIELKLASHGRKLEKFGRPTLEIEDIVVAIGLSSLITCLLETSDKRLLSTFAGR

SEQ ID NO: 111180 - protein, 29 aa, Glycine max
  Coding DNA Sequence Number=SeqID_19495
MMTFPVLFRAPPQIALFDLGRTPVLMCVV

SEQ ID NO: 111181 - protein, 198 aa, Glycine max
  Coding DNA Sequence Number=SeqID_19496
  Homolog annotation: Hit_ID=A5BEV8; Match level="QueryCoverage=97%, HitCoverage=25%, E-value=6e-09, Identity=25%"; Hit description =Putative uncharacterized protein
MEMISKRFEELDVYGKVTLKSKLREIAYHDLNSMCAPSEMVKTKGAQKRPMTKQQISTQRDPSYWKHVDALHSEQNIVALLGMGEDSWSLERNHLLKELTKWSDDYINLVGGIDRFEELKRSLLVDGLSMVIMDKWMNITNMRYVIASSQSPTDSFVHRVICIDHVYGNHFVQVFLRDRCSLPPVVLLWSTHCHHQAK

SEQ ID NO: 111182 - protein, 85 aa, Glycine max
  Coding DNA Sequence Number=SeqID_19497
  Homolog annotation: Hit_ID=A2Q3U5; Match level="QueryCoverage=67%, HitCoverage=62%, E-value=2e-08, Identity=54%"; Hit description =Putative uncharacterized protein
MGRNNDFDQARKQIVYETLDDDNDEQIMSYLRAMQQQEGNNSQQRRPRRVINCNREDGHLQLMNDYFSENLIYIKTQFRCRFRMR

SEQ ID NO: 111183 - protein, 144 aa, Glycine max
  Coding DNA Sequence Number=SeqID_19498
  Subcellular localization annotation: CTP_CleavageSite=49; ConfidenceScore=5.47e-01
MTKNNLGMQKSKGHYKQAFIENCSKRTKNSTFGTYSSSSNPKTSIENAEADTSSPIVRPMGQKATKRKNKGKGVGTSTNLVDLTGVEEAMRKRNVLNAKLVALREKELEKEYYDILMNNIFTMSETQLEDHQAFYKIIRHKLGI

SEQ ID NO: 111184 - protein, 203 aa, Glycine max
  Coding DNA Sequence Number=SeqID_19499
  Gene Ontology: Mol. function=helicase activity; Biological process =viral genome replication
  Homolog annotation: Hit_ID=Q2A9E0; Match level="QueryCoverage=76%, HitCoverage=11%, E-value=1e-23, Identity=40%"; Hit description =Putative uncharacterized protein
MARDKLDSSAVCDLKLKLISDRQTDGRLYNLPNASEVAALIVGDEHTTNNKDIIIEKQTGMLQRINELHPTYLPLQYPLLYPHGEDGYRPNILHNIIRIAMLQRGTKMQSRDNEAQTILHSRRLFHQWVVDGYCMIESQKLNYVRQHQQELRVAKYINLNYCNNQPLTQGNEKVVYTIEWQKRGLSHAHILIFLHPSNKYPNP

SEQ ID NO: 111185 - protein, 96 aa, Glycine max
  Coding DNA Sequence Number=SeqID_19500
MDSPCVSLSQLSDGAISAEVDFLEVTPKKKIERTKDYKEKTIESNHEKTNFHAEVRKGVATGPRVMFRCHEGQILATTTHFLPHSYNIHVKALALR

SEQ ID NO: 111186 - protein, 284 aa, Glycine max
  Coding DNA Sequence Number=SeqID_19501
  Gene Ontology: Mol. function=heat shock protein binding
  Homolog annotation: Hit_ID=A7PDJ8; Match level="QueryCoverage=100%, HitCoverage=39%, E-value=9e-57, Identity=40%"; Hit description =Chromosome chr17 scaffold_12, whole genome shotgun sequence
MCRVQETLSKHSQVDASSENQSLAPAVDAFKRRRLTFAWLDGEKQKDYCQFYLGQAASEHTCGQRRGVTDIPRLFVIRYLRNSSAVDLRTEEKTKWKSLLVQDLINDSDQTGQFVAGYKGEDDVSQITHWLANIISDGDSRDLPFFTLRTPKLVPDDTEPIWSMSAQNIPLQNLKQSVLGVLSGLSAYREDPRVGPFLLLGALISLGTIWLRRSQQVQSPELNQPSFNQPSDSNQPSQPSSMDERKQKPSDRVRRRPNKKPPPSMTDLEPSDAYQMPLSDSESE

SEQ ID NO: 111187 - protein, 158 aa, Glycine max
  Coding DNA Sequence Number=SeqID_19502
MAELQFDSKIKTVQTDWGREFRPLTNFLASQDPNNPISFIPSIPIVPQPISSLSPSSNSVASPTSVNPTADSNSSPSPSVHAESSPTVASEVPSPTIDTGSTSVAALEIVSTVNSHPMQTRSKSGIHLPRLNPTLLLAHCEPKSVKEASADSNKNMRH

SEQ ID NO: 111188 - protein, 20 aa, Glycine max
  Coding DNA Sequence Number=SeqID_19503
MELGCDPHGYSRAGYDTVTW

SEQ ID NO: 111189 - protein, 282 aa, Glycine max
  Coding DNA Sequence Number=SeqID_19504
SGVGDEASTTFLLTLPLFALFFKEPIIAAKGLHTASASKLYLNLANLNYDNTNIAINVAECSKHALINKLKMKGVEPNFRAGACYGLRVWNEPSFDNGVGMRDRESGSVLFCLGFVLRSVRIWECGIEFGGSMLPLNLRSTSFGGDAIEAYSSLRIKTSQAIYLLSQRGLLKLEDRDFPSYLSSLSERLSTWIDSFYGGSLKLEDRDFPSNLSSLSERLFTWIESPYGGSLKLEDRDFSSYLSSLSERLSTWIESPYSGSLKLEDRDFSSYLSSLSERLTQA

SEQ ID NO: 111190 - protein, 82 aa, Glycine max
  Coding DNA Sequence Number=SeqID_19505
  Gene Ontology: Mol. function=phosphoprotein phosphatase activity
  Homolog annotation: Hit_ID=A7R0W1; Match level="QueryCoverage=91%, HitCoverage=20%, E-value=2e-12, Identity=45%"; Hit description =Chromosome undetermined scaffold_325, whole genome shotgun sequence
MKRHEFLWEPYTINVMSVLPPISLVGSVVWCVVVPLICFQVIEWHQPDRVLRQFEMQQPILGCPSQPLDIHDITLKDKHDEN

SEQ ID NO: 111191 - protein, 102 aa, Glycine max
  Coding DNA Sequence Number=SeqID_19506
MEVGGTVEEEGVGASDAEVEGALDLLPQAFLGPLKARTLSPVKDKSEDFESYETSQQLIGLGSSSSNDSFASWKMNGSRMEKEEREETPLQGEDESRRSSPP

SEQ ID NO: 111192 - protein, 168 aa, Glycine max
  Coding DNA Sequence Number=SeqID_19507
  Homolog annotation: Hit_ID=Q6WAY6; Match level="QueryCoverage=95%, HitCoverage=26%, E-value=2e-08, Identity=29%"; Hit description =Putative uncharacterized protein
MGTRGCICYNPVHAIRQLGYAMRGAPLEEELAPVISRGFNKTNVDTLQKVRKAWEVVQKKDKELRGNNNGPIGGYPKWLKSHVQGLDCLPSLRTAKREEVEAPEEDEEVQALRAELEQAQIVKERLKSAALKIRKENAELRDMNIATTKALEQETKRAHREEHGRNKL

SEQ ID NO: 111193 - protein, 217 aa, Glycine max
  Coding DNA Sequence Number=SeqID_19508
  Homolog annotation: Hit_ID=Q5XM22; Match level="QueryCoverage=19%, HitCoverage=22%, E-value=4e-09, Identity=69%"; Hit description =Resistance-like protein HAAS-2
LDEASRTTTRQLARYLTLLQCWIYEYFPSLHQCVTDDTYQETSPRASRWLTSMAHMKGITGAPYRAHCDALTVTDVSWLPYTEHRGSIPPPPVSARLSHNDIDDRWMHFAEHVLPAGELCLVPGQVTQLRDAPAVDPEEYIQPPSPQVPVAFDPLPHVDDYDGYEAIAQRLERVLNLRMVTAGTELYEIMQDYLTITRGGASADGSVKTRQRRRTEH

SEQ ID NO: 111194 - protein, 267 aa, Glycine max
  Coding DNA Sequence Number=SeqID_19509
  Subcellular localization annotation: CTP_CleavageSite=17; ConfidenceScore=5.24e-01
FRSGVGGGTALGVLYTSSASRPSRDGRFSGSDASSSGTTKIVLEFYANAWPTEEGVRDMRSWGQECEYGQRRNRSDGFDEEAIAQLLCIPGQDFARTAAGRRVRIMRTNMTALTQIWMTLLLSNILPTDHNSDLPMPKCQLVYAILTRMSIHVAQLIADAIYIFAGMAPTRHPLDPDKSNRALGFPALITGLCQSFGVPVAPTKVIRPLITRAFIEKYCTQRQGQGDAPQAAGAPPPPHRAGQAGAFDMEQYLRHLVRQQAANHRAH

SEQ ID NO: 111195 - protein, 113 aa, Glycine max
  Coding DNA Sequence Number=SeqID_19510
MTLGLATQECRLAEMLGYSVCKVSLAGKEPAKAKGCSAQQMPQGISLGAEDPGLARDQSIKNFTKLPRLSELGSLSHMYYTRRMSVHPQEINSLSAAGALSEFFRKTPIFNEY

SEQ ID NO: 111196 - protein, 201 aa, Glycine max
  Coding DNA Sequence Number=SeqID_19511
  Homolog annotation: Hit_ID=A0ST23; Match level="QueryCoverage=12%, HitCoverage=51%, E-value=6e-07, Identity=100%"; Hit description =Putative reverse transcriptase
DLVTGIYSAQSASAVPPVQLLTGWCVTAKAPPDISAGKCSGRVPFAIQAAQLLGRAIGAGLFAITPAGERGMCCKAIKLGNARVFPGGVSKRENVRSNEEYNDVARHANTRNFQKHSLELGGARYQLLFPLVRVNFELGVIMVIAVSFGKPVVPAALMNRPTRGERRFAYWALAECILAYYVGTDEGVSEVLHVAGEKRLH

SEQ ID NO: 111197 - protein, 176 aa, Glycine max
  Coding DNA Sequence Number=SeqID_19512
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=48%, HitCoverage=71%, E-value=5e-24, Identity=68%"; Hit description=LacZ protein
  Subcellular localization annotation: CTP_CleavageSite=46; ConfidenceScore=5.52e-01
MKHFTDTLISANIVSPVYTPLAPNTQTASPRALADSLMQLARQVSRLESGQSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 111198 - protein, 195 aa, Glycine max
  Coding DNA Sequence Number=SeqID_19513
  Homolog annotation: Hit_ID=Q2HW90; Match level="QueryCoverage=72%, HitCoverage=34%, E-value=6e-14, Identity=28%"; Hit description =Putative uncharacterized protein
MAEDLHRGHCLPRQYYDRPLRCFTFGDFPVITMVEEFEEILGCPLGGRKPYLFSGFYPSLARISKIVQILAGEWAPFIDILTLLIFRGVLFPNVDGLVDLAVIDTFLAFHDRKESPVVAILADLYDTFDRRCEKSSTRIVCCTPALYVWLVSHLFRQEVRHACPLESHRSWTEKGGANWDRLLANKEGASANWFP

SEQ ID NO: 111199 - protein, 77 aa, Glycine max
  Coding DNA Sequence Number=SeqID_19514
MNLITVIKRKEHALRCPYRTRARARVMGEVEEVQKQMKANMEAMKEQMATMMEAMMSMKKIMEANAVAVADTNVVAK

SEQ ID NO: 111200 - protein, 102 aa, Glycine max
  Coding DNA Sequence Number=SeqID_19515
MSDTMSRTSCLKILELLKALKLQDPRCRDTMSRTSCPKILELLKALKLQDPRCRIRYFQENDRSHPAQAVAAQKRTLLYNHGGCTSSVPSPGLKSYFVSFGT

SEQ ID NO: 111201 - protein, 239 aa, Glycine max
  Coding DNA Sequence Number=SeqID_19516
  Homolog annotation: Hit_ID=Q6WAY6; Match level="QueryCoverage=75%, HitCoverage=39%, E-value=1e-18, Identity=30%"; Hit description =Putative uncharacterized protein
VDSRGSPDKGEWVPFIDILALLIFGGVLFPNVDGLVGLAAIDAFLTYHNHKESPVVAMLADPYDTFDRRSSVNWFPRWKEGRTGVLISCGGFPNVPLMGMRGYISYNPVLAIRQLGYPMRGAPLEEEIVPVISRGFNKTNVETLQKVRKPWEVLQKKDKELRGSNNGPIGGYREWLKAHVQGLDWLPSLRTTKREEDKAPEEDEEVQALRTELKQAKTVKERFKSAALKIRKENAELRD

SEQ ID NO: 111202 - protein, 244 aa, Glycine max
  Coding DNA Sequence Number=SeqID_19517
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLQSLPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 111203 - protein, 151 aa, Glycine max
  Coding DNA Sequence Number=SeqID_19518
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-25, Identity=53%"; Hit description =Putative uncharacterized protein
  Subcellular localization annotation: CTP_CleavageSite=18; ConfidenceScore=5.49e-01
MTMITPSSKLTLTKGNKSCSDVGVKSVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 111204 - protein, 187 aa, Glycine max
  Coding DNA Sequence Number=SeqID_19519
  Subcellular localization annotation: CTP_CleavageSite=46; ConfidenceScore=5.04e-01
MPSHSGTFPISPNPWKEFEENSRMSLSGGRKTHIFSSRGVSPSLSRIATVVKDSARGLDPHKTDSERHSGPATEVPRRQGEGYGQSRRLGPVYGCVSFANFWVVLFPNVDGLIDLAAIDAFLAYHHSKESPVVAVLADLFDTFDRRCEKSSARIICCLPALCVWLVSHLFQQDTRHPCSAPEPSLMY

SEQ ID NO: 111205 - protein, 269 aa, Glycine max
  Coding DNA Sequence Number=SeqID_19520
  Homolog annotation: Hit_ID=UPI00016621D1; Match level="QueryCoverage =60%, HitCoverage=40%, E-value=1e-11, Identity=33%"; Hit description =UPI00016621D1 related cluster
MTGPLDESISCFLKRVDPWVLVPITFRGLHVLAIRGLHVLTIRGLHALTFRGLHALTFRGLHVLTIRGLHALTFRGLDVLAFRGLDVLVFRGLHALTFRGLHVLASRGLHVLAFRGLHVLAFRGPHALDFRGLPALAFRGLPVLPFRGLHVLAIRGLHALTFRGLHVVAIRGLHTCAPGYGASCFLLSVLGPPYDIGGRPTVRAQPERKAIMQLLCIPGQDFTRAAAKRRVRVMRTNMTTLTQIWMTLLLNNIPPDDHNADLPPTEGIL

SEQ ID NO: 111206 - protein, 187 aa, Glycine max
  Coding DNA Sequence Number=SeqID_19521
  Gene Ontology: Mol. function=glutathione gamma-glutamylcysteinyltransf erase activity
  Homolog annotation: Hit_ID=A5C9E2; Match level="QueryCoverage=94%, HitCoverage=23%, E-value=4e-23, Identity=36%"; Hit description =Putative uncharacterized protein
MVDVSPIKADIVEQIRTTGLFKHVTRWLDSESSCCNTLANLGDKDMLPALAASVCCQAADLLTVCGKLKTLTESTIRERALTAQHSSMITISKFEYEYLTNHVASVEEIADKKVAATEAWIEALKANEKEILMETKIAQRQLKESKLEQELEVYTKEKMLSRRVSSSGELDNWPRKHEKSSSKNFIV

SEQ ID NO: 111207 - protein, 109 aa, Glycine max
  Coding DNA Sequence Number=SeqID_19522
MGPDGCRETRGTGTRETVCKPRLDLSIQKKIQKLFFSSPTLLFFSLSPPPLLPIKAPNFAHHFYSRLQREAIFEVVKRTSTLWDFEFQLWVDFFSHEFRGYWVFGRYDG

SEQ ID NO: 111208 - protein, 165 aa, Glycine max
  Coding DNA Sequence Number=SeqID_19523
  Gene Ontology: Mol. function=oxidoreductase activity, acting on the CH-OH group of donors, NAD or NADP as acceptor; Cellular component =cytoplasmic vesicle; Biological process=lipopolysaccharide biosynthetic process
  Homolog annotation: Hit_ID=A8GDR7; Match level="QueryCoverage=99%, HitCoverage=24%, E-value=2e-84, Identity=89%"; Hit description =Bifunctional polymyxin resistance protein arnA [Includes: UDP-4 -amino- ...
  Homolog annotation: Hit description=4-deoxy-L-arabinose formyltransferase (EC 2.1.2.n1) (UDP-L-Ara4N formyltransferase) (ArnAFT); UDP-glucuronic acid oxidase, UDP-4-keto- hexauronic acid decarboxylating (EC 1.1.1.n1) ...
  Homolog annotation: Hit description=(UDP-GlcUA decarboxylase) (UDP -glucuronic acid dehydrogenase) (ArnADH)]
  Pfam annotation: Domain name=Formyl_trans_N; Domain location=2-165; Score=41.6; E_value=6.8e-10; Accession=PF00551.10; Description =Formyl transferase
MMKAIVFAYHDIGCAGLKALTEAGYDVQAVFTHTDDPGENNFFSSVARLGAELDLPVYAPEDVNHPLWVDRIRALQPDVIFSFYYRHMLSDEILSLAPQGGFNLHGSLLPRYRGRAPVNWALVNGETETGATLHKMVKRPDAGDIVGQQKVAIADGDTALTLHKK

SEQ ID NO: 111209 - protein, 78 aa, Glycine max
  Coding DNA Sequence Number=SeqID_19524
MPIETGRLKANYLPIASMAETEIATNPSPWRKKRVADFFIPGQAIGSLVWLPVELIPALAERLPCRPIPLPFVSYPPI

SEQ ID NO: 111210 - protein, 247 aa, Glycine max
  Coding DNA Sequence Number=SeqID_19525
  Gene Ontology: Mol. function=peptidase activity
  Homolog annotation: Hit_ID=A5BCJ6; Match level="QueryCoverage=59%, HitCoverage=38%, E-value=8e-13, Identity=27%"; Hit description =Putative uncharacterized protein
MQILIEAIDLNIWEAIEVGPFIPTKVVGNATIEKPREEWNDDEKRKVQYNLKAKNIITSTLGMDEFFRVSNCKNAKEMWDTLQILLTKVLRCLSRQMTTKSNRQFAKSRDLANMPLATLFWKTSEHEMELMRLHHHEENDIKRKGIALRTSSSFIQEESDKEDLTETEEDDDDFRLFVKRFNKFLRNKRNKRKSNINTKKKEEDSFLAPSCYESNQPWHMRSDYLVFERRIEKSDKRNLKEKKEKKA

SEQ ID NO: 111211 - protein, 47 aa, Glycine max
  Coding DNA Sequence Number=SeqID_19526
MEAITMEKGLPPRSSNLRCDNCQRTGGISKRNGMSMQNVLEVEAFDC

SEQ ID NO: 111212 - protein, 232 aa, Glycine max
  Coding DNA Sequence Number=SeqID_19527
  Gene Ontology: Mol. function=ribonucleoside-diphosphate reductase activity; Cellular component=ribonucleoside-diphosphate reductase complex; Biological process=DNA replication
  Homolog annotation: Hit_ID=B0CGJ3; Match level="QueryCoverage=81%, HitCoverage=15%, E-value=2e-99, Identity=95%"; Hit description =Ribonucleoside-diphosphate reductase, adenosylcobalamin-dependent
DDEDETTQSRALIEAPAAARAVQVTERIVEKVVEKIVHEREKLPNRRQGYTQKAVVGGHKVYLRTGEFGDGRLGEIFIDMHKEGAAFRAMMNNFAIAVSLGLQYGVPLEEYVEAFTFTKFEPAGMVIGNDAIKTATSIIDYVFRELAVSYLGRNDLAHVDTSDFGNTALGKGIKEGKTNLVSTGWTRGYKPTLVTNSNNEAKGSTSSAPQASNVTTLKSTSPAGNRPATIGL

SEQ ID NO: 111213 - protein, 82 aa, Glycine max
  Coding DNA Sequence Number=SeqID_19528
METKAEMRHLVSPDARSVEAKKHHKKSNGGNGRADTYDKPMDSEMEGHPTNNILCWARRKSVASLFKEEEVPKAIKYGPPPL

SEQ ID NO: 111214 - protein, 70 aa, Glycine max
  Coding DNA Sequence Number=SeqID_19529
MYDLEDKSPKQVKVRGQWIPFDSAALNSFLETPVIIEEGESLPAYARLVLLRPNSQELAAYLCIPGKGLN

SEQ ID NO: 111215 - protein, 159 aa, Glycine max
  Coding DNA Sequence Number=SeqID_19530
MGSSQKPSFKKRFYQVKIKSLEVTSLRELGQLMGQLQRQAFRKAYAIDVFLAYHNHKESPVVAMLADLYDTFDRRCEESNARIVCCTPALYVGLVSHLFLQEGRPVYPLQGYRSCVEKGKANWDQLLASMGGRLLIGSLARRKEESRFYLHAKDVQMFP

SEQ ID NO: 111216 - protein, 147 aa, Glycine max
  Coding DNA Sequence Number=SeqID_19531
  Subcellular localization annotation: CTP_CleavageSite=41; ConfidenceScore=5.68e-01
TAAGADPAAGRAARCPAPPPPRSPRLRTARRTRRRDRSRLRGSAYRFPGRADPNLARRSSPGRLAVYRPAGDTGLWPVTFRQIDNKTDAAIVEAFGDAQLRADLVGQVPGDGQSQSAAGLLRAGHAVKAFKQARKVLFAHSGAVVAQ

SEQ ID NO: 111217 - protein, 284 aa, Glycine max
  Coding DNA Sequence Number=SeqID_19532
MTYEDLLPSLVANQMAVISPGRVHQPPFPKWYNPNATCADHGRTSGHSIEQCMAFNARGAVNVVESGRPRRSKPLKDVTTPTRFIYEALQKGGIIPRGGHEKDSYLMHPSAPHSMEACLAVGDLLQQMIDQGRLEVGDEGGEEQHICIQSTDEEGLRKPKPLVIHFTRDAARQTPRHPSVVRPIPFPYKNSHAVSWRYAPPSERKEGATDISSLLAKVTNITGLSGMTRNSHVFAPPDLPTQPANTKGKARMTEGQNVKVIPAPDEDVSMKGLSEERDGCDKKE

SEQ ID NO: 111218 - protein, 97 aa, Glycine max
  Coding DNA Sequence Number=SeqID_19533
MGVQIATRPTWALQKIPPEGCCFWRKQPCSPGQAGEVKKGSAPEALLSLSNLLGKIVSVKKIQAEAFPKRFREEFREGFDRSSMFFIRSSSFFDLQQ

SEQ ID NO: 111219 - protein, 147 aa, Glycine max
  Coding DNA Sequence Number=SeqID_19534
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MKHFTDTLISANIAEIEEQSSQEPQHNPHSQHLLLQLIEFLQPGGSTSSRAAATAWSSNSPYSESYYNSLAVVLQRRDWENPGVTQLNRLAAHPPFASWRNSEEARTDRPSQQLRSLNGEWDAPCSGALSAAGCGGYAQRDRYTCQR

SEQ ID NO: 111220 - protein, 98 aa, Glycine max
  Coding DNA Sequence Number=SeqID_19535
PETCQKSKGSRLAQSVKFRDVAEIEKRSFLQKAVASGGSNLARLGELGGKLLPYFAINRGRSEEEKGSAFFALLPLSKLLRKILFVKKIQAEALPLQR

SEQ ID NO: 111221 - protein, 434 aa, Glycine max
  Coding DNA Sequence Number=SeqID_19536
  Homolog annotation: Hit_ID=Q6WAY6; Match level="QueryCoverage=76%, HitCoverage=60%, E-value=6e-38, Identity=31%"; Hit description =Putative uncharacterized protein
FYQVKVKSLDVTSLKELGRLMGPLQRQAFRKINGKILDLTAAEVFIEAVVTLAQYYDQLLRCFTFRDFQMVPTIEESEEILGCPLGERKPYLFSGFLPSLSKIAAMVGDSAKELDCMKQIRNGVVGLPRKYLEGKARDMASQEKWGPFADILALLIFGVVLFPNVDGLVDLAAIDAFLAYHHSKESPVVAILADLFDTFDRSVRKIVHGLSVVYPLSVCGRVDWDQHLAEIGGSAINWFPRWKEGKEGVLFSCGDYPNVPLIGTRGCINYNPALAIRQLGYPMRGAPTEGSLSPFLLKDLGAQGLKVIQRIHKAWRSPLRKDKELRGIRNGVIGGYHGWLRIHTRGLDWLSKLKVIDEENFEAPEEDEEVRALKLELGKARLAKEKFKSAATHIQKEYTELQEENAATARALEQETKRARKEEYGREKFRGALW

SEQ ID NO: 111222 - protein, 85 aa, Glycine max
  Coding DNA Sequence Number=SeqID_19537
  Gene Ontology: Mol. function=ATP binding; Biological process=defense response
  Homolog annotation: Hit_ID=A2Q4E5; Match level="QueryCoverage=62%, HitCoverage=6%, E-value=3e-13, Identity=62%"; Hit description =Disease resistance protein
MMRTKSSNYYRLEGLSEEHSLSLFLKSAFDDGEERKHPQLVEIGKEILKKCGGIPLAVKTLGSLLFSKVDRKQWESIRVCLDGGI

SEQ ID NO: 111223 - protein, 189 aa, Glycine max
  Coding DNA Sequence Number=SeqID_19538
MTLHALYQRSLRSDMNKMNASLYVTEYDEFRRELERRSWHKALTRKPEGHIDVALVKEFYANLFDPEDKSPRQELAARLCIPGRRFVLNAEGAPWKLLRKDLTTLALTWSVLSYSNLAPTSHTSDLNMDKARLVYGLVMKIDMDLGSIISGQISQMAQSYSSRLGFPALITCFFASPEEWSLTQSILSP

SEQ ID NO: 111224 - protein, 341 aa, Glycine max
  Coding DNA Sequence Number=SeqID_19539
  Gene Ontology: Mol. function=structural molecule activity; Cellular component=flagellin-based flagellum basal body, distal rod; Biological process=flagellum organization and biogenesis
  Homolog annotation: Hit_ID=A1FR11; Match level="QueryCoverage=76%, HitCoverage=100%, E-value=1e-141, Identity=98%"; Hit description =Flagellar basal-body rod protein FlgG
  Pfam annotation: Domain name=DUF1078; Domain location=302-340; Score =78.0; E_value=3e-20; Accession=PF06429.4; Description=Domain of unknown function (DUF1078)
  Pfam annotation: Domain name=Flg_bb_rod; Domain location=85-115; Score=55.1; E_value=2.4e-13; Accession=PF00460.11; Description =Flagella basal body rod protein
  Pfam module annotation: Pfam domain module=DUF1078::Flg_bb_rod; Domain location=302-340::85-115
MDGMFSNTDSRQPFAPAQGTAVHSGQLEGSNVDAAEPTACSAWAVDGFRAPPGRGAGTPLAHPLPRAALRGRLHPDRTPKMNQALWIAKTGLDAQQMRMSVVSNNLANTNTTGFKQDRASLEDLLYQQVRQPGGSSSEQTQLPTGLQLGTGVRVVATAKKFEQGGQQQTGRALDVMVNGRGFFEVQMPDGSSAYTRDGSFKINQDSELVTNSGYPVQPGIQIPEGAQSVTIGTDGTISVKMADGAASVEVGALTLTDFVNPAGLQARGENLFLETTASGPAQNGNPGLNGLGTVVQGALEGSNVNVVEELVSMIETQRAYEMNAKTISTTDSMLGYLNNKL

SEQ ID NO: 111225 - protein, 152 aa, Glycine max
  Coding DNA Sequence Number=SeqID_19540
  Homolog annotation: Hit_ID=A0ST23; Match level="QueryCoverage=16%, HitCoverage=51%, E-value=3e-07, Identity=100%"; Hit description =Putative reverse transcriptase
  Pfam annotation: Domain name=Ins_element1; Domain location=4-72; Score=-11.0; E_value=0.0014; Accession=PF03811.4; Description =Insertion element protein
  Subcellular localization annotation: CTP_CleavageSite=33; ConfidenceScore=5.47e-01
GAPVASVSISCPSCSATDGVVRNGKSTAGTSALASVAAAQLLGRAIGAGLFAITPAGERGMCCKAIKLGNARVFPDHQAYRYRRPRGGARYQLLFPLVRVNFELGVIMVIAVSFGKPVVPAALMNRPTRGERRFAYWALAECILAYYVGTDE

SEQ ID NO: 111226 - protein, 180 aa, Glycine max
  Coding DNA Sequence Number=SeqID_19541
LHVLAFRGLHALAFRGLHALTFKGLHALVFRGLHVLAFSGLHVLAFRGLHICVFIGLKGPVVSLYQPLGHPPDLGGGPTVRAQPEGGYRATTMHTGARFHSCHYKEMSADHAHQHDHSYTDMDDLWLRASVSPIGCPSPPARDRARKTPSGPGEVQQGLGVSSSDYRPLLVLRSACRPQQ

SEQ ID NO: 111227 - protein, 43 aa, Glycine max
  Coding DNA Sequence Number=SeqID_19542
GSRPQDTSGPGGANRALGFPALVTGLCQSDGSLLEWLLWRLDL

SEQ ID NO: 111228 - protein, 177 aa, Glycine max
  Coding DNA Sequence Number=SeqID_19543
MTCRKCKSIGSRPTTQYDTKRFSSLDAWNRYTDNVLGRNILPERKVELYHTELDDFKTELERRNFHKCLTNLVDGSIDLALVREFHANLYSSEGPSPKQSRVRGHLVKIDADSLNTFLETPVVLAEGETLPTYSRYCRLPIDYREFVVALCIPGQGFILNTEGHPGKILRKNLTTLA

SEQ ID NO: 111229 - protein, 46 aa, Glycine max
  Coding DNA Sequence Number=SeqID_19544
MGRAFSKLDCFWGLGGNLLPLFPINRLKGAVLRARIPLVMYFSCFG

SEQ ID NO: 111230 - protein, 96 aa, Glycine max
  Coding DNA Sequence Number=SeqID_19545
MDINPTYRLSIGASMDPLSGSRPLHTPPEAEICGGRTFGHSMGLGRRPGGNQCLHRIPPKVAPAVWRGNDGGQGNVRACGTSLKWVWARIMAAGTA

SEQ ID NO: 111231 - protein, 62 aa, Glycine max
  Coding DNA Sequence Number=SeqID_19546
MDAHPCQDGIHQLTLRQREVGVMIIGQDIAEQQRHPHLGQGGHAGVHDPHLPPGSGSSKILT

SEQ ID NO: 111232 - protein, 235 aa, Glycine max
  Coding DNA Sequence Number=SeqID_19547
MTTLTQIWMTLLLNNIQSSDHNSDLPLPKCQLVYAILTWMSIHVAQLIADAIYIFAGMVPTRHPLDPDKSNRALGFPALIAGLCQSFGVPVAPSKVIRPPITRAFIKKYCTQRRVPQAADAPPPHQAGPAGSFDTEQYLRHLVRQQAANHRAHVQTHDCLYQMSLSLQSQGFTSFPCPTPDQFRAEVAWPGDWPEARAREAPAEEPAEAPDEADEAREDEEMADLLDFLGGSGAT

SEQ ID NO: 111233 - protein, 72 aa, Glycine max
  Coding DNA Sequence Number=SeqID_19548
MSIKGGAGGASGGVRISTSREAGGSTTGGCDSAGAGSVLVGMGLRGTTSGDLKIDPWILLACYETTAAGCRQ

SEQ ID NO: 111234 - protein, 44 aa, Glycine max
  Coding DNA Sequence Number=SeqID_19549
MEKNEETTMEEKCYPLGNKPWKKEFYHQEYALDKKLIEEASMEE

SEQ ID NO: 111235 - protein, 105 aa, Glycine max
  Coding DNA Sequence Number=SeqID_19550
MGSKSTLRLMRTLGPSLESLAQSTWSLLANALARLTVGNWLCDSDLVNPTGIEQVFTEKDLLADSYSDLEASILDENEFLLLKALIPEISGGEGSNGLIGSKNAG

SEQ ID NO: 111236 - protein, 112 aa, Glycine max
  Coding DNA Sequence Number=SeqID_19551
  Subcellular localization annotation: CTP_CleavageSite=32; ConfidenceScore=5.44e-01
MGFSPILLNNSSTSGGVNPSVSRSRNIVFDLVATYPSTGGRGEKPKERLLMKKTRGVATNVYSRKTLEKPKRGLRILKRRVRELFTHGECISTPRACHEGWQPRLAKVRKAG

SEQ ID NO: 111237 - protein, 269 aa, Glycine max
  Coding DNA Sequence Number=SeqID_19552
MVKEECKEVSVSSKRLAKKERHFEIKTNIKEISLLRQPPHFLLCKKTLVSIATSLRLEFIPQVKELLDEGLVRKRLNPCALLVAKIGIIRHQIPKIGGVRNALGGATLFCKITHAPNIFMICVHRDSLGRVPMNPKRIKVIPEWPAPPSVRKIWGFQDLTTFTKVLRKKPRVSRTSGFEVKSFSRGREHDVSSIGACRPRIFFINGFLCFLEDEWQRNGERKREKRRHFKEKMILEEAHHHRRPWIRAWRKKEMNEGRGREEHEILCSK

SEQ ID NO: 111238 - protein, 173 aa, Glycine max
  Coding DNA Sequence Number=SeqID_19553
  Subcellular localization annotation: CTP_CleavageSite=41; ConfidenceScore=5.46e-01
MAESSKKQKGTSSTTAAAGHRRHGPSEAPTAPIHSSLSSLRSSTLFSSDDQRLRYNSQFSSRIILDPKYLDTDFFNDETFDCYQVFQNSGLVDFMSLKLPYYPELVEFFYSNLTIHDGIISSEVHGISMIIDQSLFFSLTKLPSQCAPFEGTIVDDWKFDYSSHDARCMVCND

SEQ ID NO: 111239 - protein, 276 aa, Glycine max
  Coding DNA Sequence Number=SeqID_19554
PEEDEEVQALKSDLGKAKLAKEKFKLAATHVRKECAGLREENAITARALEQETKRARKEEYGRNKFRGALWGSNSELKLRKEERDQSRAHSMVLKEELVACSRSKRSLSQCLCETETNMLAIIAKYQEELGLAAAHEHRIADEYAQVYTEKEARGRVIDSLHQEATMWMDRFALTLNASQELPRLLAKAKAMADTYSAPEEIHGLLGYWKNTITKRAARDPYRTRSKSRTMGDQEETQEQMKADMSALKEQMASMMEAMLSMKQLIEKNAATAAAA

SEQ ID NO: 111240 - protein, 189 aa, Glycine max
  Coding DNA Sequence Number=SeqID_19555
MASMMEAMLGIRQLMEKNAATAAAVSSAAEADPTLLAIAHHPPSNIVGRGRDTLGHYGSPHLGYNRAAYPYGLLPNYSPPVLQDDAGHIASPVLEREPPQQPEEVPKDPQDYAQRDVEFYPPIPEGPAPSTLPQPNIATQPIVLSTEGPPPATEEKRKLDLLEERLRAMEGFGDYPFADMTDLCLVPML

SEQ ID NO: 111241 - protein, 139 aa, Glycine max
  Coding DNA Sequence Number=SeqID_19556
ELEICAHGVWASKIPFDRDALNHVLGPATLEEGQQCEYDERRSQVSGFDEDAIAQLLGIPGQDFARTAARRRMRILSLAHQWAKRASTAKRSFSVTKESGRASISTPHAKREINALSTTVVFNQAQRTTSAKLKSTYSH

SEQ ID NO: 111242 - protein, 57 aa, Glycine max
  Coding DNA Sequence Number=SeqID_19557
MAREIGPRPKQERHPQKLPAMEKKPTRMRRWPICLTSWEGVEIRDWEIPRFIAYIFV

SEQ ID NO: 111243 - protein, 93 aa, Glycine max
  Coding DNA Sequence Number=SeqID_19558
MNDEEQLKIFAKLPTKIKIGEELATQLAQVSSARPGEPGCFLQKQPPSGGRIWKAQVGLTYQGNPCGVYPDLSSFTGSGVIQNLRSLYQAICS

SEQ ID NO: 111244 - protein, 145 aa, Glycine max
  Coding DNA Sequence Number=SeqID_19559
  Pfam annotation: Domain name=zf-CCHC; Domain location=73-90; Score =15.1; E_value=0.0079; Accession=PF00098.14; Description=Zinc knuckle
TDKRKRSIALKASSIQEEEEEEEEEEEEEEESDDEEDFSLFVKKFHKFVKNRRIERSRNFNNGKRSQEVSPTLKFYKCNQPNHMKANCPSNESWHRENEKKSYKERRSKKAYVAWDDNDSSDGSEKEINLLSKDYGSDENISQED

SEQ ID NO: 111245 - protein, 433 aa, Glycine max
  Coding DNA Sequence Number=SeqID_19560
  Gene Ontology: Cellular component=viral envelope
  Homolog annotation: Hit_ID=Q84VI1; Match level="QueryCoverage=100%, HitCoverage=67%, E-value=0.0, Identity=76%"; Hit description =Envelope-like protein
MDKKIRSIVSSILKDASVPDAEKDVPTSSTPSVSVPDAEKDVPTSSAPNAEAFPSPSEEESTEEEDQAAEETPAPRAPESVPGDLIDLEEVESDEEPIANRLAPGIAERLQNRKGKTPLKRSGRIKTMAQKKSTPITPATSRRSKVAIPSKKRKEISSSDSDEDVELDVSTSKRAKKSGRKVPGNVPDAPLDNISFHSIGNVEKWKYEIVDLIKAAGLLKTVSKLGECYEGLVREFIVNIPSDISNRKSDDYQRVFVRGKCIRFSPAVINKYLGRPTDGVIDIDVSEHQIAKEITAKRVQHWPKKGKLSAGKLSVKYAILHRIGAANWVPTNHTSTVATGLGKFLYAVGTKSKFNFGNYIFDQTVKHSESFAVKLPIAFPTVLCGIMLSQHPNMLNYTDSVMKRESPLSLHYKLFEGTHVPDIVSTSGKAAAS

SEQ ID NO: 111246 - protein, 845 aa, Glycine max
  Coding DNA Sequence Number=SeqID_19561
  Gene Ontology: Mol. function=glutamate N-acetyltransferase activity; Biological process=arginine biosynthetic process
  Homolog annotation: Hit_ID=A7MQ29; Match level="QueryCoverage=65%, HitCoverage=77%, E-value=0.0, Identity=71%"; Hit description =Putative uncharacterized protein
  Pfam annotation: Domain name=DUF586; Domain location=484-562; Score =177.7; E_value=2.9e-50; Accession=PF04524.3; Description=Protein of unknown function, DUF586
MLVPVEEANEAETLSPVKSLLRHRFALPGLLSAGVLVGLCVGLLMSGGDDPAAPAETVQNSAPAADPAVSPSASSAPAATAAVTPEKPREAEPQPAPPPEPVAQVYIKLQQGERVQGFIMFSRITAQLPMDGLLFWKLTGAEALSQSFELNAELLATDARIDRHALLGQPVTFTLPTQSLLSPRYLNGKITRVAVRSEELSGTRYAVYQLRVEPDLWPMRRDRNLRIFQGQTVPQIVQTLLQENGVNVETRLGSSYRVWEYCVQYQESSFDFISRLMELEGIYYWFRHEAERHVMVLCDGADQHEAFAGYETIPYHVTASGGSVTEEGISQWSLCESVTPGMYSTDDYDFRKPNAWMLQARQNPVSPVPGAVDVYDWPGHFVDHSHGEFYTRIRQEVWQVAHHSVSGTGTATGIAPGYRFGIVNAPHFSDNGEYLVTSARYDFEENGYASGGGGARHNIAFTVLPSSVTYRAEPATAWPKTHGPQTAKVVGPAGESIWTDRYGRVKVKFHWDRLAKGDDTSSCWVRVSSAWAGQGFGGVQIPRVNDEVVVDFINGDPDRPLIIGRVYNEASMPPWALPAAATQMGFLSRSKDGTADTANALRFEDKAGEEHLWIQAQKNMDTHVKNDASHSVANNHSHYAGGNELYRVETNRVHGIKGGEELLTGQGKLDAAVSYLCSGIRHQTASGGDGHITTSGGKLNLNTDGAKPGTGAPGADHKQNISKAVENLFPPKQKGQAAPAAPKAAVSAAAKPTAAPVANHPARKARPLPADKQAFFDKVYAAAKISEKKTGVPAEVTTAQAILESSWGDLVPFDKKTNTSSNNIFGIKSFGSKNAAETVTHEYVN

SEQ ID NO: 111247 - protein, 247 aa, Glycine max
  Coding DNA Sequence Number=SeqID_19562
GHPAGAAVQPGAGLAAVVGLRAVLGRPAAALPGADPAVAHHRPELHGRGGAHDARQPGGRDGPRLRQAGPRQGHAARPGDPAARAAERAGAGHRHRRRARRQPAGRHRHHRGAVRLAGPEFAAGERGILARLPRDPGFAPGHLRLVHPDQPGHRPGAGLRRPPYPQAFRMIASLSYLQDRRGGPAGARLPGRGGTGRHPGPDAGPGPIRTASTPPTCCPRRPDGTGWAPTKLGRDLLARAVHGARVS

SEQ ID NO: 111248 - protein, 54 aa, Glycine max
  Coding DNA Sequence Number=SeqID_19563
  Homolog annotation: Hit_ID=A7QL08; Match level="QueryCoverage=68%, HitCoverage=50%, E-value=2e-10, Identity=91%"; Hit description =Chromosome undetermined scaffold_116, whole genome shotgun sequence
MVGAGLKKDLRVSRVVPGGSLNAFLFLLIGVISQRLAMGGNDSILYLNPVAHFF

SEQ ID NO: 111249 - protein, 249 aa, Glycine max
  Coding DNA Sequence Number=SeqID_19564
LFSNVDGLVDLAAIDAFLAYHNHKESPVVAMLADLYDTFDRGCEKSSARIVCCALALYVWLVSHLFLQEGRPVYPLQGHHSCVEKGKANWDQLLASMEGRLLIGSLARRKEESGLYLHAKDVQMFPGWEHGDRELRGSSNGIIGGYHKWLRVRTQGLDWLPNLKTVRDDEVKASEESDEVQALKAELERARVVEEKFKAAIVSSSSEEVKGIITGQRHDLEGRAKGNMWAIIDKCKEKLNLAATHEQRL

SEQ ID NO: 111250 - protein, 19 aa, Glycine max
  Coding DNA Sequence Number=SeqID_19565
SKKRVRQGKRPKGIEEIKE

SEQ ID NO: 111251 - protein, 225 aa, Glycine max
  Coding DNA Sequence Number=SeqID_19566
  Gene Ontology: Mol. function=galactonate dehydratase activity; Cellular component=nucleus; Biological process=metabolic process
  Homolog annotation: Hit_ID=Q6BF17; Match level="QueryCoverage=73%, HitCoverage=43%, E-value=5e-86, Identity=94%"; Hit description =Galactonate dehydratase
MAKVLIKELEPYRPLFIEEPVLAEQAEYYPKLAEQTHIPIAAGERMFSRFEFKRVLEAGGIAILQPDLSHAGGITECYKIAGMAEAYDVALAPHCPLGPIALAACLHVDFVSRNAVFQEQSMGIHYNKGAELLDFVKNKEDFSMEGGFFKPLTKPGLGVEIDEAKGMVSGFAMPKIWRQIAMDIPVTAAKIGRRRYLTLIMIFITVVICYVDRANLAVASAHIQD

SEQ ID NO: 111252 - protein, 116 aa, Glycine max
  Coding DNA Sequence Number=SeqID_19567
  Homolog annotation: Hit_ID=Q6WAY3; Match level="QueryCoverage=43%, HitCoverage=2%, E-value=3e-08, Identity=56%"; Hit description =Gag/pol polyprotein
MESDSLSTTCEYEVSRPSPNLVDIQDGPIDFILVAINSLSTVFEKPAHHRADRPPLNDYQPMHPEFPDEDIMALFEEKLDEDRDKWIVWFDGASNVIGHGVGAVLATIDSNVKLLQ

SEQ ID NO: 111253 - protein, 97 aa, Glycine max
  Coding DNA Sequence Number=SeqID_19568
MRRVIPTYQGIEQPPAEINPLLQQSGLYTTIKLCRIKINGEIATITLQDVFVLLGLPVDGNPLIGSTNIDGIDMCEQYLGVRQNANALANGNTLKLS

SEQ ID NO: 111254 - protein, 54 aa, Glycine max
  Coding DNA Sequence Number=SeqID_19569
MPGHELSDWPPGVMAGRNDRAIADALQALAQAIGNPNRGEVGGAVEYQGLDHFQ

SEQ ID NO: 111255 - protein, 121 aa, Glycine max
  Coding DNA Sequence Number=SeqID_19570
MTMSKRFMKAEDEGSVLYKEQMGEKTSAKVKENDVKGKENQEKGKKIMVQNKEMKNQEKEKEGEKEIENEKNEKEKKKIFEKSRSGKVVEKGVEVPYPVVPSKKENDRHLARFLDIFRKLK

SEQ ID NO: 111256 - protein, 146 aa, Glycine max
  Coding DNA Sequence Number=SeqID_19571
MEKDNLNDTLEALLPKELDDIITQNRHMMQLDYASAEDLAKMHKDIPVTNLRGVLTQAFVYKRIVPSKNAEVFCLVGFNSDQEAFHTSQVVAYDNVNNVALTASGSHYVVESFKTGAPDLLLLLHICFMFHRDGIGNYFGAQPVSY

SEQ ID NO: 111257 - protein, 105 aa, Glycine max
  Coding DNA Sequence Number=SeqID_19572
MDFGSPPFPDVHLFIQKLQDRLPFVPFLLVKVSLLVDLEKAKSSLDSTLHANITLAEAEMKVFEKWALNVNTSEKFTIDEVVRLESTLTLATAEREKGAQKEEKL

SEQ ID NO: 111258 - protein, 93 aa, Glycine max
  Coding DNA Sequence Number=SeqID_19573
MEPALDELINKTELFPKIIPTSSCWLGSSTKESHFTYSTDARLLPRMKVHDHHRYQPHGNSLSVSTQHSHLGKLSNKCRGYPVVHRQLPSPLW

SEQ ID NO: 111259 - protein, 131 aa, Glycine max
  Coding DNA Sequence Number=SeqID_19574
MEFYANAWPTEGVMDKPSWVRGQWIPYDEDAINQFLGHPLVLDEGQHCEYNERRSQVLGFDEEAIGHLLCSSGIGLCTKRDEKTVCRYHTFKTPSGPRKVQQSTGISSFDHRSLPVLWGASYTHKAHLTSH

SEQ ID NO: 111260 - protein, 145 aa, Glycine max
  Coding DNA Sequence Number=SeqID_19575
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
  Subcellular localization annotation: CTP_CleavageSite=39; ConfidenceScore=5.13e-01
MTKDAIHCHNFAAPGLHFPFPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 111261 - protein, 153 aa, Glycine max
  Coding DNA Sequence Number=SeqID_19576
MTSLTQTWMTLLLSNILPSDHNSDLPLPKCMPPTRHPLNLDKSNRALGFLALITGLCQSSGVPVTPSKAANHRAHVQTHDCLYQLSLSLQSQGFPPFPCHTPDQFRAEVAWPGDWPEAQAEEAPTEAPDDADEARIDEEMTDLLDFLGGSGAT

SEQ ID NO: 111262 - protein, 99 aa, Glycine max
  Coding DNA Sequence Number=SeqID_19577
  Subcellular localization annotation: CTP_CleavageSite=51; ConfidenceScore=5.41e-01
MDVLCLVGTSVKPTKHRGAGKQQMIRALLFSHLRSNVSNRSAKTATTGLFLAMVARYAVPSLFYAVQTSCGILDHSCNSAQGGETSGGKIWFSSPERTS

SEQ ID NO: 111263 - protein, 80 aa, Glycine max
  Coding DNA Sequence Number=SeqID_19578
DFLSVVSLVTIFQRNERGFEAFSPHEHLGLPSGVETKHEWQKPIKVGYLRTNASGGWGHDRPIVALLCAKQAENVAARQP

SEQ ID NO: 111264 - protein, 78 aa, Glycine max
  Coding DNA Sequence Number=SeqID_19579
MLAGADTPPPHQAGPAGSFDTEQYLWHLVRQQAANHRAHVQTHDCLYQLSLSLQSQGFTSFPCPTLDQFRAEVAWPRD

SEQ ID NO: 111265 - protein, 106 aa, Glycine max
  Coding DNA Sequence Number=SeqID_19580
  Gene Ontology: Mol. function=transporter activity; Cellular component= integral to membrane; Biological process=transport
  Homolog annotation: Hit_ID=A8GGV9; Match level="QueryCoverage=97%, HitCoverage=25%, E-value=2e-27, Identity=56%"; Hit description=Drug resistance transporter, Bcr/CflA subfamily precursor
  Subcellular localization annotation: CTP_CleavageSite=74; ConfidenceScore=5.13e-01
MGIWLLIVSALNLGFLPLVFGVAMFIGCVSTVSSNAMAVILDEFPHMAGTASSLAGTLRFGVGALVGALLSLVSVNSAWPMVATIALCATVSIVLFSYAARPRHTA

SEQ ID NO: 111266 - protein, 136 aa, Glycine max
  Coding DNA Sequence Number=SeqID_19581
MDSGRFQVSVPGNSYPSAVVGDTEGPPKGFVGYTTNCLPFSGISEPRLEVRLDCGWGIFMGLFHGLRDMCMISLGLLAFNEYRSGVFDILIGSVRRIGWRIVERQAIWRGGVLVLNMYIMGAARTSKSLPTISEVG

SEQ ID NO: 111267 - protein, 95 aa, Glycine max
  Coding DNA Sequence Number=SeqID_19582
AHLGGEAPSSMAYSPVDGAAFYLFFFVFRCISMGAQPIDEEEHLHGGEDSSLLQKILDMFYGLQTFVGERIIKVEEDVSYIRTSFDLPPPPPPSS

SEQ ID NO: 111268 - protein, 223 aa, Glycine max
  Coding DNA Sequence Number=SeqID_19583
MIMRGQDIYSSQDEATTSPSSSKSEEAKGEESSEEIYPQEEGQPLMVKEVSVSSKRLAKKERHFEIKTNIKEISLLRQPPHFLLCKKTLVSIATSLRLEFIPQVKELLDEGLVHKSLNPCALLVPKIGTIRHQIPKIGGMMNALGSATLICKITRAPNIFMICVHRDSLGVSMNSKRIKVIPEWPTPPSVEERSPEFQEPRDLRSNPFQGGGNDAILPRKGIR

SEQ ID NO: 111269 - protein, 184 aa, Glycine max
  Coding DNA Sequence Number=SeqID_19584
MERSMIDAASGGALGDMTPAEARNLIEKMASISHKKLEGKLDALVNLVTQLALNQKFVPVARVCGLCSSADHHTDLCPSMQQPGAIEQPEAYAANIYNRPPQPQQQNQPQQNNYDLSSNRYNPGWRNHLTQMVQPSATTTAAALPSKMLLAQADHTFLHQSNNRNNPRNNQQLRPLHNLPLKNL

SEQ ID NO: 111270 - protein, 58 aa, Glycine max
  Coding DNA Sequence Number=SeqID_19585
MAGMGKLDHLKGKAQGPLKEVPDFGKYKGTTRSKNHLKMYCRKMGAYAKDEKLLIHFS

SEQ ID NO: 111271 - protein, 203 aa, Glycine max
  Coding DNA Sequence Number=SeqID_19586
  Homolog annotation: Hit_ID=A0ST23; Match level="QueryCoverage=12%, HitCoverage=51%, E-value=6e-07, Identity=100%"; Hit description =Putative reverse transcriptase
APVASVSISCPSVQLLTGWCVTAKAPPDISAGKCSGHAARRVPFAIQAAQLLGRAIGAGLFAITPAGERGMCCKAIKLGNARVFPVTTLNSMVGLSSGLSCKQEDRERMVVRRFKFEDPRIEQIQDLELLFPLVRVNFELGVIMVIAVSFGKPVVPAALMNRPTRGERRFAYWALAECILAYYVGTDEGVSEVLHVAEKKGCT

SEQ ID NO: 111272 - protein, 106 aa, Glycine max
  Coding DNA Sequence Number=SeqID_19587
MGLVGERSQTADKSLARTLMSTLTTMKFDVREETLKNQGSHSVHYVSHQGNQGAEKKFMRKHDKGKGSLKINDNSLQIQKKISKGNNFQFYVKYGHFHKDFLKHKS

SEQ ID NO: 111273 - protein, 191 aa, Glycine max
  Coding DNA Sequence Number=SeqID_19588
  Homolog annotation: Hit_ID=Q84VH5; Match level="QueryCoverage=98%, HitCoverage=28%, E-value=2e-58, Identity=64%"; Hit description =Envelope-like protein
MTTSPKETSASGSPSVPSSPHQEQPEFNIQPIQIIPGQAPVPEKLVPKRQQGVKISENPSLATSPREVDTEMDKKIRSIVSSILKNASVPDADEDVPTSSTPNVSVPDADKDVPTSSTPNAEVLSSSSKERSTEEDDQATEETPAPRAPEPALGDLIDLEEVESDEEPIANKLAPGHCRKTTKPKGKNPHH

SEQ ID NO: 111274 - protein, 147 aa, Glycine max
  Coding DNA Sequence Number=SeqID_19589
MVSGCARPWRARNPEAPSARSWHVPGCTLTAFRLQGLETRPKGRWNNVVQGKSRASKRSVTRRKEADWLRAPCGCTGGPVPNPVGSVEWTARAESIPVGPKERNWRCGMNRKLGYGAQLRANLDPTKGVGRLRQQTWSWKSKSAKSV

SEQ ID NO: 111275 - protein, 210 aa, Glycine max
  Coding DNA Sequence Number=SeqID_19590
  Homolog annotation: Hit_ID=Q6WAY4; Match level="QueryCoverage=88%, HitCoverage=33%, E-value=1e-23, Identity=37%"; Hit description =Putative uncharacterized protein
MGTNQNGKRFYQVKIKGLDVTSLKELGRLMGPFQRQAFRKVYGKILDLTTVEVFTEAVVSLAQYYDQPLRCFTFGDFQIVPTVEEFEEILGCPLGGRKPYLFSGFLPSLSKIAAVVRDSARELDRMKQTRNGVVGLPRKYLESKARDMANQEEWVPFANILAFLIFGVVLFPNMDGLVDLAAIDAFLAYHHSNESPVVAILADLFDTFDR

SEQ ID NO: 111276 - protein, 223 aa, Glycine max
  Coding DNA Sequence Number=SeqID_19591
MASIAGYHEWPETLKRAELGKRQKLARRSSTRLLHTFGRSAPRQLRLEAAQLSGNYCAQSSLANIVADGSQGTPGHDGSPHRIQISERTYLWGLPPTKELTTRLAKGVMPCPQQPDEVHKAKTCLEGMSSTETNMLAIIAKYQEELGLATAHEHRIADEYAQVYAEKEARGRVIDSLHQEATMWMDRFALTLNGSQELPRLLAKAKAMADTYSAPEEIHGLSA

SEQ ID NO: 111277 - protein, 204 aa, Glycine max
  Coding DNA Sequence Number=SeqID_19592
  Homolog annotation: Hit_ID=Q2HW90; Match level="QueryCoverage=44%, HitCoverage=18%, E-value=8e-10, Identity=35%"; Hit description =Putative uncharacterized protein
MFGYPPHEKRTPSFPSFHRGNQVKVKSLDTTSIKELGRLMEPLQMQIFRKTYGKILELTIAEVSIEAIASLTQYYDQPLRCFTFGDFQLVPTIDEFEEILGCPLGGRKPYLFSGCLPSLSRIATAVKDSARGETNKGVSHVANCRNLSFGGRATRDSRDACSTKGIPSGVANCRNLPFGGRATRDSRDACSTKGIRAESPPTFI

SEQ ID NO: 111278 - protein, 147 aa, Glycine max
  Coding DNA Sequence Number=SeqID_19593
  Homolog annotation: Hit_ID=Q6UUU1; Match level="QueryCoverage=40%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPGNYRLESNPGRHAKAPLAAAT

SEQ ID NO: 111279 - protein, 85 aa, Glycine max
  Coding DNA Sequence Number=SeqID_19594
MKHAVTVAATRRYAKAKIWEVWAAPHYALSQRALLWACEARLTGALSKGGKMCGVATNVYLWKTSGKPKEISQNENSKFGSCIYT

SEQ ID NO: 111280 - protein, 160 aa, Glycine max
  Coding DNA Sequence Number=SeqID_19595
  Gene Ontology: Mol. function=glucose-1-phosphate adenylyltransferase activity; Cellular component=chloroplast; Biological process =glycogen biosynthetic process
  Homolog annotation: Hit_ID=A3KCF6; Match level="QueryCoverage=34%, HitCoverage=10%, E-value=2e-15, Identity=69%"; Hit description =Glucose-1-phosphate adenylyltransferase
  Pfam annotation: Domain name=TPR_1; Domain location=2-35; Score=25.6; E_value=0.00018; Accession=PF00515.19; Description=Tetratricopeptide repeat
  Pfam annotation: Domain name=TPR_2; Domain location=2-35; Score=25.2; E_value=0.00024; Accession=PF07719.8; Description=Tetratricopeptide repeat
  Pfam module annotation: Pfam domain module=TPR_1::TPR_2; Domain location=2-35::2-35
MADEAKAKGNTAFSSGDYPTAIHYFSDAIALAPTNHVLKMRTCFAMGGDGHRNHHFTETVAMGGIGPTMGLVDIGKCTLVNVVIPRPPPDGELAAGVGKQVDTCVLGLPPYEAKRSPYILHLWGYVFKTDDLVRLLKWRYPTPNDFGSEIIPAAEGKQCP

SEQ ID NO: 111281 - protein, 73 aa, Glycine max
  Coding DNA Sequence Number=SeqID_19596
MNNCLLAKSMNTLEVSSLLKSLQVWAHIRDLTPFRKRFTSLQRITDSLIRGRSTSGVQGKLRCLAIAITVYCI

SEQ ID NO: 111282 - protein, 98 aa, Glycine max
  Coding DNA Sequence Number=SeqID_19597
MGITSPRNNQQTLKEEERNSIFAQHQSSRFSNGGFLEKRELCRNLLSQPTVATYPLAGGRRETHGSVFQERNTRGITTNVYSRKTSEKPGKTWSTNFK

SEQ ID NO: 111283 - protein, 186 aa, Glycine max
  Coding DNA Sequence Number=SeqID_19598
MVGKDLGSTDDPMMCKFKTSTPSRHMVCLPNYTPPNVVYIPNEDVNNSTPILIKSQQPQSDHAMSRRPQRRHMKFPTNIQLIELLVSLKAMHGGNLKHLDGPSISSQPYILTFQQRLKKGHALRRPYRTRARARVMGEAEEVQEKMKAEMEAMKEQMATMMEAMMSMKKIMEANAVIVAATCAVAK

SEQ ID NO: 111284 - protein, 99 aa, Glycine max
  Coding DNA Sequence Number=SeqID_19599
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=50%, E-value=4e-24, Identity=100%"; Hit description=LacZ protein
MLHNMMGLARLQSPGDPLVLERPPPRWSSNSPYSESYYNSLAVVLQRRDWENPGVTQLNRLAAHPPFASWRNSEEARTDRPSQQLRSLNGEWDAPCSGA

SEQ ID NO: 111285 - protein, 194 aa, Glycine max
  Coding DNA Sequence Number=SeqID_19600
MGCRQTILQAVQSDADMAICSERGSVLLPRLVEVRAGIVTPAEGFEVDHGGYSFGEVDGLQLSVAVQDAENGRENVEQGFDELDHGEFQVGDQATAPADTPHAGHEPGLSGGRSHEPGQADELAARIGQDRAEIRLLLGAVVGRHHGAADGDEFRGGALHFAEVYGGAVGPHVRAIGDGAHGFDVLGLEVVLGH

SEQ ID NO: 111286 - protein, 141 aa, Glycine max
  Coding DNA Sequence Number=SeqID_19601
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=73%, E-value=2e-24, Identity=70%"; Hit description=LacZ protein
MSRPYILNFERPDIFIISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 111287 - protein, 22 aa, Glycine max
  Coding DNA Sequence Number=SeqID_19602
NDSGQGVGSKILVRSRRARRDD

SEQ ID NO: 111288 - protein, 185 aa, Glycine max
  Coding DNA Sequence Number=SeqID_19603
  Gene Ontology: Mol. function=phosphoprotein phosphatase activity
  Homolog annotation: Hit_ID=A7R2Z6; Match level="QueryCoverage=94%, HitCoverage=34%, E-value=5e-18, Identity=25%"; Hit description =Chromosome chr11 scaffold_467, whole genome shotgun sequence
MGECTITLEDVALHLGIRVDGRVVAGPNFLHYNELCDELLGEVPPENARKGAALKLAWLLSILCAPLPEEPTIHQLQCRCRAYIMYMIGASSEVGKVMGGGAILLQSWAWYRMPFIAPRVPRPETTYPLAKRWSGDRLKYRVTPHGDLVRYRSRIDHMEGHEFSWVPYRGFEEQLSRHAYRDMEI

SEQ ID NO: 111289 - protein, 57 aa, Glycine max
  Coding DNA Sequence Number=SeqID_19604
MAPKFACPKFRFQLQGGADIEEELTDLRSNPLQGEGDDAILPRKGPVTKAKSRAPED

SEQ ID NO: 111290 - protein, 310 aa, Glycine max
  Coding DNA Sequence Number=SeqID_19605
  Gene Ontology: Mol. function=motor activity; Cellular component=cell projection
  Homolog annotation: Hit_ID=UPI00016621D1; Match level="QueryCoverage =92%, HitCoverage=41%, E-value=3e-22, Identity=34%"; Hit description =UPI00016621D1 related cluster
GLQVLAIRGLHALTFRELHVLAFRGLHVITFGGLHVLTFRGLHVLALRGLHVLTFKGLNILIFRGLHVLIFRGLHVLTFRGLHALTFRRLHVLAFRGQHVLAFKGLHALTFRRLHILAIRGLHVLAFRGQHILAFRGMHALTFRGQHVLAFRGLHALTFRGQHVLAFRGLHALTFRGLHVLAIRGLHALAFRGLHMLAIRGLHVLAFRGQHVLAFRGMHALTFRGQHVLAFRGLHALTFRGLHVLAIRGQHALAFRGLHALAFRGLHTLTFRGYTPSPSKGDTSSTSEGCTPPPFEGYASSLSVGSISTP

SEQ ID NO: 111291 - protein, 157 aa, Glycine max
  Coding DNA Sequence Number=SeqID_19606
MTKTVCTDNRLGYLRTSPDFTGTIASGISIRHLTSRVKMTKTVSTDNRLGYLCTLPDFTDSAEDDVNLRVSTGSLAAIDKGMTESAEDDVNLRVSTGSLAAIDKGVYTDNHLGISARHLTSRGISVRQLTSRVRMTEIAEDDVNLRVSTSSLAAIDK

SEQ ID NO: 111292 - protein, 103 aa, Glycine max
  Coding DNA Sequence Number=SeqID_19607
MGYAINSFLTPRCLEILFIMNMKWPQGSLPQKDPGKTRRLKEPVPLPNMTAIVLGALRDDEYTDFQEEIVRRRWASLVTPMAKFDPDVVLEFYANAWPTEEGV

SEQ ID NO: 111293 - protein, 161 aa, Glycine max
  Coding DNA Sequence Number=SeqID_19608
MAAQGNFLKEHEMELQRLNQNEETDKKKRSIALKASSSMQEANEEEDSDDEEDFSLFVKKFQKFVKRTRIERRQNFNNGKRSQEDSQVLRCYKCNQLGLIKANFPSNEEWPEKSDKERYNERRTKKAYIAWDDNDSSDDSEKEINLLTKDYESDENISQEG

SEQ ID NO: 111294 - protein, 39 aa, Glycine max
  Coding DNA Sequence Number=SeqID_19609
MEAVDGLKSCGNGFTKTGANPTDILPKVALTIRLYTVQT

SEQ ID NO: 111295 - protein, 150 aa, Glycine max
  Coding DNA Sequence Number=SeqID_19610
  Gene Ontology: Cellular component=chloroplast
  Homolog annotation: Hit_ID=Q49KT9; Match level="QueryCoverage=36%, HitCoverage=47%, E-value=5e-10, Identity=66%"; Hit description =Putative uncharacterized protein ORF113
MSPHGGDMDGGEKRKERDGVSLAFGIAGPGGRPARRAISSVVERAPDNCVVVPGLWGDSVRSNVDPTFSSLVGSGRSGGDHHGSSLLENSYIPYQYMDSYLSSTGLGLASMEKNGAPNNVSSQTKNYEIAPFILGDQEIGSSHKKNRMLG

SEQ ID NO: 111296 - protein, 102 aa, Glycine max
  Coding DNA Sequence Number=SeqID_19611
GGANSTQAHLGPPEYFLQKAVASGGKQTLARLGELSSPGRAGRQPPPLFAINRGGNEEGREKSKPRRFRNVFRNVFREESRKGLNRSSTFFIRSSSFFDLQR

SEQ ID NO: 111297 - protein, 274 aa, Glycine max
  Coding DNA Sequence Number=SeqID_19612
ALNQFLGYPLVLEEGQECEYGQRRNRADGFDEEAIVQLLCIPGQDFARIAVGRRVRIMRTNMTTLTQTWMTLLLSNILPNDHNSDLPLPKCQLVYAILTRMSVHVAQLIADAIYLFAGMPPTRHPLDPDKSNRALSFPALIAGLCQSFGVPITPSKVIRPPITRAFIEKYCTLRQVQGGDPQAPDAPPPPHQADPAGSFDTERYLRHLVRQQAANHRAHVQTHDCLYQLSLSLQGQGFASFPCPTPDQFRAEVAWPRDWLEAQAGEAPAEAPGD

SEQ ID NO: 111298 - protein, 274 aa, Glycine max
  Coding DNA Sequence Number=SeqID_19613
WIPFDADAIGQLLGYPLVWEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAALTVYGKWPRGSLPQRGPGRTRQPKKLVPLRSMTVTALGALYTSSASRPSRDGRFSGSDASSSGTTSILISRRK

SEQ ID NO: 111299 - protein, 119 aa, Glycine max
  Coding DNA Sequence Number=SeqID_19614
  Pfam annotation: Domain name=zf-CCHC; Domain location=46-63; Score =31.2; E_value=3.8e-06; Accession=PF00098.14; Description=Zinc knuckle
MQEESEDEEDFSLFLKKFHKFVKNRRIERLQNFNHGKRFQEGSPTLRCYKCNQLGHIKANCPSNKQWPEKNDKKNHEERRTTKAYITWDDNDSSEGSKKEEINLLTKDYESEEDITQRD

SEQ ID NO: 111300 - protein, 67 aa, Glycine max
  Coding DNA Sequence Number=SeqID_19615
MHELHSMLVQEEARLKNQGSHSVHYVSHQGNQGAGKKFMKKHDKGKGSLKINTLCKSRRRDSLQSKP

SEQ ID NO: 111301 - protein, 238 aa, Glycine max
  Coding DNA Sequence Number=SeqID_19616
  Gene Ontology: Biological process=transposition, DNA-mediated
  Homolog annotation: Hit_ID=Q1J7G7; Match level="QueryCoverage=15%, HitCoverage=67%, E-value=2e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLNSITLLSNKMTASVKAARPIFPVEPQSAALALPPIAQRTATGINDRPITVTTVPVTTGGKKRIMCEKNGAINNPSSLSIPSTSRGGPVPAFVPFSEVGKPVVPAALMNRPTRGERRFAYWALAECILAYYVGTDEGVSEVLHVAEKKGCT

SEQ ID NO: 111302 - protein, 44 aa, Glycine max
  Coding DNA Sequence Number=SeqID_19617
MSFSRDLLSGNRLPKSSPAEVHQRFSLADYARVGLGLIKLGFGQ

SEQ ID NO: 111303 - protein, 143 aa, Glycine max
  Coding DNA Sequence Number=SeqID_19618
MDNEEGVQEQMKADLSALKDQMASITEAMLKIQKTIEDNATVAASNIAREAEPVLQPAINLGRDRNVTVFNRRYSPQAYPYGLPPDFTPCASPDDLSQAPTFEGQLPPHADYPLQEDDEGDAHLGPLLPLKEPAPHEFPQPHI

SEQ ID NO: 111304 - protein, 78 aa, Glycine max
  Coding DNA Sequence Number=SeqID_19619
MRRYPSGYPFKLSFAISKTQSMIARAETNAYLLHPLSIVASKPVDTRRFTSSSAQTISVILTLESHDMWRYPSGYPHF

SEQ ID NO: 111305 - protein, 195 aa, Glycine max
  Coding DNA Sequence Number=SeqID_19620
MKQQLSDYGILLDHIPIRTPRPEATGASPAPIPPSLSSSTLFSSDEQRICHDSPFEGTIVDDWKFAYSSLDARRMVCNDQADMTGRLLAGSLTFDYRIMHYIIVRILLPSSSNLVQASKEDLILMWAFLIGRPIDWAHLIRYHMHKALRSNAPLPYPQLVTLFLHHFQISLDNEPFVKVKRSFAIGACAVTSFSY

SEQ ID NO: 111306 - protein, 214 aa, Glycine max
  Coding DNA Sequence Number=SeqID_19621
  Subcellular localization annotation: CTP_CleavageSite=32; ConfidenceScore=5.32e-01
MEANAVIVAATSAVAKVNPMLPSGLKQMNHPTSNMVGKDLGSTDDPMMCKFKTSTPSRHMACLPSYTPSNVAYIPNEDVNNSTPILIKSQQPQSDHAHVSQPMEETHEIPHHDLANFEPCLGYTVEGQAVGGIPLQNTLEGPQYHPQPQPSRCTAVKNPHDYGRMQLQNICKKGDGSFKEHAQKVEGSGGPSGTPNDGKGDDNRDGRHIIDTLL

SEQ ID NO: 111307 - protein, 139 aa, Glycine max
  Coding DNA Sequence Number=SeqID_19622
MNLEERSKIFALLLTEMLQKRYGSASAWIFFTEIIFLSNFERERRRSLPPSSPRRARLLPPEATTFWRKDLEGPTFEEVMETHGLRKNTSFRLPPHYRISRIAQACFLLISETSRDFIYCATKDAKYLKAANQRLHVIK

SEQ ID NO: 111308 - protein, 208 aa, Glycine max
  Coding DNA Sequence Number=SeqID_19623
  Homolog annotation: Hit_ID=Q2HW90; Match level="QueryCoverage=84%, HitCoverage=42%, E-value=2e-07, Identity=25%"; Hit description =Putative uncharacterized protein
MGFGYDRMLLVFGVVLFPNVDGLVDLAAIDAFLAYNHIKESSIVAILADAYETFDWRCEMSSTRIVCCTPAIYVWLVSHIFCHESRPVSPLQGHRMCAEKGKANWEQLLTGMTTWLPHEKSTIGREYRKPFIARIFSEPKSRVLQRVRKAWNAVHKKDKELKGSNNGIVGGYHKWLRARMQEITWLPKLKISSEEEAEPQRRAKRCKP

SEQ ID NO: 111309 - protein, 206 aa, Glycine max
  Coding DNA Sequence Number=SeqID_19624
MVKEECKEVSVSSKRLAKKERHFEIKINIKEISLLRQPPHFLLCKKTLVSIATSLRLEFIPQVKELLDEGLVRKRLPTVLCLVPKIAFTFCKPPTRKNHNLGTNTSHHSSSVNCEGTSHKDPLSKILDGLSSLKLWKEKLERREKGKEKVEINLDKREQIREEERRKILRELRKEKHVSYSSHDSCKSLSEERSDYYGGKGKNKYC

SEQ ID NO: 111310 - protein, 94 aa, Glycine max
  Coding DNA Sequence Number=SeqID_19625
  Subcellular localization annotation: CTP_CleavageSite=56; ConfidenceScore=5.17e-01
MPSTSQGPKKGRMSSSKGPRPKLGYDRELSLRKKKVDKSGALAPTYPPSKRKSDLRSSFKRGKSSDSFYLEGGYLRRWTLKRFFSNFCGQSLIL

SEQ ID NO: 111311 - protein, 95 aa, Glycine max
  Coding DNA Sequence Number=SeqID_19626
MRLLLHLPLVKVKKQKEKNLVKKSIPKKKDTFNGIIRHQIPKIGGVMNVLGGATLFCKITRAPNIFMICVHRDSLGVPMNPKRMKVILEWPAPPS

SEQ ID NO: 111312 - protein, 206 aa, Glycine max
  Coding DNA Sequence Number=SeqID_19627
  Homolog annotation: Hit_ID=Q84VH5; Match level="QueryCoverage=48%, HitCoverage=19%, E-value=1e-14, Identity=44%"; Hit description =Envelope-like protein
MDKKIRSLVNSILKNASVPDADKDVPTSSTPNAEVLSSSSKKKSTEEEDQATEETPAPRAPEPAPGDLIDLEEKDYKAEREKPPFWSGRIKTIAQKKSTQSSYFHMVPEEQSCSLPQEAEILQQEAAVHQSDSDEADAEGVKFVYHTRQLHWKENGSSRYLDSKETLDLKSGCAAEKLRGQVEDLPARGIIAATYILNVLKRLTQH

SEQ ID NO: 111313 - protein, 47 aa, Glycine max
  Coding DNA Sequence Number=SeqID_19628
MKIPNSGVDTFAEGEHACRPARPGEQGCFLQKQQPSGGIFWRAQVGL

SEQ ID NO: 111314 - protein, 44 aa, Glycine max
  Coding DNA Sequence Number=SeqID_19629
MSAEKYQSQEMFDVGHQVILFQTSLSVNFPGRCRLAFLSISIGE

SEQ ID NO: 111315 - protein, 126 aa, Glycine max
  Coding DNA Sequence Number=SeqID_19630
  Gene Ontology: Mol. function=voltage-gated anion channel activity; Cellular component=mitochondrial outer membrane; Biological process =transposition, DNA-mediated
  Homolog annotation: Hit_ID=Q1J7G7; Match level="QueryCoverage=36%, HitCoverage=78%, E-value=1e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPEFDRAWRPNSLITLSAEYDSTKIFGSSTKFGLALALKP

SEQ ID NO: 111316 - protein, 68 aa, Glycine max
  Coding DNA Sequence Number=SeqID_19631
MHEQRWAINSWGSGLDCLWIVKKKCGTKWFPRMSSGPPPLDDKGADDHNLSLHVNGLACLWLTKGAGP

SEQ ID NO: 111317 - protein, 159 aa, Glycine max
  Coding DNA Sequence Number=SeqID_19632
  Gene Ontology: Mol. function=chitin binding; Cellular component =extracellular region; Biological process=chitin metabolic process
  Homolog annotation: Hit_ID=UPI000069F178; Match level="QueryCoverage =98%, HitCoverage=39%, E-value=6e-08, Identity=28%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
  Subcellular localization annotation: CTP_CleavageSite=36; ConfidenceScore=5.57e-01
ACSPLLVRTCSPLKARTCSPLNGEGRVVLSRRGRVVLSTVRVRACSPLMVRTCSPLKARTCSPLKARTCSPLNGEGRAALCWRGRVVLPRRGRVVLTTVRARTCSPLMVRACSPLMVRTRSPLKARTCSPLSEVRACSPLMVRTCSPLKARTCSPLNGE

SEQ ID NO: 111318 - protein, 111 aa, Glycine max
  Coding DNA Sequence Number=SeqID_19633
MSVKNLVGCLGVHDKTNHTLGDQLRSRCFVRMLQPCGIGTGLKEHSNQVYLPPRPTLRRVHQGHSLLIQNTYLLPLLNWYYLFLYESGLTGKRTGSPNVPVFYAEDKNIKH

SEQ ID NO: 111319 - protein, 34 aa, Glycine max
  Coding DNA Sequence Number=SeqID_19634
MVRPFKTDEFLREEYCDGIHYGNPTSLITLRCNE

SEQ ID NO: 111320 - protein, 122 aa, Glycine max
  Coding DNA Sequence Number=SeqID_19635
MFKNWQWSIQTVWHDLGFSFLANKTFITKIMHIMLHCPIKPPSVEVMTSKIILMMPKNQELSKFQRIRSQKASRIKSQRIKIQEQSSFKIQDSRTIKFQESRFRNNQDQDSRIKRRLNQDKY

SEQ ID NO: 111321 - protein, 69 aa, Glycine max
  Coding DNA Sequence Number=SeqID_19636
MEALSTLQTSSQDHNGQIMDKCLVKLQTTFREDPTVNEGWVAFLPRQLHVASSRSFIKRLLQEASPWLL

SEQ ID NO: 111322 - protein, 197 aa, Glycine max
  Coding DNA Sequence Number=SeqID_19637
MGSNQTPLLKKRFYQVKIKSLEVASLRELGQLMGQLQRQAFCKAYGKIWDLAIIEVFVEVIASLTQYYDQPLRVEEILGCPLGGRKPYLFSGFHPSMARVAKVVKISTQELDRVKQNRNGVVRVLLIRQALEKAVFTFSLSQYVGLASSLSAPLHLSKRTASVHPLSEKGALSQKSLACAKRSIHALSARARTRPPI

SEQ ID NO: 111323 - protein, 173 aa, Glycine max
  Coding DNA Sequence Number=SeqID_19638
  Gene Ontology: Mol. function=aspartic-type endopeptidase activity; Cellular component=small subunit processome; Biological process=DNA integration
  Homolog annotation: Hit_ID=A5CB76; Match level="QueryCoverage=98%, HitCoverage=61%, E-value=7e-34, Identity=43%"; Hit description =Putative uncharacterized protein
MASSGPVFSFSGTPTITSTKLNWKNYLSWSASVELWFLGQGHHDHLEKGVDAVPNDRKFEWEKLDYQLYAVLWQSVEPDILEILRSFKTCHSFWKKAQEIFANDIQSLFDATMKVTALKQTGHDMIAHVGKARAAVEELKKFLVADSLEEMNRKLDKFYMVLILRSLHFDFDH

SEQ ID NO: 111324 - protein, 163 aa, Glycine max
  Coding DNA Sequence Number=SeqID_19639
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAALF

SEQ ID NO: 111325 - protein, 241 aa, Glycine max
  Coding DNA Sequence Number=SeqID_19640
  Homolog annotation: Hit_ID=UPI0000ECBAF8; Match level="QueryCoverage =17%, HitCoverage=48%, E-value=3e-16, Identity=100%"; Hit description= UPI0000ECBAF8 related cluster
SEQESARGSFQGDTPGIFIVLSGFATSDLSVDFCDARQGAGAYGKTPATRPFYADTARRSRTTERSESVSEEAEERPIRKPPLPAPDNNFTQETAMTMITNSSSVPCHPLSEASTCLAVRRNLEGNLSRRHALSASSARSASCLSPSRLSTSLALSESSLTHTKRENGVKRDVEVSEPFFKPDLQRMKGMQAWHWPSFYNVVTGKTLALPNLIALQHIPLSPAGVIAKRPAPIALPNSCAA

SEQ ID NO: 111326 - protein, 57 aa, Glycine max
  Coding DNA Sequence Number=SeqID_19641
MMAHHGVSSLSSFSIPLPFIFQDAKESIDEKYPRPTSSNGAYITWVLRSRTLTINTR

SEQ ID NO: 111327 - protein, 15 aa, Glycine max
  Coding DNA Sequence Number=SeqID_19642
MASPNHKCHPHQDDS

SEQ ID NO: 111328 - protein, 111 aa, Glycine max
  Coding DNA Sequence Number=SeqID_19643
  Homolog annotation: Hit_ID=UPI0000ECBAF8; Match level="QueryCoverage =36%, HitCoverage=48%, E-value=1e-16, Identity=100%"; Hit description= UPI0000ECBAF8 related cluster
MTMITNSSSVPIPYQYMDSYLSSTGLGLASMEKNGAPNNVSSQTKNYEIAPFILGRPAGMQAWHWPSFYNVVTGKTLALPNLIALQHIPLSPAGVIAKRPAPIALPNSCAA

SEQ ID NO: 111329 - protein, 160 aa, Glycine max
  Coding DNA Sequence Number=SeqID_19644
  Homolog annotation: Hit_ID=A0ST23; Match level="QueryCoverage=20%, HitCoverage=65%, E-value=2e-11, Identity=96%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLIPAALGVQLASKNFRFGIEKPTAEAVLLGATTSMAAAIGKPVVPAALMNRPTRGERRFAYWALFRFLAH

SEQ ID NO: 111330 - protein, 250 aa, Glycine max
  Coding DNA Sequence Number=SeqID_19645
  Gene Ontology: Mol. function=Type I site-specific deoxyribonuclease activity; Biological process=DNA modification
  Homolog annotation: Hit_ID=Q6L2Y9; Match level="QueryCoverage=99%, HitCoverage=42%, E-value=7e-17, Identity=38%"; Hit description=Type I restriction-modification system specificity subunit
MSDYVEIDIGEFPKDWDVRKLKDVIIKAKSGGTPRRNVPEYWNGNIPFAKIQDITKSVLNSSVPILPLEEQKKIVELLQKATDIYYTLKDYIIQIRNSTETITKVIRKELLTKGIGHRDYVETDIGEFPKDWEVRRLNEIAIIRSGFSERKRDENSKVIHLRPDNIDNETDRIVFHRIVYIPESPKIERYLLRHLDIVLVNTNGSIDHIGKLGIIDMPLNQKITFSNHLTAIRIVSKDVEPYYIYYLLSW

SEQ ID NO: 111331 - protein, 88 aa, Glycine max
  Coding DNA Sequence Number=SeqID_19646
MTGLNQTSEHPSKKILSFELAQRSTFNVERLDILRDSIRHPSKKILSFELAQRFNINFERLDILRDSFRHPSKKILSYELAQRFNIQF

SEQ ID NO: 111332 - protein, 324 aa, Glycine max
  Coding DNA Sequence Number=SeqID_19647
  Homolog annotation: Hit_ID=A5B5V0; Match level="QueryCoverage=83%, HitCoverage=59%, E-value=9e-14, Identity=24%"; Hit description =Putative uncharacterized protein
  Subcellular localization annotation: CTP_CleavageSite=32; ConfidenceScore=5.41e-01
MAESSKKRKRTSSRNQRHSGSQVAPIPPSIPSGSLFSSEEQRTQYANLFSSRSIVDPKFIDMEFFSNENFECFQAFENSNLIPFMSLKLPVYSELVKAFYSNLEIHEGTLNSEVYGIKMVIDQSLFYDLTKLPSEGVSFEGALIDEWKFDFSVHDARRLVCTNQADMTERLLAGSLAFESHILHYLIFRILLPRSSNLAQVSEEDLIVMWAFHKGLQIDWAHLVRYRMHKALRLNAPLPYPHLFTLFLQHFNIPLDFEPYVPIKRSFLIGTSIIASFGYIKEHDGSWVKKGARNIGEEGPEGEDSSLLSKILERFDGLQTFVGE

SEQ ID NO: 111333 - protein, 90 aa, Glycine max
  Coding DNA Sequence Number=SeqID_19648
MKGSGVVGSDDASFIGACRPRIFFINGFLCFLEDEWQRNGERKRERRRHFKEKMSLEEAHHHRRPWIRAWKKKEMNEGRGREEHEILCSK

SEQ ID NO: 111334 - protein, 128 aa, Glycine max
  Coding DNA Sequence Number=SeqID_19649
  Homolog annotation: Hit_ID=A5B589; Match level="QueryCoverage=96%, HitCoverage=32%, E-value=8e-08, Identity=28%"; Hit description =Putative uncharacterized protein
STAGDSIPIDLEINATCRRRNSERIRNFLQDLEAVTTPKEEPRSSEASSSFPIAGHSHIEPVEDPIMAEDIRQPEVQAQTTTYPPSLVQLIQNNLFHGLPNEDPYAHLGTYIEICHTIRPVGVPADAV

SEQ ID NO: 111335 - protein, 175 aa, Glycine max
  Coding DNA Sequence Number=SeqID_19650
  Homolog annotation: Hit_ID=Q6WAY6; Match level="QueryCoverage=39%, HitCoverage=12%, E-value=1e-10, Identity=47%"; Hit description =Putative uncharacterized protein
MLADLHDTFDRRCEKSNTRIVCCTPALYVLLVSHLVRQEVRHACPLESHCSCTEKGGANWDQLLANQEGASINWFPRWREGRVGVLISCGGFPNVPLMGTWGCISYNPVLAVRQLGYPMRVAPLEEKLTLVISRGFNKTNMETLQKVRKEWEVVRKKNKELTGSNNGPIWWLQVV

SEQ ID NO: 111336 - protein, 96 aa, Glycine max
  Coding DNA Sequence Number=SeqID_19651
MVIFNHGVAAEDKGEELEEESFLEKLEGGYSHPSVATYPSAGGRRVTHGMRVPRKEYARSRHQRLFEENVGKTGKDAIYELLSERFGSCIYARGRY

SEQ ID NO: 111337 - protein, 211 aa, Glycine max
  Coding DNA Sequence Number=SeqID_19652
MAPRKLPAKRSRKDKAAKGTSAAPEYDSHRFRSAEHQQRFEAIKGWSFHRERRVQLRDDEYTDFQEEIAHRRWTSLVTPMAKFDPDIVLEFYANAWPTKEGVRDMRSWGHECEYGQRRNRADGFDEEAIAQLLCIPGQDFARTAAGRRVRIMRTSMTTLTQIWMTLLLSNIQPSDHNSDLALPKCQLVYAIMTRMSVHVAQLIADAICLFA

SEQ ID NO: 111338 - protein, 215 aa, Glycine max
  Coding DNA Sequence Number=SeqID_19653
  Homolog annotation: Hit_ID=UPI0000ECBAF8; Match level="QueryCoverage =19%, HitCoverage=48%, E-value=3e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMLLTHNEDAVELRITWEEAQDLLHPPPSTMPSVETIEDKEFEEFESRPAGMQAWHWPSFYNVVTGKTLALPNLIALQHIPLSPAGVIAKRPAPIALPNSCAA

SEQ ID NO: 111339 - protein, 164 aa, Glycine max
  Coding DNA Sequence Number=SeqID_19654
  Homolog annotation: Hit_ID=P03851; Match level="QueryCoverage=51%, HitCoverage=100%, E-value=5e-44, Identity=98%"; Hit description =Uncharacterized 9.4 kDa protein
STLEDPLSAHSKAVYGYPQNQGITQERTCEQKASKRPGTVAKPDRTIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 111340 - protein, 90 aa, Glycine max
  Coding DNA Sequence Number=SeqID_19655
MHEYPRRTRALTRKHSFQNSCGYSCFVGKREMASKKLSTKRSRRDATGEGSSAAPEFDSHRFQSAEHQQRFEAIRGWLLHRERRVRLKED

SEQ ID NO: 111341 - protein, 211 aa, Glycine max
  Coding DNA Sequence Number=SeqID_19656
  Gene Ontology: Mol. function=motor activity; Cellular component=cell projection
  Homolog annotation: Hit_ID=UPI00016621D1; Match level="QueryCoverage =99%, HitCoverage=41%, E-value=1e-17, Identity=29%"; Hit description =UPI00016621D1 related cluster
PHILAFKGLHIIALRGLHVLAFSGLHALAFVGLHALTFRGLFVLTFIRLHLLTFRGLLVHAFRGIHVLAFRGVHILPMKALHALAFVGIHALTFKGVHVLTFRRLYIIAIRGLHILHFRGLHALTFKGLHVLAFRGLHVHASRGQHVLPFRGLHAFAFVGLHALTFRGLHMLVFRGLHTLAFVGLHAVTFRGLHILAFRGLHALAFRGLHV

SEQ ID NO: 111342 - protein, 97 aa, Glycine max
  Coding DNA Sequence Number=SeqID_19657
MSSRYSRRNREQFKTQEERLKDTSRFKRKVEFKNQDSRIKLQESRSRFKIQVFLKVITLLMVVLTRHEESIKARLCFAFFNHLEHLFNQSFTSPKSL

SEQ ID NO: 111343 - protein, 139 aa, Glycine max
  Coding DNA Sequence Number=SeqID_19658
HHFKNSVAPPTYLALLILLPVAAASGDKSCLTGATLPEGRKADRYPVSGRVGTGERTRELPGGNAWPLVPAHVLSLRYPVVILWINGVLPTLSELHPPFASWRNSEEPAPIALPNINASRTTGFPTGTPAVSALTGNCV

SEQ ID NO: 111344 - protein, 101 aa, Glycine max
  Coding DNA Sequence Number=SeqID_19659
MAYKKRKASYTPTQARYDKSRFTSQEAWERYTYIAVPKKLLPERNVVVYYTEFDEFKEELERRHWDEELTDFADSNIDIAIVKEFYANLYDPEDKSPKQVK

SEQ ID NO: 111345 - protein, 48 aa, Glycine max
  Coding DNA Sequence Number=SeqID_19660
MEEKNSARASTNSKHAEHSRNSRMEKRKEKSVYNGQKLSASLNAMLHP

SEQ ID NO: 111346 - protein, 246 aa, Glycine max
  Coding DNA Sequence Number=SeqID_19661
  Gene Ontology: Mol. function=RNA-directed RNA polymerase activity
  Homolog annotation: Hit_ID=A7P5T3; Match level="QueryCoverage=36%, HitCoverage=7%, E-value=4e-34, Identity=79%"; Hit description =Chromosome chr4 scaffold_6, whole genome shotgun sequence
  Pfam annotation: Domain name=RdRP; Domain location=112-245; Score= -172.1; E_value=0.0034; Accession=PF05183.3; Description=RNA dependent RNA polymerase
DAGSRQARQGASAGVGGCRVWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPSDGIGVITHDLAREVAEKLKLDNVPSAYQIRYAGFKGVVASWPAKGDGVRLSLRPSMNKFQSTHNILEICAWTRFQPGFLNRQIITLLSALGGTELEFVIMVIAVSCVKLLSAHNSTQHTSRKHKV

SEQ ID NO: 111347 - protein, 140 aa, Glycine max
  Coding DNA Sequence Number=SeqID_19662
  Gene Ontology: Mol. function=gluconate 2-dehydrogenase (acceptor) activity; Cellular component=plasma membrane
  Homolog annotation: Hit_ID=A8GDC9; Match level="QueryCoverage=99%, HitCoverage=57%, E-value=6e-40, Identity=56%"; Hit description =Gluconate 2-dehydrogenase (Acceptor) precursor
MASAAPATEKSETYHYVPVFFNNDEWRFILSATDLLIPEDEFGPGAVSEGVPVYIDKQMELPYGYGYLWYMSPPFQESIPEMGYQTNLVPREIYRRGIINLNKYCRENFQKNFADLSKEKQEAILHDLESGKIVLDTISG

SEQ ID NO: 111348 - protein, 16 aa, Glycine max
  Coding DNA Sequence Number=SeqID_19663
MGVVFVIGSAVDRLCG

SEQ ID NO: 111349 - protein, 160 aa, Glycine max
  Coding DNA Sequence Number=SeqID_19664
  Homolog annotation: Hit_ID=A9IZ23; Match level="QueryCoverage=90%, HitCoverage=28%, E-value=5e-07, Identity=30%"; Hit description =Phosphate-selective porin O and P precursor
MAEQLKSLQAARGQSTGQPVYANFKNGLSFEDGTGNWKLGINGRVQADYRSFSPDIAAADTFNIRRGRLGANVAMKDFAARLEAEYSGTANNGSVGLTYAHVDYIHFNSFKLRVGQFKPFYGLERAMNANFTDFQERGSTDYLLGATFDRGVMVFGEPVP

SEQ ID NO: 111350 - protein, 79 aa, Glycine max
  Coding DNA Sequence Number=SeqID_19665
KFFRKLRSAIPEEGLPEVVSGRTSSGIGLHHFRKKVFRKLRSPIPEEVLPEELLPQLAFTTSGRPSSGSGHSGPSSFCA

SEQ ID NO: 111351 - protein, 135 aa, Glycine max
  Coding DNA Sequence Number=SeqID_19666
  Homolog annotation: Hit_ID=Q1RU80; Match level="QueryCoverage=83%, HitCoverage=84%, E-value=5e-13, Identity=38%"; Hit description =Putative uncharacterized protein
MREVTISLDDVMSLLHLPMVGSLHVFQPLHVDDAVQMLVELLMVSTEAARAETGQCRGLYVHLQWALRDLSLTGRYTWGVAALVHMYDHLNGASICTSRQLGGYITLLQCWICEHFPLIVKSAADRDYDEGSLHA

SEQ ID NO: 111352 - protein, 271 aa, Glycine max
  Coding DNA Sequence Number=SeqID_19667
  Homolog annotation: Hit_ID=A5BSR3; Match level="QueryCoverage=52%, HitCoverage=45%, E-value=4e-14, Identity=37%"; Hit description =Putative uncharacterized protein
  Pfam annotation: Domain name=Transposase_23; Domain location=184-241; Score=3.2; E_value=0.00053; Accession=PF03017.5; Description =TNP1ENSPM transposase
KLLAEKTKKKLQEDAQSGSVDGVIDPPSPVRRHVKWKMARTKKTGEMTTEAVKEIAEKIDSFEEQATQGSFVPHGRQDVLAVAIGRPEHPGRVRAAGAGVTIKQYFGSAPRTSRSASSLPPDELQQLTQQIRDQLEESITEKVTRQVMASFSQLQSQMQSQAPPEPLVGPGPSDPRVRLVHRSRSCPPGCRGESYGGLTLVHNTPLLPSQVKVSVDKVKDADAPVPVPTAEVSLVGQALHTFLAWPTHLIKSLSHQVLIVLTICFFLMGIL

SEQ ID NO: 111353 - protein, 97 aa, Glycine max
  Coding DNA Sequence Number=SeqID_19668
  Homolog annotation: Hit_ID=Q51617; Match level="QueryCoverage=35%, HitCoverage=49%, E-value=6e-11, Identity=94%"; Hit description =Putative uncharacterized protein
MTVKTSDTCSSRRRSQLVCKRMPGADKPVRARQRAPFAIQSAQLLGRAIGAGLFDITPAGERGMCCKAIKLGNARVFPVTTLYNDGQCQACMPAGRL

SEQ ID NO: 111354 - protein, 187 aa, Glycine max
  Coding DNA Sequence Number=SeqID_19669
  Homolog annotation: Hit_ID=A5AZ88; Match level="QueryCoverage=25%, HitCoverage=4%, E-value=6e-07, Identity=47%"; Hit description =Putative uncharacterized protein
MDIEEDVEIPLILGRSFMVTAKCVMDMGKGNLEMSVEDQKATFNLFEAKEDEAKPVVNPTNSSSIFLGPKQAKTRTTPDIPPTPPSAVPPPDVSPPPIGQTSIPFSHPEQLLPPPPSLTLAAGDDTRGIPSPGCLAKSPTPSSKGGDTFGVADDDENPETGQIQATDSSGEGQSPQVEKDEGPSGER

SEQ ID NO: 111355 - protein, 55 aa, Glycine max
  Coding DNA Sequence Number=SeqID_19670
MEILIANTSTTFHRDERLGNTYATHVIMRMRCPKRHHFLVNHALEENARIMHEQT

SEQ ID NO: 111356 - protein, 110 aa, Glycine max
  Coding DNA Sequence Number=SeqID_19671
MVRTRGLGRALGQVTGKASTAYCIRMEAAIVVTVAHDEPMVPAPDFEPDVLPDDPMEAPADSEDIVADIPVDTGVEAAEDEHEGFSGGPSDPSVLTQYADHVACSVWTGE

SEQ ID NO: 111357 - protein, 144 aa, Glycine max
  Coding DNA Sequence Number=SeqID_19672
MTGRLLACSMTFDCCIMHYIIVRILLPRSSKFSQPSEEDLILMWAFLTSCPIDWVYLIRYRMRKRSNAPLPYPQLVTLFLHHFQIPLDNEPFVKVKCSFAIGTGAVISFGYRKDMDGKWLKKDAQPPQDERTPSPPPQQDDSSA

SEQ ID NO: 111358 - protein, 334 aa, Glycine max
  Coding DNA Sequence Number=SeqID_19673
DAEETDGDGAGEAQDHPGHADAARAADGAVRIRRHETRQDVRLAEVAQAPTQQRQDGDEVQPLQHVEVGRILRLDHQHRGIDAADGEDHDHRRQDQRENHQAGLHGVGPAHRQETADKGIQDGRCGAGPQGGFVAHAEGAFEQTRAGHDAGGAVNGEEHQDDDGRDHPQQLAVVFKAAGEIVRQRQGVVVGFGMHAQPSCHQLPVQVSADGQADGDPAFGDAGEEDGARQAHQQPAAHVGSAGGQRGHHAAQTAAAENIVIKVVGCPVGKQADQHHPENVHQEGHQHRCAHCHLILHFHYYSRFAPATPAPVNPRAMHFTGRRAGTWRSLRASA

SEQ ID NO: 111359 - protein, 36 aa, Glycine max
  Coding DNA Sequence Number=SeqID_19674
MAAQDEWRDAITLTMGRDLKKVPQHLNAISVIDPVT

SEQ ID NO: 111360 - protein, 63 aa, Glycine max
  Coding DNA Sequence Number=SeqID_19675
GDGEGVDVGTGDDLRASIEDGDGVDVGIGDGPSGDGVGARSGGLTGIDTEDGDEVDDGRLSRG

SEQ ID NO: 111361 - protein, 159 aa, Glycine max
  Coding DNA Sequence Number=SeqID_19676
MIMRGQDIYSSQDKATTSPSSSESEKAKGEESSEEIYPQEEGQPLVVKEKYQETLASIATPLGLEFIPQVKKLLDDGLVRKSLNRCALLVPKIGIINIKYRKSDQGVPTNPKRIKVIPDWPTPPGVEGRSLEYEEPRDLRSNPFQAGGDDAILPPKGIG

SEQ ID NO: 111362 - protein, 99 aa, Glycine max
  Coding DNA Sequence Number=SeqID_19677
HPSDDSVVPTLTLRFRPPRRKTLAIVLTTTTYPISCPLEWCRHLASVKIKREISTLKLLKHPNVVRLNERNLDQLEELLKKVKLKTIRTEPPSASIAST

SEQ ID NO: 111363 - protein, 88 aa, Glycine max
  Coding DNA Sequence Number=SeqID_19678
MAVSKLRNDAKGFILNRNREASWKIPLRLKGSSWCGVSTENNGGLWWLRVAVVDEEKAWYIGNGFGRRKEKKWHFSKATWTTRLKTQK

SEQ ID NO: 111364 - protein, 116 aa, Glycine max
  Coding DNA Sequence Number=SeqID_19679
CDGSAVIHDRVVMECLEGVWETLEGNERCRFRGTIRLTTTSLPVQVIKVSFSEEDPEEDPEELPPEPAVDDLDLPEDDEDPLPEVDSPEDIMSASEADSTEESGPGETANSEDSSS

SEQ ID NO: 111365 - protein, 76 aa, Glycine max
  Coding DNA Sequence Number=SeqID_19680
MDSGRFQVSVPGVAGGDTEGLPKCFQGVYHQLLALQWHIRAKARSRLDCGGEFHVSLPRFKRHVHDQFGVAGSQWV

SEQ ID NO: 111366 - protein, 270 aa, Glycine max
  Coding DNA Sequence Number=SeqID_19681
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=24%, HitCoverage=65%, E-value=9e-33, Identity=100%"; Hit description=LacZ protein
MRKRHASRREKGGQVSGNRQGRNRRAHEGASRGKRLGGGAYGKTPATRPFYGSWPFAGLLLTCSFLRYPLILWITVLPPLSELIPLAAAERPSAARNSYDHDYEFELGTRPQHALAQGDADVRRVQQTGMVTRRYWNQQELNKRGFRHSTASVESIEAQLTLILSGRYIGFLPEGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 111367 - protein, 132 aa, Glycine max
  Coding DNA Sequence Number=SeqID_19682
  Homolog annotation: Hit_ID=Q1J7G7; Match level="QueryCoverage=25%, HitCoverage=60%, E-value=8e-07, Identity=66%"; Hit description =Transposase
  Subcellular localization annotation: CTP_CleavageSite=42; ConfidenceScore=5.18e-01
WNSYVPINVSFSPKVGPGLPAVPPVQLLTGWCVTAKAPPDISAGKCSGRVPFAIQAAQLLGRAIGAGLFAITPAGERGMCCKAIKLGIRWDIATQNHSTGDIPPHMSKEEKTETPSFLSRNTTLEKILLVRD

SEQ ID NO: 111368 - protein, 162 aa, Glycine max
  Coding DNA Sequence Number=SeqID_19683
  Homolog annotation: Hit_ID=A0ST23; Match level="QueryCoverage=27%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLQPQTVGTVGLILWPNLTICSINATMGTELEFVIMVIAVSFGKPVVPAALMNRPTRGERRFAYWALFRFLAH

SEQ ID NO: 111369 - protein, 229 aa, Glycine max
  Coding DNA Sequence Number=SeqID_19684
MVSPKMLNPDSSYCRLPTDYREIEAALCIPSRGFVLNAEGHPEKILRKDLTTLARVWSVLSYSNLAPTSHTSDLTVDRDRLIFGLVSQMDMNVGALISSQITSMAQSNSSRLRFPALITALCKSRRVASDSLVFKHLSLVINLAYIKKNYWNPDEGPTAQVPQQMKNESSKTTTPKPLVRRKKADETQEAVATSKKSLEATSKPSEPVADTTSPQQAADPSTAEDHTTP

SEQ ID NO: 111370 - protein, 292 aa, Glycine max
  Coding DNA Sequence Number=SeqID_19685
  Homolog annotation: Hit_ID=A5ATL8; Match level="QueryCoverage=14%, HitCoverage=34%, E-value=5e-15, Identity=93%"; Hit description =Putative uncharacterized protein
LFLDGGKGYNSAVECHLDVVEVISSSLIIPKPNRTPVEYEAPGYKLCLGMEENSESALSTNKEAISNATRNLMESSILAQMNAGGMPYTCKSDGKWCFQWRTATLGLRHGPDSYGRQQWGIFRNGRKPDGAMPREGRRPTAAVRQRMQALSGMIGRKASVGGFLSSPSNPRAQPWTGGGNYQAGVRSERTPTAKALCWADTDTERRKLGERMGLDTPSSPSRKRWILGAVRIDPCNAVANALSIPPGEYRRTLPGLDMPRILLKERGAFGNADTGGAWLSSARATAGDKPEE

SEQ ID NO: 111371 - protein, 223 aa, Glycine max
  Coding DNA Sequence Number=SeqID_19686
  Homolog annotation: Hit_ID=Q5QJQ3; Match level="QueryCoverage=13%, HitCoverage=24%, E-value=5e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTLIPDGWIHVSNLRWRWWSIAEQGGPLWKNIKQEKRTAGPAPVLQFGVPSSNSRETCRASCINESANARGEAVCVLGALPLPRSLTRCARSFGCGERYQLTQRRSFAPSWAVCTNPPFSPTAAPYPVTIVLSPT

SEQ ID NO: 111372 - protein, 28 aa, Glycine max
  Coding DNA Sequence Number=SeqID_19687
MAREETIFGQSKVGSVKSGFIPQHCPQN

SEQ ID NO: 111373 - protein, 269 aa, Glycine max
  Coding DNA Sequence Number=SeqID_19688
YPMRRAPSEEIIAPFVARGFNEGNAKILQRIRKAWNTVGRKDKELRGSNNSVIGGYHKWLKTRTQGVTWLPKLKGQSGEKAEVPEESEEVQALKAELERMRVVKEKLKKAVTRVKKECDEPRDVNITTAEVNNERKLRRAERDESRVERSFTEQLSRTKENMLTIIDQYKEKLNLAASHGQRLENKHAKVLALQVEREVRERVIESLHGESVKWMDRFALTLNGSQELPRLLARAKVMADVYSAPEEVHGLFDYCQHMVELISHIIRNH

SEQ ID NO: 111374 - protein, 290 aa, Glycine max
  Coding DNA Sequence Number=SeqID_19689
  Gene Ontology: Mol. function=nucleic acid binding
  Homolog annotation: Hit_ID=A5AZ88; Match level="QueryCoverage=76%, HitCoverage=25%, E-value=1e-12, Identity=25%"; Hit description =Putative uncharacterized protein
  Pfam annotation: Domain name=Retrotrans_gag; Domain location=6-87; Score=35.3; E_value=2.2e-07; Accession=PF03732.8; Description =Retrotransposon gag protein
EAIRLSLFSFSLAGEAKRWLHSFKGNSLKTWEEVVEKFLKKYFPKSKTAEGKATISSFHQFPDESLREKIKLKTPEEATKLIENMSASDHAILRDRTHQPTKKSLLELTSHDALLAQNKLLSKQLEILTETLAHEIGQCISIEENTQEIHFMGNQQRQGYTQGGFSGFQQGPYNQQGQWRTHPSNQLNKDQGGSSNRPIQQGPNIFQRMTKLEETLTRFMQVTMSNHKSIESVLKNLEVQVGQLTKLMQAPLELVGLESSSSMDSFASWKMNGSGMEKGRERGDATSRRR

SEQ ID NO: 111375 - protein, 102 aa, Glycine max
  Coding DNA Sequence Number=SeqID_19690
  Homolog annotation: Hit_ID=A6FJQ2; Match level="QueryCoverage=37%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLGENEPSQAKLY

SEQ ID NO: 111376 - protein, 200 aa, Glycine max
  Coding DNA Sequence Number=SeqID_19691
  Homolog annotation: Hit_ID=A5BA83; Match level="QueryCoverage=92%, HitCoverage=9%, E-value=4e-07, Identity=24%"; Hit description =Putative uncharacterized protein
GSTLISKVHGISIVIDESVFFSLTHLPSHDSPFEGTIVDDWKFAYSSLDARRMVCNDQADMTGRLLAGSLTFDYRIMHYIIVRILLPSSSNLVQASKEDLILMWAFLIGRPIDWAHLIRYHMHKALRSNAPLPYPQLVTLFLHHFQISLDNEPFVKVKRSFAIGACAVTSFSYRKDMDGQWLKKDVQPLQDEHTPSPPPQ

SEQ ID NO: 111377 - protein, 106 aa, Glycine max
  Coding DNA Sequence Number=SeqID_19692
MVWGDILAKFDIPEAEKAKKKDEFVASRKTPDWQEIRKKAKESKKYNDCPHVLSRGGYDLLEKKLLDEKTKQRQQQALLTENPLFDLEEPPSPIKRQVKWKMARTK

SEQ ID NO: 111378 - protein, 248 aa, Glycine max
  Coding DNA Sequence Number=SeqID_19693
MEGRKGGSPFLMWRLKVVSEESFEAPEEDEEVQALKSELGKAKLAKKKFKLATTHIRKECAGLREENATTARALEQETKRARKEEYGRNKFRGALWGSNSELKLRREERDQSRAHSMVLKEELVAYSRSKRSLSQHLCETEANMLANIAKYQEELGLATAHEHRVADEYAQVYVEKEARGRVIDSLHQEATMWMDRFALTLNGSQELPRLLAKAKAMADTYSAPEEIHGLLHYCQHMIDLMAHIIRNH

SEQ ID NO: 111379 - protein, 147 aa, Glycine max
  Coding DNA Sequence Number=SeqID_19694
  Gene Ontology: Mol. function=exonuclease activity; Cellular component= cytoplasm; Biological process=DNA recombination
  Homolog annotation: Hit_ID=P65974; Match level="QueryCoverage=100%, HitCoverage=48%, E-value=1e-75, Identity=96%"; Hit description =Recombination-associated protein rdgC
  Pfam annotation: Domain name=RdgC; Domain location=1-147; Score =121.7; E_value=2.1e-33; Accession=PF04381.3; Description=Putative exonuclease, RdgC
MMWIDTVNGLIMVDCASAKKAEDTLALLRKTLGSLPVVPLTLENPIELTLTEWVRSGSVAQGFQLLDEAELKAMLEDGGVIRAKKQDLVSDEIAVHIEAGKVVTKLALDWQQRIQFVICDDASIKRLKFCDELRDQNEDIDREDFAQ

SEQ ID NO: 111380 - protein, 126 aa, Glycine max
  Coding DNA Sequence Number=SeqID_19695
MRVPDDCSCNTLKHRMQNTFQLTNDQLVDEIYYRQPFIDAAIEHQMLYSTCFNQLSLLLMMQLCITTGSGTYHVKVGFWVTPGGSLGYSFTGTNPIRFGIPSGCNMDKLKHLIKQVAPIGIPPNGI

SEQ ID NO: 111381 - protein, 99 aa, Glycine max
  Coding DNA Sequence Number=SeqID_19696
MSKSCGFGMTSPLDESISCFLIRVDPWILVPITMRGLHVLALRGLHALILGTSYPHRQRTTRPRLERTTRPHHQRAARPYLQRTTCPRLERAARPHLGY

SEQ ID NO: 111382 - protein, 291 aa, Glycine max
  Coding DNA Sequence Number=SeqID_19697
  Gene Ontology: Mol. function=chlorophyll binding; Cellular component =integral to membrane; Biological process=photosynthetic electron transport
  Homolog annotation: Hit_ID=Q2MI75; Match level="QueryCoverage=44%, HitCoverage=25%, E-value=1e-68, Identity=98%"; Hit description =Photosystem II P680 chlorophyll A apoprotein
  Pfam annotation: Domain name=PSII; Domain location=1-139; Score= -154.2; E_value=0.00023; Accession=PF00421.10; Description =Photosystem II protein
SMDNGDGIAVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQVEFGAFQKLGDPTTKKQGCPKAIYKAYPVKLTSKPDIEISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 111383 - protein, 351 aa, Glycine max
  Coding DNA Sequence Number=SeqID_19698
  Homolog annotation: Hit_ID=Q84VI1; Match level="QueryCoverage=100%, HitCoverage=55%, E-value=1e-160, Identity=78%"; Hit description =Envelope-like protein
GEKIAGNPSLATSPREVDTEMDKKIRSIVSSILKEASVPEADEDVPTSFTPNVSVPDVEKDVPTSSGPNAEVLSSPSKERSTEEDDQATKETPAPRAPETAPGDLIDLEEVESDEEPIANRLAPGIAERLQNRKGKTPLKRSGRIKTMAQKKSTPITPATSRRSKRAKKSGRKVPGNVRDAPLDNISFHSIGNVEKWKYVYQRRLAVERELGRDALDCKETMDLIKAAGLLKTVTKLGDCYEGLVREFIVNIPSDISNRKSDDYQRVFVRGKCVRFSPAVINKHLGRPTDGMVDIDVSEHQIAKEITAKQVQHWPKKGKLSAGKLSVKYAILHRIGAANWVPTNHTSTVAT

SEQ ID NO: 111384 - protein, 184 aa, Glycine max
  Coding DNA Sequence Number=SeqID_19699
  Pfam annotation: Domain name=Transposase_23; Domain location=1-59; Score=4.8; E_value=0.00035; Accession=PF03017.5; Description =TNP1ENSPM transposase
ADPARLVAVGRVYEGSTLVHNTPLFPGQVKVSVDEVKDADASVPVPTDEVSLVGQALHTFLAWLTHLVKSLSHQVLIVLTISVSPPKPPLKPDPEVDDPLYLMTLTIPELFLRPYQVRWDATVFGVVNPDFPLYIKHKDLSEIAHGGQCLSISVLQLWILHLTETCMRAGNYDIYGFLEPQSIR

SEQ ID NO: 111385 - protein, 124 aa, Glycine max
  Coding DNA Sequence Number=SeqID_19700
MVAPGEVCTVPGQCASDYIDWFFRISHPFMTPVVPQVPQTDIPHVSEPGAPSTSAMPVVDEPRHAVEVCYEIAERLERHLSLGVVTPGSSTHEVIEDCLRIARSVTQDQLVYVRSRRRRCTDQA

SEQ ID NO: 111386 - protein, 293 aa, Glycine max
  Coding DNA Sequence Number=SeqID_19701
MSFELIKYIMNSIITVLYFNGRVYEDNDGVIFEGSKKAIQIKRGISFNALKKKLEIRFLVSAKYVALQICDDEDVETMIESFQQQQQMSVLELYVEKDVAGGSMFHAANSVTSCGRNVSHHESELPRNISNLHDDEDDDDDDDYLASNSYVEESFDEDDSDDEISDTDDEVTDIVEPVSIVHPSEGVPEIQNPFWNDAMHYNNINWSHPDEGDICGLDMPTTFNVGQELYIGMDFDSKDAVKNALKQYVMNVHQSFKVVETKSHKYIVCCPNNTEESPCPFYMRAILSKKTDA

SEQ ID NO: 111387 - protein, 34 aa, Glycine max
  Coding DNA Sequence Number=SeqID_19702
MAPKTCSLVPTSAPDRTSSIKWCINYLCKKKENH

SEQ ID NO: 111388 - protein, 87 aa, Glycine max
  Coding DNA Sequence Number=SeqID_19703
MRLTVYESSKLYKERVKAYHDKKPMKRDFKLGKKPYGAIELYDPQSQDPDRTWVVNGQRLKLYHGGEFEKENTILHLISLIEVYASS

SEQ ID NO: 111389 - protein, 80 aa, Glycine max
  Coding DNA Sequence Number=SeqID_19704
MYIKYDPEYIMKHSQQNKLSNDTKTPHTYSQNNSKAPKFLKDMVISWTHQQESSQGYCASNQWGKTHQMIMMMDGSNSHK

SEQ ID NO: 111390 - protein, 152 aa, Glycine max
  Coding DNA Sequence Number=SeqID_19705
  Homolog annotation: Hit_ID=UPI0000ECBAF8; Match level="QueryCoverage =26%, HitCoverage=48%, E-value=2e-15, Identity=95%"; Hit description =UPI0000ECBAF8 related cluster
AGSEQESARGSFQGETPGIFIVLSGFATSDLSVDFCDARQGGGAYGKTPATRPFYGSWPFAGLLLTCSFLRYPLILWITVLPPLSELIPLAAAERPSAASMQAWHWPSFYNVVTGKTLALPNLIALQQIPLSPAGVISKRPAPIALPNSCAA

SEQ ID NO: 111391 - protein, 86 aa, Glycine max
  Coding DNA Sequence Number=SeqID_19706
  Homolog annotation: Hit_ID=A5BEV8; Match level="QueryCoverage=87%, HitCoverage=9%, E-value=2e-09, Identity=37%"; Hit description =Putative uncharacterized protein
MTFFPLRSQPLPDSSVHCMICVGHVFGNHFVQVYLKDCCPLPPLALLWSTNCYSQAKQWPTPYISRMQQYTSLMSFKRDYVDLNED

SEQ ID NO: 111392 - protein, 130 aa, Glycine max
  Coding DNA Sequence Number=SeqID_19707
  Homolog annotation: Hit_ID=UPI0000ECBAF8; Match level="QueryCoverage =31%, HitCoverage=48%, E-value=1e-16, Identity=100%"; Hit description= UPI0000ECBAF8 related cluster
AQYANRLSPRVGRFINAAGTTGFPTGKRAVSATQLIYDHDYEFELGTALEEAKKPEGVASKEIINLFGFGDRCCRPAGMQAWHWPSFYNVVTGKTLALPNLIALQHIPLSPAGVIAKRPAPIALPNSCAA

SEQ ID NO: 111393 - protein, 185 aa, Glycine max
  Coding DNA Sequence Number=SeqID_19708
MKNGEKPSRNHPRKRLGSVTEGKSGRWLPPSSPRRVGLLPPEGTAFCWNILEVPRSGQAKVAELHGLPNDACQVPRSGQAKVTSHQTDGPQTKLAYDTMKEKMTTMMETMMSMKKIMEANAVAIAPTSTIAEVDLTPPSDLNQMNHPTSDMVGKDLGSTGAPPFSAKTSMPSHHRTCLPTIRHPM

SEQ ID NO: 111394 - protein, 104 aa, Glycine max
  Coding DNA Sequence Number=SeqID_19709
  Homolog annotation: Hit_ID=A5AGG9; Match level="QueryCoverage=60%, HitCoverage=7%, E-value=7e-11, Identity=55%"; Hit description =Putative uncharacterized protein
MAIMLGVVDLRLWWPRLGSFGVVVLESVSGLKAVDFRQPEVLLVKKVHQFEVTKSPLEALADMGLNGEYNLKELMTLVSLGAEHGREHGEQGRLERNKYLVFQQ

SEQ ID NO: 111395 - protein, 65 aa, Glycine max
  Coding DNA Sequence Number=SeqID_19710
MVTMIDVVFMTLTIMMLVTMTINDSGVVNSGSSQMLLNIYNLLVTRYRSLILMKAYPRKLRKERA

SEQ ID NO: 111396 - protein, 82 aa, Glycine max
  Coding DNA Sequence Number=SeqID_19711
MVEQVKKQTEKKVKRLWTDNDEDMALTKNKEPLEGLGGPMARARTKKAKEALQQVLTIIFEFRPKLQVEKLQIVNCTMFQEE

SEQ ID NO: 111397 - protein, 138 aa, Glycine max
  Coding DNA Sequence Number=SeqID_19712
MSGSAPSSSRLITLNEELEMLLATLPKLTNKEHKQWCEMVKIMLKVAVPPDTILNTVGAKDQDIPSTMYYFLKDKGWTHLHLEDVAECRLVFNHWRKTLKIGAGWKYFSETLSLTANIEIVFEFIDPIVNHVLFWPCL

SEQ ID NO: 111398 - protein, 116 aa, Glycine max
  Coding DNA Sequence Number=SeqID_19713
MRKMQGSCTSERHVNDENRMYAIGMLNERVMHPLGCYEEMHDAIKEQARVSLLCAPELRNLMEMIQKSTSRTINDNESLKEENSDEATLLSSVLETQHDHRPTSTPYGSRRPGYRA

SEQ ID NO: 111399 - protein, 84 aa, Glycine max
  Coding DNA Sequence Number=SeqID_19714
MARVVSNLFEDGAQSTWPNPPTPVVDLSSPQHAADPSTPILEIPVDPTTPVLTMSTSPPATPVLHLTDEKGVQTQDTQDQSHEF

SEQ ID NO: 111400 - protein, 76 aa, Glycine max
  Coding DNA Sequence Number=SeqID_19715
MEGKGNLKQARDSFLCEAWMTLWSSQVALHLVYMIYTKLLHTNKVFHSKFGEALVGPNPMVLLGWLTFKTKKSSFK

SEQ ID NO: 111401 - protein, 147 aa, Glycine max
  Coding DNA Sequence Number=SeqID_19716
  Gene Ontology: Cellular component=integral to membrane
  Homolog annotation: Hit_ID=A7R385; Match level="QueryCoverage=51%, HitCoverage=37%, E-value=8e-15, Identity=56%"; Hit description =Chromosome undetermined scaffold_490, whole genome shotgun sequence
  Subcellular localization annotation: CTP_CleavageSite=52; ConfidenceScore=5.02e-01
MSFLGLGFSLGTVPVCHGAKHKVLDRRVRITKLVLRCVSLGLGVVAIVLVVTDSQVKEFFSFQKKAKFTDMKALMSFNGDFSPWRCSGRQRRRGERRRHPLGNKPWKKELHHQECALDKKLGEDASMEEKKERGGSTKLKEEKRKRS

SEQ ID NO: 111402 - protein, 162 aa, Glycine max
  Coding DNA Sequence Number=SeqID_19717
  Gene Ontology: Mol. function=microtubule motor activity; Cellular component=microtubule associated complex; Biological process =microtubule-based movement
  Homolog annotation: Hit_ID=Q9FG03; Match level="QueryCoverage=72%, HitCoverage=9%, E-value=9e-15, Identity=46%"; Hit description =Kinesin heavy chain-like protein
MKIFMQLEEGDQRSPGIIPLAVKDAFSIIQEMFPYTRLRTESFFFEFRTWRSTMRLSINFHDGIGLETVMTISCPIGVHCTLEIETCYVGFSDTLSPSTKGTFVEGIKEEVVLSPAHALSLIAAGEVSLLRSCERTHPSHFFNALCYALLYGYVQKRDLHRL

SEQ ID NO: 111403 - protein, 251 aa, Glycine max
  Coding DNA Sequence Number=SeqID_19718
MWIPIGADIDWGVFIGGGMGVIDEGDEGGCGWGGGGVCAKGNVLAHMNESHGQRLELGHARLNDVMHAAAVHENDHLVVAQRPKEAEGVLIVEPVCESRAEGPDEVAMQPLLIAMIAKPLITADRHFLYQERFPQRRSNILSSCNRASLVAWELPVDRHNMTERIAILAPATSPLRKGKIHFEPSTGGGPGDEDGDCVGAAMVANRSTRESNFVVSEPLSSLSVVTWRVWCSGMVDVVVVTIAVEGGGGGR

SEQ ID NO: 111404 - protein, 90 aa, Glycine max
  Coding DNA Sequence Number=SeqID_19719
  Gene Ontology: Mol. function=oxidoreductase activity, acting on the CH-OH group of donors, NAD or NADP as acceptor; Cellular component =cytoplasm; Biological process=malate metabolic process
  Homolog annotation: Hit_ID=P51615; Match level="QueryCoverage=58%, HitCoverage=8%, E-value=6e-15, Identity=75%"; Hit description=NADP -dependent malic enzyme
MTKLQTIDVFIDLFKELAFLTKERDAHSLCGLLPPTFSSQQLQENKLMNNISLYQVPLQKYVAMMDLHVIVWQPNMRGKPEKKIFGGIYA

SEQ ID NO: 111405 - protein, 128 aa, Glycine max
  Coding DNA Sequence Number=SeqID_19720
MSSPSSNLSDLSFDTRLDISMMYSLIFPLPLYFMEMSLAKRVRFNFFNYKGSNKKQCHNLLFSGRATRGSRVRLSWEENVWSHHQRLFKENVGKTRTCGVRTLSVKGSRVVFTHGEGISTPRVRHKRR

SEQ ID NO: 111406 - protein, 117 aa, Glycine max
  Coding DNA Sequence Number=SeqID_19721
MIHVVAQTPNTLPTAQDQPNPTFVRESIPTTPVRDAPPSAPDDSVTPEYPTDPNCEHIVDERPFISAYKGEFQPTYGCSNIISNIIRAKFDEPAPSWLKVSVDLCDRWFGEFKKEYR

SEQ ID NO: 111407 - protein, 122 aa, Glycine max
  Coding DNA Sequence Number=SeqID_19722
MTRGNSSDLQPFDPEIDRTFHRLVRHHLVPFEHPKHSVIGDFEHSENMAHPPPCERTLRELVALDFTYESLCIQYPDEDVPYVLKTGLIHLLPKFHGLAGEDPHKHLKEFHIVCSTMKPPDV

SEQ ID NO: 111408 - protein, 72 aa, Glycine max
  Coding DNA Sequence Number=SeqID_19723
LASGVSLSEACVLSKNHALSEALNPLSELGESGGESEKHLRAQRVISSLSEAFVSSYAKHPQLAQRIFTNSR

SEQ ID NO: 111409 - protein, 78 aa, Glycine max
  Coding DNA Sequence Number=SeqID_19724
MVQNTIGLEKRDATNRGKTFTCFLTNGKAKSRIDKEAWLKKNVVGWGAYLLKEKLNRVKEVLKKWYKEEFGVYKGDDN

SEQ ID NO: 111410 - protein, 143 aa, Glycine max
  Coding DNA Sequence Number=SeqID_19725
MMKPFNSPWMRISPSFTEQQMNKTMKTESGVLPHKSSKDGLGKSTYFHMHQQVIEKIAPSGHVEKCDKQVLKDVTFVLDAFRLVSYPNFVRGPLFVGMRLSFDHFKMFNTHRRGIRKVPGCFGEKPAKNTKMGVYLAKWGVCK

SEQ ID NO: 111411 - protein, 372 aa, Glycine max
  Coding DNA Sequence Number=SeqID_19726
  Gene Ontology: Mol. function=chaperone activator activity; Cellular component=cytoplasm; Biological process=response to stress
  Homolog annotation: Hit_ID=Q9LHL7; Match level="QueryCoverage=91%, HitCoverage=98%, E-value=1e-119, Identity=59%"; Hit description =Arabidopsis thaliana genomic DNA, chromosome 3, P1 clone: MEC18
  Pfam annotation: Domain name=AHSA1; Domain location=221-279; Score =26.9; E_value=7.7e-05; Accession=PF08327.2; Description=Activator of Hsp90 ATPase homolog 1-l
  Pfam annotation: Domain name=Aha1_N; Domain location=29-163; Score =134.9; E_value=2.3e-37; Accession=PF09229.2; Description=Activator of Hsp90 ATPase, N-terminal
  Pfam module annotation: Pfam domain module=AHSA1::Aha1_N; Domain location=221-279::29-163
MAKFGEGDKRWIVAERPDGTNVHNWHWAETNCLEWSRTFFNNSFTNVAVGDGDATVTIKKVEKLDGEAYVNVRKGKVIPGYEISVRLAWEGEARDADGKVLKRVDGAVEIPYISDENAGEDPEIRVSVKENGELGIKLMEVMLKKGKVVVLEKVRVWVESMAKGGPVKDELEAKKVAVPHKNNNNNNNNSSNGDNNVKKEEVKKNEGKKGFKVISLIEKFNCRARDLFEILMDENRWRGFTQSNARISKEVGGEFSIFDGSVTGKNLELDEGKLIVQGWRFGSWPDGIESMVRIVFEEPEDGVTVVKLTHSDVPEEDRYGNATVVENTERGWRDLIFQRIRTAKERLLDWQFLVKDEVSHAQFNDLAGCISS

SEQ ID NO: 111412 - protein, 74 aa, Glycine max
  Coding DNA Sequence Number=SeqID_19727
MATPNAPLAPQWNVPRAIPDMGDLLGFDLRHKFSAKVEQVEAGRHRGIRNPDRQGRRWDRPCGTSSRHHGHHNE

SEQ ID NO: 111413 - protein, 72 aa, Glycine max
  Coding DNA Sequence Number=SeqID_19728
MVIFNHGYAAEDKGEEVREYGIHKGISHGRRSFTTKRVSWIRSLEWKLQWRKRMRERRRKWHEKLKEQRDTS

SEQ ID NO: 111414 - protein, 169 aa, Glycine max
  Coding DNA Sequence Number=SeqID_19729
MDDGIKEEVLETSIVTERSDSNKDKEEGHDLDSTLANTMNGASSSVESPSKKRRTSEAGGVVLSVGFVTLLPSALALPPTLFIRYSAKAKKVKVVKGDFVPMASVGASQNKILADISNLPQQPKQHISVDHLLKEKETLIKLIANREQTLLVEDVQNVNCGKGCSSSST

SEQ ID NO: 111415 - protein, 116 aa, Glycine max
  Coding DNA Sequence Number=SeqID_19730
MMRIMKLAKYRLKAQVEKDEGPSGEGQSPQVEKDEGSSNPCGVYPDLSSFTGSGVYPDLSSFIGSGVYPDLSSFTGSGVIQISVTCIKRSTPTQVHIITLTYLPSLEVASTQTYLP

SEQ ID NO: 111416 - protein, 94 aa, Glycine max
  Coding DNA Sequence Number=SeqID_19731
  Homolog annotation: Hit_ID=A6FJQ2; Match level="QueryCoverage=40%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARDHDDDARGGA

SEQ ID NO: 111417 - protein, 211 aa, Glycine max
  Coding DNA Sequence Number=SeqID_19732
  Homolog annotation: Hit_ID=A7QRG8; Match level="QueryCoverage=20%, HitCoverage=6%, E-value=1e-08, Identity=70%"; Hit description =Chromosome chr8 scaffold_150, whole genome shotgun sequence
  Subcellular localization annotation: CTP_CleavageSite=49; ConfidenceScore=5.19e-01
MSFTAYLITLALGRAKSAPSVAILAISTVSSWSPSQRIINLSTPTPHLRARAGNEHEEHTQIRICVQGLLNRLSESNVKSITGELSLIFQGFKKYYLIFGYVKFFLLDLVLKIIKNNIQFKDDAYISTVFESRHSKTVLTSTTSLKVGILRRCLNKQHLRMPIFKDVAEVSTVFENCSLLKTVFWNPSLKFLSFDDVTFNDVRKTLITFFQ

SEQ ID NO: 111418 - protein, 88 aa, Glycine max
  Coding DNA Sequence Number=SeqID_19733
MQHVADQQVANHRGQVQLHESFYRYTLHQQSQDPNPFPWPTPEQFGATIAWPRDRPDFQTGAGPVGTLGDEGGAQDDDDMADVMDYFL

SEQ ID NO: 111419 - protein, 45 aa, Glycine max
  Coding DNA Sequence Number=SeqID_19734
MEREFLVHDWVTSTLPDMNGRGMEKEEREEMPLQGEDESRRSSPP

SEQ ID NO: 111420 - protein, 70 aa, Glycine max
  Coding DNA Sequence Number=SeqID_19735
MKAVKNTMDGKNDQGTPKWIEVKDRQVVYEGEVVLAEQPDKSTLDAPNLRTKDELTPQQGKNITFYTIQF

SEQ ID NO: 111421 - protein, 75 aa, Glycine max
  Coding DNA Sequence Number=SeqID_19736
MKTEKSKVDTLITISPNTWHASNGSYWKLNLEVELGSGSWKLEVGSGNYWKLKVENGSWKLEVKVTGSWNLKFEI

SEQ ID NO: 111422 - protein, 150 aa, Glycine max
  Coding DNA Sequence Number=SeqID_19737
EFRILVTGVAGGEVFRVRPGVVGSSGISRIGVEGSDCKSQGVPSVVELMILAVVSPMKNQLMKSIIWGTSQDTISMQVDSLDSSMASSIINSMDSGEITLEILSTKTRVDRPQGCNNKGLVSMIEQRSWKRLLLNSCKYLCQTIRAQSLP

SEQ ID NO: 111423 - protein, 267 aa, Glycine max
  Coding DNA Sequence Number=SeqID_19738
  Subcellular localization annotation: CTP_CleavageSite=37; ConfidenceScore=5.48e-01
MPSLFAIPGTKGVVGNGHRPMGKASSASIAGGGVRPPASVKRLSPSCYACRDRTLLGQRRGDGNVLPNDHNSDLPLPKCQLVYAILTQMSVHVAQLISDIIYQFAKIAPTRHPVDPEKFNRALGFPTLIIGLCQFYGVPVTPNKIIRPPINRAYIEKYCMPKLECCIRHVANQQATNHRGQVRLNESFYPCTLHQQSQDPSPYAWPTPEELEVIVAWPRDWPNFQTGAGPKGTSRDGDEAQEDDDMANVMDFFLGGGEVVRPGSPNL

SEQ ID NO: 111424 - protein, 406 aa, Glycine max
  Coding DNA Sequence Number=SeqID_19739
  Homolog annotation: Hit_ID=Q6WAY6; Match level="QueryCoverage=81%, HitCoverage=59%, E-value=2e-26, Identity=28%"; Hit description =Putative uncharacterized protein
EKVLADQGEWTSFIDILALLIFKVILFPNVDGLVDLAAIDAFLADHHSKESPVTAILVDLYDTFDRRCEKSDTRIVYCTPTLYVWLVSHLFRHESRPVCPMQGHYICAEKGEVNWEQLLASVVGASINWFPWWKKGGVGVLSSCKGFPNIPLMGMRGCINYNPVLAIRQLGYPMRGAPSEESIMPLIARGFSDHNARILQGVHKAWGAVQRKDKELRGSANGIIDDYHKWLKTQTQELDWIQKLKVSSEERDEILEESEEVQALKAELERAQAVKEKFKTTAIELKLWNGKQRGPKRKNTAETSFEGLYGGSNNELKLPRAERDYLPKVEKELVRTIEQDQRKHVGHHRPIQGKVKPSGNSQTKARGRVREGISPASGKGSKGKGCHDIALQNMQLVYDRMNRLNK

SEQ ID NO: 111425 - protein, 62 aa, Glycine max
  Coding DNA Sequence Number=SeqID_19740
RSEEDLEELPPKPTVDDLDLPEDDEDPLPDVDFPEDVLSASEADSTEESGPGGTANSDDSSS

SEQ ID NO: 111426 - protein, 179 aa, Glycine max
  Coding DNA Sequence Number=SeqID_19741
MVESLLRWFGHVWQSLVEALKRRVEQMEDNVATRGRGIPRKTISKTINISNILHIIQRSVDGKLLSVITEDLEVFQSRFLTLNFETSLDILNVGKSLDKAAMPNTVGNVGFSLKGCCFIGVLRWGWSSVVGKVGGGGKRKKESHEDSISGGFNLFSVSLTFENFIGTLGGITGGISGNR

SEQ ID NO: 111427 - protein, 172 aa, Glycine max
  Coding DNA Sequence Number=SeqID_19742
MEGKQTLDGQGYLPLTETSQMNFSGVALQRLKRHRAQSKLEFEGHCKNKNYFDINTTKIKLYEKKIPKIQNERNTKLRNILIQVGGCALCGGAQESSTCMTQEETSKKVNYMANMNHHGYNQRSNASYHPRSNAGFHQGGNFSQNQGQDWRFHPSNNFKKDQVGSSNCPLPP

SEQ ID NO: 111428 - protein, 105 aa, Glycine max
  Coding DNA Sequence Number=SeqID_19743
  Homolog annotation: Hit_ID=A4F1R9; Match level="QueryCoverage=50%, HitCoverage=11%, E-value=1e-15, Identity=73%"; Hit description =Putative glycosyltransferase
MASVVKCLMEGQEGKKLHYRIKDLKEVAAKVLSPHGSSTDHISNLLLKWTNKPPSLLVWFGSIFVFVYPEPKEWCKIEIHVVFVTHFSVMLDSLRDTKIANNALH

SEQ ID NO: 111429 - protein, 104 aa, Glycine max
  Coding DNA Sequence Number=SeqID_19744
  Homolog annotation: Hit_ID=A5B7I7; Match level="QueryCoverage=76%, HitCoverage=9%, E-value=2e-10, Identity=39%"; Hit description =Putative uncharacterized protein
MYGDVQLRQGLICQMKGNWTPEQCYKFYDPKLKTIFETGTATFFEDIESGGKNKVRDFVLEEESVTIPELIHTVVIDKANSEPLKDIVIESLTQDNLVVHEEQT

SEQ ID NO: 111430 - protein, 271 aa, Glycine max
  Coding DNA Sequence Number=SeqID_19745
  Gene Ontology: Mol. function=ubiquitin thiolesterase activity; Cellular component=nucleus; Biological process=ubiquitin-dependent protein catabolic process
  Homolog annotation: Hit_ID=A7PGA4; Match level="QueryCoverage=51%, HitCoverage=12%, E-value=1e-36, Identity=47%"; Hit description =Chromosome chr6 scaffold_15, whole genome shotgun sequence
  Pfam annotation: Domain name=MATH; Domain location=18-138; Score =34.5; E_value=4e-07; Accession=PF00917.17; Description=MATH domain
MDNENAKDKIFEKFTWRIRNFSTLDSKPLYSEEFFLDNHTWSILIYPKGNKVAYLSIYLDAGDPDDLPHGRRKYANFKLALVNQVHDKYNDIEETSHVFSASETNWGFTTFTPLNKLCDPSLGFIVNDTCIIQVQILANKSKHENQVDQSVNKIDYKIVERMDNPLPKEMISTSFGGLVDFRGLGKLEEDFVPLLEEKVVQVKTLEENVTTLEMKTKGLKTKLIEAEEKNFKEQATWSIAPESKIQSLGSALLMLQIVVEAVTSKLDTVVA

SEQ ID NO: 111431 - protein, 101 aa, Glycine max
  Coding DNA Sequence Number=SeqID_19746
MPLTMVTRPVIQKGEKLEGVAAGVLLSPGHALSEYHPLSETSARLVTRPASYLSLLALSALGSLSQSSLTRAKCKNGAKHAFKNRKPFLKLEVKKKRDLGR

SEQ ID NO: 111432 - protein, 216 aa, Glycine max
  Coding DNA Sequence Number=SeqID_19747
  Gene Ontology: Mol. function=aspartic-type endopeptidase activity; Biological process=proteolysis
  Homolog annotation: Hit_ID=A5B4G8; Match level="QueryCoverage=71%, HitCoverage=18%, E-value=1e-11, Identity=31%"; Hit description =Putative uncharacterized protein
MTRGNPGDLQPFDPEIDRTFHRLVRHSVHHYPEHFVPFEHPEHSVIGESEHSVVGNFEHSDFEHYENMAQPPPHERTLREMAAPDFTYESMCIQYLDEDVLYVLKTELIHLLPKFHGLAGEEPHKHLKEFNIVCSTMKPPDVQEDHIFLKVFPHSLEGVAKDWLYYLAPSNMERSMIDAANGGALGDMTPAEARNLIEKMTSNSQQFSARNDAIVI

SEQ ID NO: 111433 - protein, 385 aa, Glycine max
  Coding DNA Sequence Number=SeqID_19748
  Gene Ontology: Mol. function=ubiquitin thiolesterase activity; Cellular component=nucleus; Biological process=ubiquitin-dependent protein catabolic process
  Homolog annotation: Hit_ID=A7Q028; Match level="QueryCoverage=36%, HitCoverage=12%, E-value=7e-25, Identity=41%"; Hit description =Chromosome chr8 scaffold_41, whole genome shotgun sequence
  Pfam annotation: Domain name=MATH; Domain location=43-161; Score =33.0; E_value=1.1e-06; Accession=PF00917.17; Description=MATH domain
MTVKRGNMTEEDVRRPELAPDVHTGMVNELTTGVDFEKFSWKIEDFSKKNLMKLRSKPFKIRGCTWRLLVYPLRRDVNHFSVYLMVADSLPPYGWSRNTFFKLALINQVDRNKSIAKETQQKFNGGYRCWGSFFLNLTDFNNPKQGYLVRNTCIIEAHICVSDLAPKIQVHPNSSPIHDSCDQATEESSSDDRDTISPRTSGSSTAAEGEIQGSNNLTLRELIDFESLGAEEQAFIPLLEEVCIWHPNLIKCQRERTRRFRQWAFTSLGHVLHFLKTKRVKDINEEDIKYLHGLWKELVKSSGFDLAWLEPYVQLALGSRAYMERANQLKKLKDKVVALEIKMKRLRGELAAAEGEFEVARRGLSEVRRGFNEMDLNAAIGYAMF

SEQ ID NO: 111434 - protein, 53 aa, Glycine max
  Coding DNA Sequence Number=SeqID_19749
MEELINKTQLSPKIISTSSHQLGGSTKESHFSYSTAVILLLRTRVRDHHRYVN

SEQ ID NO: 111435 - protein, 217 aa, Glycine max
  Coding DNA Sequence Number=SeqID_19750
  Subcellular localization annotation: CTP_CleavageSite=38; ConfidenceScore=5.68e-01
MATPPSSPPPPPESATPSSPSSSKNTRKATRIRSLTTRPAGVKRLVVHVDPVIGKFDGPHRKKLRTYLGIVFRDKEGEDDKVCEKYRISKEKWTQFCQSLGDPLWEDSLEEQASQGSFATHGRQDVLTVAIRRPEHPGLAQPPEAEVGPSTTRVNIKESCVDPSRQDPETGDSDKFGIYVNDNHPRIVALGRVYKGSTVIHSIPLGNDQVKVGVEEV

SEQ ID NO: 111436 - protein, 188 aa, Glycine max
  Coding DNA Sequence Number=SeqID_19751
  Gene Ontology: Mol. function=hydrolase activity, acting on ester bonds; Cellular component=cellulose and pectin-containing cell wall; Biological process=lipid metabolic process
  Homolog annotation: Hit_ID=Q9LY84; Match level="QueryCoverage=41%, HitCoverage=20%, E-value=2e-09, Identity=41%"; Hit description=Early nodule-specific protein-like
MAERLTAVQNFGKRFVKPSKVTKDIHTDRWSKEAWILRQDVCAGCCSFGIAGNDPKVAQFNQFKARIGKFFKQEGRNSFREHFPRLEDFAKAIYIFDIGKNDIVAAINRVGHEDSHAVISDIVDYFENQIQVKTPHQFLGLPQGAWFQDGGFEISVLDLGLQISKNSTPVDLNTKFRFGVLPTILNEL

SEQ ID NO: 111437 - protein, 65 aa, Glycine max
  Coding DNA Sequence Number=SeqID_19752
MFGYSPFTKCKPRAKRIFGHALSRESQALSAQPLHLRLIWSAKLAKAEQSQFQFDLNSAKRRPDR

SEQ ID NO: 111438 - protein, 90 aa, Glycine max
  Coding DNA Sequence Number=SeqID_19753
NNYKTNRYRLPLLDFVGVTPTGMTFSAGFAYVEGEHVYLKERCPLPPVALLWSNNCHLQTKSWPNPYISRMQHYKSFVMFKRDYVDINDD

SEQ ID NO: 111439 - protein, 36 aa, Glycine max
  Coding DNA Sequence Number=SeqID_19754
MVYKGWSFDGASMVRKKKGIATSSRFSAPVGASFRK

SEQ ID NO: 111440 - protein, 161 aa, Glycine max
  Coding DNA Sequence Number=SeqID_19755
  Subcellular localization annotation: CTP_CleavageSite=15; ConfidenceScore=5.04e-01
MAQASANIATFHITRKSRVPPSVDNVIPMPSINRTPGFFIKEFALNHLVDMSLISYHGHRVMNKNGRDKGLEKCAIDVEDSDKSNMEEVVRLESALATIETEKDAEREETGAPNGGQLNAPPSESQMTNPGEEDVGEEDEAQKEKPFSVVLLVMLDFSHFI

SEQ ID NO: 111441 - protein, 107 aa, Glycine max
  Coding DNA Sequence Number=SeqID_19756
MSERKGDGMEPLHCSDFNGHLGLEVRGKERKRDPNKKVRYSIFGPPIPGDSCAFLRGHGATVRSWSDTTSLFNCVGNQNALSFQLLIFVYLTVEIHDRFGPIGGPSS

SEQ ID NO: 111442 - protein, 226 aa, Glycine max
  Coding DNA Sequence Number=SeqID_19757
MPRRPLSGDLSIWYFDLLLGWRQVRIQTFFPNQSLFISFVVLLAQWSNLEEGSWMFFSIYHHYGPYGQIDVVRIIVCPFEKDECPTHVISAKGFVSEVNSLLVFTFGHQESQTDSLALLCKGLTSDVWKYVVEVNSSEMQPKGNLSFDPVCIWLWFRYRLKTFFRALISGEIQQNSMKQTNSIHRNLTLSNTSSLSSILGFIHFNFKYLTIRYAFQRIEFSLNIFV

SEQ ID NO: 111443 - protein, 122 aa, Glycine max
  Coding DNA Sequence Number=SeqID_19758
  Gene Ontology: Mol. function=nucleic acid binding
  Homolog annotation: Hit_ID=A5BY76; Match level="QueryCoverage=67%, HitCoverage=9%, E-value=5e-13, Identity=43%"; Hit description =Putative uncharacterized protein
MDSSEDSENEVVNLSLMAKIMKAMKRYYIRKAKVSLKKSWYIDSRCFKHMTGDASKFTHISPKKNGHVTYGDNNKGRILGVGKIESLEEMHIYGEDHKGKGDGNNEDFHIDEIKANADLPRE

SEQ ID NO: 111444 - protein, 76 aa, Glycine max
  Coding DNA Sequence Number=SeqID_19759
MTPTHDALLYYNGRWNMSRQNEFVGYSFTGKNPKKFDIHSKCTMDELKDLIKQVVPHGIPPYGIHETQTVLIESNY

SEQ ID NO: 111445 - protein, 98 aa, Glycine max
  Coding DNA Sequence Number=SeqID_19760
MEGVFSSVRISDPLERVFIDGDLDWEYLSSQQSLHKQSSWWKDIGKVFGWRDQGGWFDSHIPWRVGDGKQFYEDIVTVSLKKLVADVRVWDLEGFGLY

SEQ ID NO: 111446 - protein, 644 aa, Glycine max
  Coding DNA Sequence Number=SeqID_19761
  Gene Ontology: Mol. function=RNA binding; Cellular component =intracellular; Biological process=mRNA processing
  Homolog annotation: Hit_ID=A7PW23; Match level="QueryCoverage=87%, HitCoverage=30%, E-value=0.0, Identity=61%"; Hit description =Chromosome chr8 scaffold_34, whole genome shotgun sequence
  Pfam annotation: Domain name=S1; Domain location=176-250; Score=87.4; E_value=4.5e-23; Accession=PF00575.14; Description=S1 RNA binding domain
  Subcellular localization annotation: CTP_CleavageSite=49; ConfidenceScore=5.13e-01
MLSGVTLKLFVGVALKLFAEVGIAPVSFAGVGISRVSPVLTGVASVFAEAMKMGQRTLDTIFNFFKNLNTLRELFTRYSYSEGYIKNVTPKGCFIMLSRKIDAKILLSNLSEQYVQELEKEFPIGKLVIGRYLKKCTKTANNRVISVEPLSNRVEVTLKTSTDPNIPKSEIIDLSKFHVGDVISGRIKRVESFGLFIAIDNTNMVGLCHVSEISDNRIENIEANYRAGERVNARILKVDEERHRISLGMKNSYMRDETMLQIPSEEESDEPITDGMKSITSMNSSLLGTSNIDVEDEINQFPILSQVQQRADIPPLDVPLDDFDQFDVNNTNSQSEEHANEEDIVNEKHKRREKKKAKEEREKQIRAAEERLLEDDVPRTADEFEKLIRSSPNSSFTWIKYMDFMVSMVDVEKARSIAERALRTINIREENEKLNIWKAYFNLENKYGNPREEAVMKVFQRALQYNDPKKVYLALLGMYERTEQHNLADELLNKMTKKFKHSCKVWLRRIQSLLKQNQDGIQPVIDRASLSLPKHKHIKFFSQTAILEFKVGVLDRGRSMFEKILREYPKRTDLWSVYLDQEIQHKDKDIIRALFERAVSLSLPPKKMKFLFKKYLYYEKSQGDEERIESVKRKAMEYVESTRA

SEQ ID NO: 111447 - protein, 129 aa, Glycine max
  Coding DNA Sequence Number=SeqID_19762
MTCDSLGVRIIFVDICNQPTFRMKGVCYFTTKRLPEERVPPERDTWLVWTGRCDRGGRACLPGATSRAYLPGATSRAYLPGATTSGSLAGTSTSGGAPGTSLFPIKPSALRFIFTQTQNQAHLETLKLS

SEQ ID NO: 111448 - protein, 597 aa, Glycine max
  Coding DNA Sequence Number=SeqID_19763
  Gene Ontology: Mol. function=catalytic activity; Cellular component =integral to membrane; Biological process=metabolic process
  Homolog annotation: Hit_ID=A7PW19; Match level="QueryCoverage=87%, HitCoverage=86%, E-value=0.0, Identity=69%"; Hit description =Chromosome chr8 scaffold_34, whole genome shotgun sequence
  Pfam annotation: Domain name=Epimerase; Domain location=123-452; Score=-58.2; E_value=0.0078; Accession=PF01370.12; Description=NAD dependent epimerasedehydratase family
  Pfam annotation: Domain name=NAD_binding_4; Domain location=125-431; Score=369.3; E_value=6.3e-108; Accession=PF07993.3; Description=Male sterility protein
  Pfam annotation: Domain name=RmlD_sub_bind; Domain location=191-401; Score=-187.3; E_value=0.078; Accession=PF04321.8; Description=RmlD substrate binding domain
  Pfam module annotation: Pfam domain module=Epimerase::NAD_binding _4::RmlD_sub_bind; Domain location=123-452::125-431::191-401
  Subcellular localization annotation: CTP_CleavageSite=39; ConfidenceScore=5.46e-01
MGVLSIGYSFSSSLLTKLIFGVPQNNERCPSRRKACVVYCQGGGNVIKSSSGLSSVLTERSALVGTDHAAAVLMDAGSLVLSQNGKSQAEILVKDLVPYDGPTTLIGVEDGIGIVKFLGGKKFFITGATGFLAKVFIEKILRTEPDVGKMYLLIKAKNKQAAMERLQNEIINTELFRCLQEIHGKSYQAFMLSKLVPVVGNICEHNLGLDEGISDVIAEEVDVIVNSAANTTFDERYDTAININTIGPCRLMNIAKKCKKLKLFLHVSTAYVNGQRQGRIMERPFSIGECIAREKYISEVSPKYLPTLDIEGEINLVSNYKGDIEDNLLAQKMKEIGLERARRYGWQDTYVFTKAMGEMMIDKLRGDIPVVVMRPSVIESTFSEPFPGWMEGNRMMDPIVLCYGKGQLTGFLVDPNGVLDVVPADMVVNATLAAMARHGVSQKPDINVYQIASSVVNPLVFQDLARLLYEHYSSSPCIDSKGRPIQVPLMKLFSSTEEFSGHLWRDAIQKRGLTAVASSKGKMSQKLENMCRKSVEQAKYLANIYEPYTFYGGSQSEIMRHDFEDSYYKRWGTYRHELSNHQRIFNLQDQSNNDFIY

SEQ ID NO: 111449 - protein, 189 aa, Glycine max
  Coding DNA Sequence Number=SeqID_19764
  Gene Ontology: Mol. function=phosphoprotein phosphatase activity; Cellular component=cytoplasm; Biological process=negative regulation of mitotic cell cycle
  Homolog annotation: Hit_ID=P48578; Match level="QueryCoverage=91%, HitCoverage=55%, E-value=1e-98, Identity=95%"; Hit description =Serine/threonine-protein phosphatase PP2A-3 catalytic subunit
MATIIQNLFVLKISALYGNASVWKIFTDLFDFFPLTALVESEIFCLHGGLSPSIETLDNIRNFDRVQEVPHEGPMCDLLWSDPDDRCGWGISPRGAGYTFGQDISEQFNHTNKLKLIARAHQLVMDGFNWAHEQKVVTIFSAPNYCYRCGNMASILEVDDSMGHTFIQFDPAPRRGEPDVTRRTPDYFL

SEQ ID NO: 111450 - protein, 186 aa, Glycine max
  Coding DNA Sequence Number=SeqID_19765
  Gene Ontology: Mol. function=diphosphate-fructose-6-phosphate 1 -phosphotransferase activity; Cellular component=6-phosphofructokinase complex; Biological process=glycolysis
  Homolog annotation: Hit_ID=Q2HTG9; Match level="QueryCoverage=80%, HitCoverage=23%, E-value=6e-50, Identity=69%"; Hit description =Pyrophosphate-dependent phosphofructokinase PfpB
MTIGDLEVRRGPRYGINLAKGILEHHLKGILDSDKPRKLLEDFRIGKLITGNIHRLQVGKIEAEKMLIQMVETELEKRKQQGTYKGGFGGQSHFFGYSVYFRYIILRIVSYEGRCGLPTNFDSTYCYALGYGVAALLQSGKTGLISSVGNLCAPVEEWIVGGTALTSLMDVERRHGKFKPVIKKTN

SEQ ID NO: 111451 - protein, 122 aa, Glycine max
  Coding DNA Sequence Number=SeqID_19766
  Gene Ontology: Mol. function=phosphoprotein phosphatase activity; Cellular component=cytoplasm; Biological process=protein amino acid dephosphorylation
  Homolog annotation: Hit_ID=P48578; Match level="QueryCoverage=89%, HitCoverage=34%, E-value=8e-58, Identity=98%"; Hit description =Serine/threonine-protein phosphatase PP2A-3 catalytic subunit
  Pfam annotation: Domain name=Metallophos; Domain location=36-121; Score=40.9; E_value=4.5e-09; Accession=PF00149.19; Description =Calcineurin-like phosphoesterase
MQKEFYCSKYVVLVRVLCEKAKEILMDESNVQPVKSPVTICGDIHGQFHDLAELFRIGGKCPDTNYLFMGDYVDRGYYSVETVTLLVSLKVRYPQRITILRGNHESRQITQVYGFYDECLRK

SEQ ID NO: 111452 - protein, 187 aa, Glycine max
  Coding DNA Sequence Number=SeqID_19767
  Gene Ontology: Mol. function=ATP-dependent helicase activity; Cellular component=cytoplasm; Biological process=translation
  Homolog annotation: Hit_ID=Q2R1M8; Match level="QueryCoverage=55%, HitCoverage=16%, E-value=2e-44, Identity=85%"; Hit description=DEAD -box ATP-dependent RNA helicase 52C
  Pfam annotation: Domain name=Helicase_C; Domain location=11-86; Score= 100.0; E_value=7.2e-27; Accession=PF00271.22; Description=Helicase conserved C-terminal domain
MSVLRGGAMMGLGIMGCLSPTSSSMECEERELALRSFKTGNTPILVATDVAARGLDIPRVAHVVNFDLPNDIDDYVHRIGRTGRAGKMGLATAFFNEGNFNMAKPLADLMQEANQEVPAWLSRYAARATYSGGNRNRKSGGSRFGGRDFRKEGSFNKATDYYGGGTGGGYCGNYGGGYGQGVPSAWD

SEQ ID NO: 111453 - protein, 41 aa, Glycine max
  Coding DNA Sequence Number=SeqID_19768
MAKEEKFSVTDDSLNETDPLSEWHPLSEAYNSLNGLGNPRR

SEQ ID NO: 111454 - protein, 103 aa, Glycine max
  Coding DNA Sequence Number=SeqID_19769
MKKVLHQLFNRNPQLRVLAFHGKEAPFTIKKGNQEKLLAYTGGGMSPPPLGTAQSLKSSLISLKVENLAPCFASSFYAVHTQRLSVVSLQNLFPPLFSVQIRL

SEQ ID NO: 111455 - protein, 125 aa, Glycine max
  Coding DNA Sequence Number=SeqID_19770
DSDDVLQRRRPTASARRQREVVVVAEDAPHVDDAVEEVFQHADEVVDDFEGFPRPRDPSVLIVYADHVAVIVWNEEERPELKLSSHGRKVQKFGRFAVEIERLVVGIRLSPLIAYSLDTGHQRLI

SEQ ID NO: 111456 - protein, 30 aa, Glycine max
  Coding DNA Sequence Number=SeqID_19771
MARVLLQRRKKNKCRDDERERESLLMVEGP

SEQ ID NO: 111457 - protein, 94 aa, Glycine max
  Coding DNA Sequence Number=SeqID_19772
MQEKIDCNNINEIREERNTNSIYTGLATSRAYIQSSSNLREIFHYLCKSFTDFEHTLGSLTIVFKDSPRDNPSLDYNSHNPRTTSLLIATDFLR

SEQ ID NO: 111458 - protein, 151 aa, Glycine max
  Coding DNA Sequence Number=SeqID_19773
MTVDTNPFLKLNINMVSYEYPTTKKKGETEGTSNGSTYQIIDPKLANMWQAMKRKEESMKIEKLRQQIHGNMEVAHMPKIDDRPIPRSKIMVVEFNVENEMKTLWITVDSEGNSKFRMIKPSTNAEIGQWCLNQKAVQDKENPQLGGLTHT

SEQ ID NO: 111459 - protein, 175 aa, Glycine max
  Coding DNA Sequence Number=SeqID_19774
  Homolog annotation: Hit_ID=A5BLR4; Match level="QueryCoverage=37%, HitCoverage=24%, E-value=6e-12, Identity=50%"; Hit description =Putative uncharacterized protein
MQKPWNLRLCKPTLIPKATLKIGIGPSQKPPPRHQQWSIPRRRQQRQQQPRIEVAAASRVLRHAVQVCSLAYAYGFILSANFSKWREKLPPRPSFHNYVAVMFVFSVITLFAYGLAEIDAGLNNWLYDLTMLCYHCVINTNAISLVDNAYYFALGILRNSAFEIDHIFINQGHTY

SEQ ID NO: 111460 - protein, 154 aa, Glycine max
  Coding DNA Sequence Number=SeqID_19775
  Gene Ontology: Mol. function=hydrolase activity, acting on glycosyl bonds; Biological process=cell wall organization and biogenesis
  Homolog annotation: Hit_ID=A7QP20; Match level="QueryCoverage=30%, HitCoverage=9%, E-value=5e-12, Identity=68%"; Hit description =Chromosome chr1 scaffold_135, whole genome shotgun sequence
MKRSRSFSLLFYLYLLVIVFSTFSIVSVEARKTNTKKKLHKPHKGGHTRGSHSPCPILAPQGSTFDVLAFGAKGNGVSDDSEALLAAWNRACKVAGATVKIPAQLKGIEANTIRKIHFQHRLFTAFYVGFKIDVESTDVECIIVNIGFEKPMLT

SEQ ID NO: 111461 - protein, 189 aa, Glycine max
  Coding DNA Sequence Number=SeqID_19776
MAGRSGPSFALKTRNEGFFQQHCMKQWLRQVCTSLNIPAPSIVLSDIKFNDEVEFRRYCGTLIRSFDGNQLSHVRRYALTDYDAQEDRNQSWEMVFRMDMSMHKQVKVAMEANKQLEHETPTPALEVDQQNARAENGCVYTNLQDGNFITIDHYYTLDTPTNIGDQPEGGADEYIMMNTIRHSSILSDL

SEQ ID NO: 111462 - protein, 160 aa, Glycine max
  Coding DNA Sequence Number=SeqID_19777
  Homolog annotation: Hit_ID=A7QUI1; Match level="QueryCoverage=94%, HitCoverage=36%, E-value=5e-37, Identity=54%"; Hit description =Chromosome chr10 scaffold_179, whole genome shotgun sequence
MECGVGRGNREVIEVLKRKDMEDYERLGNIALKINKGYAVSAPLLTGIAALGSVFSGDGLVPALARALATVVNAFEHGVQVGMVFEMYRTCGGFFQLLEETIEAAIEEKDLDKRENGKLIEMKMALQLGRSVSQLRKLATKSASCCIEGREIHEFASKLF

SEQ ID NO: 111463 - protein, 252 aa, Glycine max
  Coding DNA Sequence Number=SeqID_19778
  Subcellular localization annotation: CTP_CleavageSite=75; ConfidenceScore=5.11e-01
MQSSSRPPSCARNCPPIGDQLGAQRSSLPGDTPTQYKQVSMTMDQLKRLSIPSERLRFFNHACYPRLGHPTRKINMQQGQAVILIARFPDPNYGVKTGFVLYRNRKPSWKIPLRLKGSSRCGVSTEKNDSLWWLMVAVGDVESAWDVRNGFGRKKEKKMMFFLSYLDYKAQNAQVSNALGNGNLAHTPGIFSTIPTAKFREDPTVNEGWTTFLLRQLHVASLRSFIKRLPQEASSWLLSEAFSRVFFEKLML

SEQ ID NO: 111464 - protein, 50 aa, Glycine max
  Coding DNA Sequence Number=SeqID_19779
MESLSSSKTAAEVDVTLHFLALSFNTYLHKGCLDISLSPKSAASGKVVPW

SEQ ID NO: 111465 - protein, 134 aa, Glycine max
  Coding DNA Sequence Number=SeqID_19780
MLIDVRNALACACCVCSWGALCTDPPGSLALAFGRVHTLDVVYVHGGHCALTFQGLWHYLLATNIRRMECMSWGVECTDLFGWPRRALIGPWSLALTFGRDHSSYDTGNRVTVGKCNSVLGGCHLVGNTFGLQG

SEQ ID NO: 111466 - protein, 109 aa, Glycine max
  Coding DNA Sequence Number=SeqID_19781
CKRKSYHLFIPPVPDESLSEALERFRGLLWKTPTHGFSEPIQLNIFIDGLRPQSKQLLDASDGVAGCIIYGGAHESGCCIPNEEQIPHEVNYMRNQPRGRFNTSGFPGF

SEQ ID NO: 111467 - protein, 222 aa, Glycine max
  Coding DNA Sequence Number=SeqID_19782
MVGSGSKNCYCWLGLLRSWCRGWLWHGIWRSFLLLNHRLIIFRILGCGCPTPSNRKRLDSWPGHLSLKLLHSHDESIEWSILGENVKSDAEAVGIYIGSCEVDGEAEVDGAVGVGKVDEEGAEVSGTTVVVGVSNLLPLAFLGPLNVIVGSYRFQQFFLMYAKLMAGLRLSRDLESDWTPLALHRAVIKAGNPSLEQLCCVVIEIWCEMWYPIFISIFMMMP

SEQ ID NO: 111468 - protein, 127 aa, Glycine max
  Coding DNA Sequence Number=SeqID_19783
MLQQKLKFVVEGHLVIVSGEEDILVSCLSSTPHVEVVQESLETSFQALEIVNNAYVEAHLVQPHLSGASLMDGYDPEMGLGQNGDRTTNLVRFVENCEDGTGRYGKDNLHHSIWNCWTSGLNNLRGG

SEQ ID NO: 111469 - protein, 152 aa, Glycine max
  Coding DNA Sequence Number=SeqID_19784
MGSSQNPSLKKRFYQVKIKSLEVTSLRELGKLMGQLQWQAFRKAYGKIWDLARDFQLVPTVKEFEEIQGFPLGGWKPYLFSGFYPSTTRVAKANGLSFIDILALLIFGVVLFPNMEGLVDLAVIDAFFAFHHGKKSPVVAILAMYDTFRPGM

SEQ ID NO: 111470 - protein, 71 aa, Glycine max
  Coding DNA Sequence Number=SeqID_19785
MMTTKDDDKGDEQKAQRSKNISSESRTSQEFKNQGEFKTQEESLESRIKIQNLKNQNQDSRMKKRLNQDKY

SEQ ID NO: 111471 - protein, 76 aa, Glycine max
  Coding DNA Sequence Number=SeqID_19786
  Gene Ontology: Mol. function=aspartic-type endopeptidase activity; Biological process=proteolysis
  Homolog annotation: Hit_ID=A5B5G7; Match level="QueryCoverage=63%, HitCoverage=3%, E-value=2e-10, Identity=60%"; Hit description =Putative uncharacterized protein
TPRVFLSWNTHPASLASPSRRRVGCDTEQEEKFLLGLKKHKKAIGWTLADIPGISPSTCMHRILLQDGAKPVRQPQ

SEQ ID NO: 111472 - protein, 363 aa, Glycine max
  Coding DNA Sequence Number=SeqID_19787
  Homolog annotation: Hit_ID=Q6WAY6; Match level="QueryCoverage=29%, HitCoverage=19%, E-value=2e-12, Identity=35%"; Hit description =Putative uncharacterized protein
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKRRPVPSLHACRSTLEDPLPRWKEGKEGVLFSCGDYPNIPLIGTRGCINYNPALAIRQLGYPMRGAPTEESLSPFLTRNLGTQSLKAIQRVHRAWRSPLRKDQELRGIRNGIIGGYHEWLKVHIRGLDWLAKLKVVSEESFEAPEEDEEVQALKSELGKAKLAKEKFKLAATQTRKECAGLREENATTVRALEQETKRARKEEYGRNKFREALWGSNSELKLRREERDQSRAHSMVLKE

SEQ ID NO: 111473 - protein, 140 aa, Glycine max
  Coding DNA Sequence Number=SeqID_19788
  Homolog annotation: Hit_ID=B0HC01; Match level="QueryCoverage=23%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTQVVDSWKPKPKQALVERSMLGKGRYHQNKAW

SEQ ID NO: 111474 - protein, 79 aa, Glycine max
  Coding DNA Sequence Number=SeqID_19789
MPLRSRIASAWPGDWPEDQTEEAPAEAPGDGEEARMDEEMTDLLDFLGGSGATNFWCYGSQLFLHYFRAFFVHLVVRHR

SEQ ID NO: 111475 - protein, 170 aa, Glycine max
  Coding DNA Sequence Number=SeqID_19790
  Homolog annotation: Hit_ID=UPI0000ECBAF8; Match level="QueryCoverage =24%, HitCoverage=48%, E-value=2e-16, Identity=100%"; Hit description= UPI0000ECBAF8 related cluster
  Subcellular localization annotation: CTP_CleavageSite=67; ConfidenceScore=5.08e-01
NAAFLRFLAFCWPFAHMVFPALSPDSVDNRITAFEKRKSAQYANRLSPRVGRFINAAGTTGFPTGKRAVSATQLIYDHDYEFELGTLFSMMIVEELGNHLMNNIHKLGAGSRWRRTTGMQAWHWPSFYNVVTGKTLALPNLIALQHIPLSPAGVIAKRPAPIALPNSCAA

SEQ ID NO: 111476 - protein, 127 aa, Glycine max
  Coding DNA Sequence Number=SeqID_19791
MSLPSAVHVSSIIKREASGDWEAQEKRRSRDESRHHEKAGRTKSVSYLCFPLISDERGGANSNQAHLDPPEDSSRRLLLLEEATLLAWAARSEEEKDSLLGTSLSLEFAEENYFREENSSRGASSST

SEQ ID NO: 111477 - protein, 73 aa, Glycine max
  Coding DNA Sequence Number=SeqID_19792
MAEINQGKTMTGHDWPRILFPVYRYIGTDASGGGVTTDQSLPLPGAKQAENVTAGQPSILCVHSFFYYFVLNK

SEQ ID NO: 111478 - protein, 125 aa, Glycine max
  Coding DNA Sequence Number=SeqID_19793
FARTAAGRRVWIMHTSMTTLTQMWMTLLLSNVLPSDHNSDLPLPKSQLVYAILARMNVHVAQLIADAIYLFAGMPPTRHPLDPDKSNRALGFSTLITGLCQSFGVPVTLSKGDAPQAIDAPPPPH

SEQ ID NO: 111479 - protein, 85 aa, Glycine max
  Coding DNA Sequence Number=SeqID_19794
MSLPSTVHVSSTFEFGAMLHDCLSVDPLVQSSILHFFAEPHECHCLALFMCPPRSSLEPRECDCLALFTNSPFSTSIRSPLNVIA

SEQ ID NO: 111480 - protein, 193 aa, Glycine max
  Coding DNA Sequence Number=SeqID_19795
  Homolog annotation: Hit_ID=A6FJQ2; Match level="QueryCoverage=19%, HitCoverage=84%, E-value=5e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARRIPVAEAVGEAGAGDELVDEEDDGARDRRAEEFQEAAVVTPADEGEAAAELRDINLTAEVAARNDDFAVTNYAAPGGRGKAWRGEIGGCGGDLREVVDVRVFRERVFET

SEQ ID NO: 111481 - protein, 128 aa, Glycine max
  Coding DNA Sequence Number=SeqID_19796
MVPKKLSTKRSRRDAAAEGSSATREFDSHRFRSAEHQQRFEAIKGWSFHRERRVQLREDEYTDFQEEIACRRWTSLVTPMAKFDPKIVLEFYANAWPTEEGINEALCLNLELGLGLNPELGLDLKTAD

SEQ ID NO: 111482 - protein, 178 aa, Glycine max
  Coding DNA Sequence Number=SeqID_19797
MTPTRHPLDPDKSNRALGFPALIIGLCQSFGVPVTPSKVIRPPITRAFIEKYCTQRQVQGDSPQAADAPPPHQAGPAGLFDTEQYLRHLVCQRAANHRAHVQTHDCLYQMSLSLQSQGFTSFPCPTPDQFRAEVAWPGDWPEAQAGEAPAEAPDEADEAREDEEMTDLLDFLGGSGAT

SEQ ID NO: 111483 - protein, 68 aa, Glycine max
  Coding DNA Sequence Number=SeqID_19798
MEAGSLSFNEVLQWRRGEERRHPLGNNPWKKELHDQECVLDKKLGEDCRSKLHDDEPSNFDDAKSPSD

SEQ ID NO: 111484 - protein, 68 aa, Glycine max
  Coding DNA Sequence Number=SeqID_19799
METSGRVIDLAQNGISVVIMPKKSFTFDKVFTPEASQEEVFTTTKSGFNIGVLTSVVKKTDVNICAVA

SEQ ID NO: 111485 - protein, 57 aa, Glycine max
  Coding DNA Sequence Number=SeqID_19800
MVMQSVKFYNATETRRRYYYAIRGSKLARLGELGGNHLPHLVKKWDSGASGTPVMLP

SEQ ID NO: 111486 - protein, 87 aa, Glycine max
  Coding DNA Sequence Number=SeqID_19801
VKIAKKNESYAKQANKKRKEVVLEPDDDPGHLRANAFQEGGNDENPETGQIQAKGPSGEGQRPRVEKDEGLEAETLPRLLIVVEGLD

SEQ ID NO: 111487 - protein, 52 aa, Glycine max
  Coding DNA Sequence Number=SeqID_19802
MAQLPPHERTLREMAAPDFTYESLCIQYPDEGVPYVLKTGLIHLLPKFHGLA

SEQ ID NO: 111488 - protein, 117 aa, Glycine max
  Coding DNA Sequence Number=SeqID_19803
  Gene Ontology: Mol. function=nucleotidyltransferase activity; Cellular component=intracellular; Biological process=regulation of transcription, DNA-dependent
  Homolog annotation: Hit_ID=A8G7X3; Match level="QueryCoverage=87%, HitCoverage=49%, E-value=9e-36, Identity=74%"; Hit description=DNA polymerase beta domain protein region
MPPVRPITAQAVAFHVREIARRTATQAGTLHKELSRLAEGGILLRQRQGNQICYQANADCLIFPELAAIFRKACGPAARLRQVLTGFGEDIERAFIFGSVASGKATAASDIDVLGIL

SEQ ID NO: 111489 - protein, 85 aa, Glycine max
  Coding DNA Sequence Number=SeqID_19804
  Homolog annotation: Hit_ID=Q2H7J5; Match level="QueryCoverage=94%, HitCoverage=35%, E-value=3e-08, Identity=30%"; Hit description =Putative uncharacterized protein
MEMWFHIDKNVKAKCKSLVGQKNAWEYVMDSWGNLVDCPSEQEFSEHLQRFQVACSPWPMFTDYVCETWIVPHKEKFILAWTNKD

SEQ ID NO: 111490 - protein, 159 aa, Glycine max
  Coding DNA Sequence Number=SeqID_19805
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
GRVGTGERTRELPGGNACLWKNASNAAFLRFLAFCWPFAHMFFPALSPDSVDNRITAFEKRKSAQYANRLSPRVGRFINAAGTTGFPTGKRAATAKKIVKADAYVAGMQAWHWPSFYNVVTGKTLALPNLIALQHIPLSPAGVIAKRPAPIALPNSCAA

SEQ ID NO: 111491 - protein, 117 aa, Glycine max
  Coding DNA Sequence Number=SeqID_19806
MSHFQILKLIQHKLPLGLSHLEMWFLHSFDTTSCFYKLQMKDLLHQWIPLLLGRRMAAEWRRKRERRRHFKEKISLEEAHHHRRPWIRAWRKKEMNEGRGREEHEILCSKRALKSEV

SEQ ID NO: 111492 - protein, 128 aa, Glycine max
  Coding DNA Sequence Number=SeqID_19807
MVILCLLSSRGGGPDDIRRQIMVIPLTFSPFRHSCVRWHVETNYGHSATFVIQRRWARWHAEKNYGHSAQLFAIQTQSCPMARKEKLWSFCVFCHPEAASPMTCEDKLWSFRSPFRHSDTVVSDGTQR

SEQ ID NO: 111493 - protein, 72 aa, Glycine max
  Coding DNA Sequence Number=SeqID_19808
MVQLWFGIRVKHLPVWENIGGPFGPANKSYSEPHELIIIHASSTNGSGAPRIDCLALFAYPTPSNLIRRPMN

SEQ ID NO: 111494 - protein, 151 aa, Glycine max
  Coding DNA Sequence Number=SeqID_19809
  Homolog annotation: Hit_ID=A0ST23; Match level="QueryCoverage=29%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLRNSEESSTQWTTGMGTELEFVIMVIAVSFGKPVVPAALMNRPTRGERRFAYWALFRFLAH

SEQ ID NO: 111495 - protein, 151 aa, Glycine max
  Coding DNA Sequence Number=SeqID_19810
LVACARSKWSLAQHLEAMEQSMLAIIGQYKEELNKSMAHEQKLVEDFAQVYAEKEARGRVIDALHQEATMWMDRFALTLNGSQDLPRLLVKAKAMAEEQMKADLSALKDQMASISEVMLKLQKTIEDKATATASSTVREATPVLQPALNPS

SEQ ID NO: 111496 - protein, 124 aa, Glycine max
  Coding DNA Sequence Number=SeqID_19811
MAFIPPFAAAIGAAGLPVGAAAAAGAGLSGLPEPGSPQRAGGGHQPHHAGGRAAQRGDDQRGAGDGAQLSSVLRAGRSHAAKAVSEPAQAVFADAGRPCADSAGRALLSNVAPAADPAGGDQMP

SEQ ID NO: 111497 - protein, 74 aa, Glycine max
  Coding DNA Sequence Number=SeqID_19812
VEARDTHLSFDMWGGHHHTTRCVCVARPNANALADGNTLKLSWLTSQFANIQDYVDDEEHLKMFAHAWILRFIG

SEQ ID NO: 111498 - protein, 143 aa, Glycine max
  Coding DNA Sequence Number=SeqID_19813
MAAQLIHDRVVMKCLEGVWETLEGNERCRFRGTIRLTATSLVHPEEPARTLLQPVEWILPTPTPYQLVELVQVIEVSSSEEDLEEDPEELPPEPAMDAPDLPEDDEDPLLDLDSPEDIMSASEADSTEESGPGGTAHSDDSSS

SEQ ID NO: 111499 - protein, 284 aa, Glycine max
  Coding DNA Sequence Number=SeqID_19814
  Homolog annotation: Hit_ID=UPI00006A2939; Match level="QueryCoverage =43%, HitCoverage=67%, E-value=2e-07, Identity=32%"; Hit description =UPI00006A2939 related cluster
GLHILALRGLHVLTIKGLHVLALRGLHALILGLHVLTIRGLHALTSRGLHVLALRGLHALTLGLHVLTIRGLHALTSRGLHVLALRGLHALTLGLHVLTIRGLHALTSRGLHVLALRGLHVLTLGTSYLHLQRTTRPRLQRVMYLQLQRTTRPRRQKDYTSSPSEDYMFPIFKGGHALTFRGLHVLAIIGLHSLAFERRHVLNFRGLHALAFRGLRVLTFRTSSFLLTVPEPPPDIGGGPTVRAQPEREAITQLLCIPGQDFTRAAAKRRVRIMRTNMTTLTQI

SEQ ID NO: 111500 - protein, 118 aa, Glycine max
  Coding DNA Sequence Number=SeqID_19815
  Homolog annotation: Hit_ID=Q51617; Match level="QueryCoverage=29%, HitCoverage=50%, E-value=4e-11, Identity=91%"; Hit description =Putative uncharacterized protein
MTVKTSDTCSSRRRSQLVCKRMPGADKPVRARQRMRKEKIPHQAPFAIQAVQLLGRAIGAGLFDITPAGERGMCCKAIKLGNARVFPVMTLSTLEDPHTSTNAPDPIRTPQLSVLGRE

SEQ ID NO: 111501 - protein, 98 aa, Glycine max
  Coding DNA Sequence Number=SeqID_19816
  Subcellular localization annotation: CTP_CleavageSite=27; ConfidenceScore=5.65e-01
MASPPASPPPAPSDALASPFAVKRTRKASRLRSLSTRPPGAERPVVHVDPATSKADGPHRKKLRTYLGIVVRDKVDVTYENWKEVPTAHKDLIWEDIQ

SEQ ID NO: 111502 - protein, 81 aa, Glycine max
  Coding DNA Sequence Number=SeqID_19817
MIVKGQDIYSSQDEATTSPSYSESEKAKGEESSEEIYPQQERQPLMVKEECKEVCVSSKRSNQHENIKKVLREEVQSFKNL

SEQ ID NO: 111503 - protein, 42 aa, Glycine max
  Coding DNA Sequence Number=SeqID_19818
MKILKGYTEDLHHPEANIVERMKKKKVEAAGVSLSEAYALSE

SEQ ID NO: 111504 - protein, 77 aa, Glycine max
  Coding DNA Sequence Number=SeqID_19819
MIPGRRSEGVEMEKIGGKQNNSRSMKEKDQRTFRPDKFSARSFSTGDIPPHLNKEEKTETPSFLSKKHYPRENPIGP

SEQ ID NO: 111505 - protein, 172 aa, Glycine max
  Coding DNA Sequence Number=SeqID_19820
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
  Pfam annotation: Domain name=RepA_C; Domain location=21-128; Score= -66.6; E_value=0.069; Accession=PF04796.3; Description=Plasmid encoded RepA protein
  Subcellular localization annotation: CTP_CleavageSite=82; ConfidenceScore=5.06e-01
GRSLWKNASNAAFLRFLAFCWPFAHMFSPALSPDSVDNRITAFEKRKSAQYANRLSPRVGRFINAAGTTGFPTGKRAGKSIAAATTSASFASWNRPNFPPKVLLRSLAPYAWRLFFLQGRMQAWHWPSFYNVVTGKTLALPNLIALQHIPLSPAGVIAKRPAPIALPNSCAA

SEQ ID NO: 111506 - protein, 195 aa, Glycine max
  Coding DNA Sequence Number=SeqID_19821
  Gene Ontology: Mol. function=transcription factor activity; Cellular component=flagellum; Biological process=regulation of transcription, DNA-dependent
  Homolog annotation: Hit_ID=A8FA74; Match level="QueryCoverage=100%, HitCoverage=74%, E-value=5e-94, Identity=91%"; Hit description=RNA polymerase sigma factor
  Pfam annotation: Domain name=Sigma70_r2; Domain location=34-104; Score=60.2; E_value=6.8e-15; Accession=PF04542.5; Description=Sigma -70 region 2
  Pfam annotation: Domain name=Sigma70_r3; Domain location=108-189; Score=76.1; E_value=1.2e-19; Accession=PF04539.7; Description=Sigma -70 region 3
  Pfam module annotation: Pfam domain module=Sigma70_r2::Sigma70_r3; Domain location=34-104::108-189
MTQPSKTMKLTKDEVDRLIQSYQTNQDEQAQLTLVECYTNLVDMLAKKYSKGKSFHEDLRQVGMIGLLGAIKRYDPLVGKSFEAFAIPTIIGEIKRFLRDKTWSVHVPRRIKELGPRIKMAVDHLTTETQKSPKVQEIAEYLDVTEEEVLETMEMGKSYQALSVDQGVEADSEGSTVTILDVVGSQEEGYERVNQ

SEQ ID NO: 111507 - protein, 143 aa, Glycine max
  Coding DNA Sequence Number=SeqID_19822
  Homolog annotation: Hit_ID=P03851; Match level="QueryCoverage=58%, HitCoverage=100%, E-value=4e-44, Identity=98%"; Hit description =Uncharacterized 9.4 kDa protein
GISSLKGGNTVIHMNQGDNAGKNMTIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 111508 - protein, 31 aa, Glycine max
  Coding DNA Sequence Number=SeqID_19823
MLAGYAYTEKMHWRHLGDIRGNKPSAAEWLD

SEQ ID NO: 111509 - protein, 44 aa, Glycine max
  Coding DNA Sequence Number=SeqID_19824
MKGRANRGLKSENGSDRSGKVTCGKAWAEQMRKISDQSESKSHF

SEQ ID NO: 111510 - protein, 258 aa, Glycine max
  Coding DNA Sequence Number=SeqID_19825
  Homolog annotation: Hit_ID=Q6WAY6; Match level="QueryCoverage=69%, HitCoverage=36%, E-value=6e-12, Identity=28%"; Hit description =Putative uncharacterized protein
RPPFIDILALLIFRGVLFLNVDGLVDLAVIDAFLAYHNHKESPVRHACPLESHRSCTEKGGANWDQLLASKEGASVNWFPRLKEERTGVLILCEGFPNVPLMGTRDCISYNLVLAIRQLGYLMREAPLVEEIAPVISRGFNKTNMETFQKVLKAWEVVRKKDKELRGSNNGPIGGYHKWLKAHVQGLDWLPSLRTAKREEVEAPEEDEEENTELRDINVATTKALERETKRACREEHGRNKFRGALWGNNSELSSGIL

SEQ ID NO: 111511 - protein, 48 aa, Glycine max
  Coding DNA Sequence Number=SeqID_19826
MKMLLIPHYVAQCRASEWRKKKDDWRCHFKEKMSQEEAHQHRKRWIRA

SEQ ID NO: 111512 - protein, 247 aa, Glycine max
  Coding DNA Sequence Number=SeqID_19827
  Gene Ontology: Mol. function=ribonuclease activity; Cellular component=cytoplasm; Biological process=RNA processing
  Homolog annotation: Hit_ID=Q6DAI2; Match level="QueryCoverage=99%, HitCoverage=50%, E-value=1e-123, Identity=90%"; Hit description =Ribonuclease G
  Pfam annotation: Domain name=S1; Domain location=35-122; Score=77.3; E_value=5e-20; Accession=PF00575.14; Description=S1 RNA binding domain
MTAELLVNITPSETRVAYIDGGILQEIHIERESKRGIVGNIYKGRVSRVLPGMQAAFVDIGLDKAAFLHASDIMPHTECVAGDERKNFHVRDIAELVRQGQDLMVQVVKDPLGTKGARLTTDITLPSRYLVFMPGAAHVGVSQRIESEAERERLKAIVAPHCDELGGFIIRTAAEGIGEEELAQDAAFLKRLWTKVMERKKRNQTKYKLYGELALAQRILRDFAGAALDRIRVDSRLTHDLLVEFTG

SEQ ID NO: 111513 - protein, 403 aa, Glycine max
  Coding DNA Sequence Number=SeqID_19828
  Homolog annotation: Hit_ID=Q84VH5; Match level="QueryCoverage=100%, HitCoverage=63%, E-value=1e-174, Identity=74%"; Hit description =Envelope-like protein
  Subcellular localization annotation: CTP_CleavageSite=21; ConfidenceScore=5.25e-01
MATSPKDTSSPGSPSVPSSPSSTKAPSNQEQPEFHIQPIQMIPGQAPVPEKLVPKRQQGVKISENPSLATSPREVDPEMDKKIRSIVSSILKNASVPDADEDVPTSSTPNVSVPDADKDVPTSSTPNAEVLSSSRKEESTEEEDQATEETPAPRAPEPAPGDLIDLEEVESDEEPIANKLAPGIAERLQSRKGKTPITRNSSSDSDDDVELDVLDIKRAKKSGKKVPGNVPDAPLDNISFHSIGNVERWKFVYQRRLAVERELGRDALDCKEIMDLIKAVGLLKTVTKLGDCYESLVREFIVNIPSDITNRKSDDYQKVFVRGKCVRFSPAVINKYLGRPTEGVVDIAVSEHQIAKEITAKQVQHWPKKGKLSAGKLSVKYAILHRIGAANWVPTNHTSTVAT

SEQ ID NO: 111514 - protein, 109 aa, Glycine max
  Coding DNA Sequence Number=SeqID_19829
  Gene Ontology: Mol. function=catalytic activity; Cellular component =chloroplast thylakoid membrane; Biological process=cellular metabolic process
  Homolog annotation: Hit_ID=UPI0000ECBAF8; Match level="QueryCoverage =37%, HitCoverage=48%, E-value=1e-16, Identity=100%"; Hit description= UPI0000ECBAF8 related cluster
MTMITNSSSVPQVKADVTEGSDKLAEAIGDDSEAVVCATGFRPGWDLLAPWKSRPAGMQAWHWPSFYNVVTGKTLALPNLIALQHIPLSPAGVIAKRPAPIALPNSCAA

SEQ ID NO: 111515 - protein, 116 aa, Glycine max
  Coding DNA Sequence Number=SeqID_19830
  Subcellular localization annotation: CTP_CleavageSite=81; ConfidenceScore=5.88e-01
MPPKASGASLRGGRSTGKGSRLALPELSTKKSSSTSSRSPTQAGSSTQKTNFEGSSTQIISVKPESSTQESPKPATAKQTSVDYAWPIETLSFGHFQGFERRCSERTTFGSASFRF

SEQ ID NO: 111516 - protein, 88 aa, Glycine max
  Coding DNA Sequence Number=SeqID_19831
MSYEPSLLQCGKPNRNKDGSSCVVVPNKPQQQPTNACSGDGYFSAVNKACPEAEGGGFRPCVGSLWQCAELAVHVGSMTVFGKDTGKA

SEQ ID NO: 111517 - protein, 156 aa, Glycine max
  Coding DNA Sequence Number=SeqID_19832
  Homolog annotation: Hit_ID=A5B3Q0; Match level="QueryCoverage=49%, HitCoverage=7%, E-value=3e-08, Identity=33%"; Hit description =Putative uncharacterized protein
VGDDLWKLGRSYAKLPKLLGALQSCVPGTVVAAQTGSVTSRWYMALWEYGKYTGILLIDTAQDGANHIFPIAYAIVEGETTSAWGYAYTEKMHWRHLGDIRANKSSAAEWLDQLPKQKWETYFKTAQLFANRGRQTQAMINFGSQYSEVVFDAMNN

SEQ ID NO: 111518 - protein, 161 aa, Glycine max
  Coding DNA Sequence Number=SeqID_19833
  Homolog annotation: Hit_ID=UPI00006A2D9E; Match level="QueryCoverage =76%, HitCoverage=83%, E-value=4e-10, Identity=16%"; Hit description =UPI00006A2D9E related cluster
MPSPSKGYTPLPSEDYTSSPSEEYTSSPSEGYRSSPSKDYRSLAFRGLHVLTFKGLHVLTFRGLHVLAFRGLHILTFRGLHVLPFRGLHVLAFIGLHALAFRGLHVLTFRGLHVLAFIGLHALAFRGLHVFTFRGLHTLDFRGLHLFTLKGLHAPDLRGLH

SEQ ID NO: 111519 - protein, 125 aa, Glycine max
  Coding DNA Sequence Number=SeqID_19834
QGWTFSPWVKVYNKLGFWLKACRTAGHDICQGAGAVTSVTWLCFLPRNRASPSSPHPYGPPLHRRGILQAPPMPGVATYPSAGGRRETRGMRVPRKEYARSRHQRLFEENVGKTGKDAIYELFSE

SEQ ID NO: 111520 - protein, 142 aa, Glycine max
  Coding DNA Sequence Number=SeqID_19835
QARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPELMINLPQSFVKADIVLHDHLLPRTTH

SEQ ID NO: 111521 - protein, 98 aa, Glycine max
  Coding DNA Sequence Number=SeqID_19836
MKGPSATHTEHNYSNGDEVGSDDFTKQLSRVAIDEYGPAHEPKLFSGKRFQSQPNQGIAALRLPPPNPPTSSTSSTATATPPRTAPPSAAASSPTDKP

SEQ ID NO: 111522 - protein, 143 aa, Glycine max
  Coding DNA Sequence Number=SeqID_19837
  Homolog annotation: Hit_ID=A5BSR3; Match level="QueryCoverage=64%, HitCoverage=31%, E-value=3e-10, Identity=38%"; Hit description =Putative uncharacterized protein
MDEKTNKKLEEAGQSGSTEAMIDPPSPIRQHIKWKMARTKKTGQMTSEAAKQIADKIDSLKELTSQGSFVAHGRQDVLTATIGRPEHPGCVRAAGVNVTIKQYFGLTPRTSCTSSSMAPEGLEHLTQQIRDQLEESITEKVTR

SEQ ID NO: 111523 - protein, 58 aa, Glycine max
  Coding DNA Sequence Number=SeqID_19838
  Subcellular localization annotation: CTP_CleavageSite=21; ConfidenceScore=5.20e-01
MVLVVAIATTLTSIISFMLIMASIIVVICSFKASVSAFTCSCTSSTSPITLAWVRTWG

SEQ ID NO: 111524 - protein, 265 aa, Glycine max
  Coding DNA Sequence Number=SeqID_19839
EVERRNWHKELTNFSEGSIDVAIVKEFYANLYDPEDKSLKQVRVRGNLIKFDVDALNTILKTPVVIEEGESLPAYSRFANQRPVPEELAAHLCLPGRGFELNADGLPLKILRKNLTTLAQTWSVLSFSNLATTSHTSDITLDMAKLICGLVMKMDIKLGSLISGQISLIAQHDSSRLGFPALITALCKGTRKSRARGSEAPSTLALPTSSPSISAPSTSPLPPPPPAPILPEFARCGLAAASYECRGVSSGGGLAKSPAFSFGRG

SEQ ID NO: 111525 - protein, 214 aa, Glycine max
  Coding DNA Sequence Number=SeqID_19840
MAPRKLSAKRSRKDAAAEGTSAAPEFDSHRFRSTEHQQRFEAIKGWSFHRERRFQLRDDEYTYFQEEIARRRWTSLVTPMAKFDPDIVLEFYANAWPTEEGVRACGHGQFLGDPLVLEEGQECEFSQRRNRADGFDEEAIAQLLCIPGQDFARTAAERRVRIMRTSMTTLTQMWMTCCSATSRPADHNSDLFAEVSASVCHPDTDERPCGSVYR

SEQ ID NO: 111526 - protein, 49 aa, Glycine max
  Coding DNA Sequence Number=SeqID_19841
MTTMMEAMMSMRKMMEVNMAIVVAASITIEVDSTHPPGFNQVNHPASDM

SEQ ID NO: 111527 - protein, 63 aa, Glycine max
  Coding DNA Sequence Number=SeqID_19842
MDKSLKVGEDEWRERKRRSMKFCASNELWFSPLIQDQVQDSPLSVLRCMKHVKHEGHAQSATT

SEQ ID NO: 111528 - protein, 45 aa, Glycine max
  Coding DNA Sequence Number=SeqID_19843
MALGWWPQMTHPPHAEVPGLWDLHLPCEEKFGSQASFFFNVNSSN

SEQ ID NO: 111529 - protein, 15 aa, Glycine max
  Coding DNA Sequence Number=SeqID_19844
MGAEWQWQGVGSKIL

SEQ ID NO: 111530 - protein, 167 aa, Glycine max
  Coding DNA Sequence Number=SeqID_19845
  Gene Ontology: Mol. function=chloramphenicol O-acetyltransferase activity; Biological process=response to antibiotic
  Homolog annotation: Hit_ID=P62577; Match level="QueryCoverage=83%, HitCoverage=63%, E-value=3e-79, Identity=99%"; Hit description =Chloramphenicol acetyltransferase
  Pfam annotation: Domain name=CAT; Domain location=6-166; Score=225.5; E_value=1.2e-64; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGLIALQHIPLSPAGVIAKRPAPIALPNSCAA

SEQ ID NO: 111531 - protein, 123 aa, Glycine max
  Coding DNA Sequence Number=SeqID_19846
  Subcellular localization annotation: CTP_CleavageSite=74; ConfidenceScore=5.35e-01
MPISPCGSISWSVLSRHRDHTTKTPSGPREVPQGPGVSSSGYGPLSVLRSARTPQQGHVIPLSMHMVHKISVIYCAPRQAEDETPQQPGDGQQQATNAPPPPPEPLSSSTKRLEYCLRHIADK

SEQ ID NO: 111532 - protein, 159 aa, Glycine max
  Coding DNA Sequence Number=SeqID_19847
  Gene Ontology: Mol. function=zinc ion binding
  Homolog annotation: Hit_ID=A5APQ3; Match level="QueryCoverage=86%, HitCoverage=8%, E-value=7e-17, Identity=37%"; Hit description =Putative uncharacterized protein
  Pfam annotation: Domain name=DUF1723; Domain location=11-60; Score =53.4; E_value=7.8e-13; Accession=PF08330.1; Description=Protein of unknown function (DUF1723)
LSPLITCSVDTGDRGLLSSFVERWHRETSSFHLPVGELTITLDNVSSLLHLPVVGDLHAFQPLHVDDAVQMLVDLLMVSAESARAEITQYRGSYVRLQWALCDLSMTERYAWGVAALVHMYDQLNDASISHSQQLGGYITLLQCWIYEYFPSVADSTTD

SEQ ID NO: 111533 - protein, 84 aa, Glycine max
  Coding DNA Sequence Number=SeqID_19848
MDYENEEACGENEPHVDCSDAFNTSQVIMCLSVEMMFCGGLDPFLMKTDLWRKKEFIRRDTGIRKCGCPFKIRCKPVVGGEGWM

SEQ ID NO: 111534 - protein, 111 aa, Glycine max
  Coding DNA Sequence Number=SeqID_19849
MERSMIDAASGGALGDMTPDEVRNLIEKMASNSQQFSARNDAIVLRGVHEVATNSSSSPETKKLEGTTPGGGIILTLDGRILHNNNNNSNNNSPRNNKQLRPLRNLPLKNL

SEQ ID NO: 111535 - protein, 172 aa, Glycine max
  Coding DNA Sequence Number=SeqID_19850
  Homolog annotation: Hit_ID=Q5QJQ3; Match level="QueryCoverage=18%, HitCoverage=24%, E-value=3e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIVLSPT

SEQ ID NO: 111536 - protein, 225 aa, Glycine max
  Coding DNA Sequence Number=SeqID_19851
  Gene Ontology: Mol. function=pyruvate kinase activity; Cellular component=cytoplasm; Biological process=glycolysis
  Homolog annotation: Hit_ID=A9P7U5; Match level="QueryCoverage=91%, HitCoverage=36%, E-value=3e-89, Identity=82%"; Hit description =Putative uncharacterized protein
  Pfam annotation: Domain name=PK_C; Domain location=92-222; Score =121.3; E_value=2.8e-33; Accession=PF02887.7; Description=Pyruvate kinase, alphabeta domain
MSNPSEQYWQAVKRILRYLNATLTLGLSDAIVLGAETLRGLYPVETISTVGKICAEADIFITRCSLQAEKVYNQDLYFKKAVKFVGEPMTHLESIASSAVRAAIKVKASVIICFTSSGRAARLIAKYRPTMPVISVVIPQLKTNQLRWTFTGAFEARQSLIVRGLFPMLADPRHPAESKSATNESILKVALDHGKAFGIIKAHDRVVVCQKVGDSSVVKIIELDE

SEQ ID NO: 111537 - protein, 71 aa, Glycine max
  Coding DNA Sequence Number=SeqID_19852
  Subcellular localization annotation: CTP_CleavageSite=26; ConfidenceScore=5.14e-01
TYQGNPCGVYPDLSSFTGSGVYPDLSSFTGSGVYPDLSSFTGSGVIQTFVACIKRSAPTQVHIIWYQSFGS

SEQ ID NO: 111538 - protein, 143 aa, Glycine max
  Coding DNA Sequence Number=SeqID_19853
MWLRLDDSSTSRCRQHAWSLVAETKVTNVCVISGNHTTWKPAPRWKSYFNGSWTGGSSKNVTGSGSKYPPIVPKPTSFSYQSNKVVPWKYTPPAFGERVATEVDSLSAKVTNITGLSGVTRSGRVFAPPHSAELPSKGKAPMI

SEQ ID NO: 111539 - protein, 185 aa, Glycine max
  Coding DNA Sequence Number=SeqID_19854
MPISPCRWIAPTRRPVDPKKSNRALGFPALVTGLCQSYKVPVTPARSCHRDIGIAPTRHPVDPKKSNRALGFPSLESHPQRHPVDPEKSNRALGFPALVVGLCSPTGCPFPPARSRHRDIGIAPVRHPVDPEKSNRALGFPTLITGLCLFYRVSIAPSMVIRPPTNRAFIKKYCVPRQAQGETPQ

SEQ ID NO: 111540 - protein, 130 aa, Glycine max
  Coding DNA Sequence Number=SeqID_19855
MPSKVILMMPKNQELSKVSRTKFQVSRFKIQESRFKNNQDQDSRLKIQESRRRLNQDNTRSFHKIITKEFYSLVIDYRKVVSYPNFVRGLLLDGMQPLIDRFEVLSTLCCTICEVPRRVRNQKKAWLRDP

SEQ ID NO: 111541 - protein, 56 aa, Glycine max
  Coding DNA Sequence Number=SeqID_19856
MKFGGAVPFLIPMTRGGGHNPLFEDSPSESGSGAGTVRYGLISNDTREARCKCMAV

SEQ ID NO: 111542 - protein, 107 aa, Glycine max
  Coding DNA Sequence Number=SeqID_19857
MCSMSRTCHLEVEYISLSLNVRYKGFNLLRKGLKNNLESIFLKKKNSLFAKRKPRAKRIFGHALSRESQALSAQPLHLRLIWSTKLAKAELSQLQFDLDLAKRKPNR

SEQ ID NO: 111543 - protein, 159 aa, Glycine max
  Coding DNA Sequence Number=SeqID_19858
MDMNIGALISALITSLCRARGVTSDSLTYESLSLAINLAYIKKNYWNVDDLIVNFRGARKPRVRPADVPSSSTLPAPSTSATPTPAPPDSSTQDSQHFEFMLQSLHKGQILLMQSLQVVAPLGSILTMEQFLERVSWPGTLPSLERKGGGLSAQLPQQV

SEQ ID NO: 111544 - protein, 57 aa, Glycine max
  Coding DNA Sequence Number=SeqID_19859
  Homolog annotation: Hit_ID=A7Q1X7; Match level="QueryCoverage=94%, HitCoverage=13%, E-value=3e-13, Identity=49%"; Hit description =Chromosome chr13 scaffold_45, whole genome shotgun sequence
MLLVRDCLGNVSDGPLEFKYSLTIIHACKSNVAEKHGTIEEARKVFSNLRERNLGIL

SEQ ID NO: 111545 - protein, 58 aa, Glycine max
  Coding DNA Sequence Number=SeqID_19860
MALGFDGLQTYVGERFDALEQQVDMRFDEMDSRITKVEGDVTFIRTYFDLPPPPPPSS

SEQ ID NO: 111546 - protein, 65 aa, Glycine max
  Coding DNA Sequence Number=SeqID_19861
MERSMIDAASGGALGDMTPAEAKNLIEKMAPSASSETKKLEGKLDALVNLVTQLALNQKSVPVAR

SEQ ID NO: 111547 - protein, 26 aa, Glycine max
  Coding DNA Sequence Number=SeqID_19862
MNKKVKWWLDRNIEMAITQATGLQMR

SEQ ID NO: 111548 - protein, 139 aa, Glycine max
  Coding DNA Sequence Number=SeqID_19863
IIIIVTKEKDHALRHPYQTRAKAIIMSEIEEVQEQVKADMEAMKEQMTTMTEAMMSTRKMKEDNTTTVVAASTATEMDPIHSAGQGGEAAKNACGPHHVQVQSKHFFPPYGLPPNYTPPTVVYAFGENISNSTPVLIEN

SEQ ID NO: 111549 - protein, 210 aa, Glycine max
  Coding DNA Sequence Number=SeqID_19864
VDSRGSPLIKILQDQALPHNERIPEHKGWVVPVWFRLCNGFYKDSGNLKPQGPTEAYSTSAAPHLASTSAAPPPARIVAAPSTLPPADFQCFEAMIQSIHQGQIILLQSLQLVPHQPADESSESSTPEPLIRKRRVELTQEAANTPKKSPKESFNGGFPPWRCSGRQRRRGERRCHPLGNKPWKKELHHQDEPWIRSLEGCFNGGKERGR

SEQ ID NO: 111550 - protein, 58 aa, Glycine max
  Coding DNA Sequence Number=SeqID_19865
MTTLCKSRRRVSKGNNCQFCEIETFPKELPKVDSLHSCTISPNEKFIFMGYEVKAPGK

SEQ ID NO: 111551 - protein, 204 aa, Glycine max
  Coding DNA Sequence Number=SeqID_19866
  Homolog annotation: Hit_ID=A5B5G7; Match level="QueryCoverage=94%, HitCoverage=13%, E-value=6e-09, Identity=27%"; Hit description =Putative uncharacterized protein
KRKTPSTSAQAIFDRSRFTSQEAWERYTDIVVPRKIFPERNVILHYIEFDEFTEELEHRNWHKELKNFADGSIDVAIVKEFYGNLYDPEDKPKQVRVRGRLVKFDADTLNSFLKTLVILEEGENFPVYSRFCRSKPEPQEMAARLCIPRRGFELNADGLPLKILRKNLIMLAQTWSILSFSNLVPTSHTSNITLDRARLIYGII

SEQ ID NO: 111552 - protein, 332 aa, Glycine max
  Coding DNA Sequence Number=SeqID_19867
  Homolog annotation: Hit_ID=A5B5G7; Match level="QueryCoverage=66%, HitCoverage=15%, E-value=3e-09, Identity=24%"; Hit description =Putative uncharacterized protein
MAELSQIQLGLNWAKLEPFAKRMTSRKRKSTASRPQAQYDTRRFQSLEAWNRYTDNILDQRILPKRNVKIYHTKFDEFKAELERLNLHKRLANLQEGSIDVAEVKEFYANLYSLEDQSPKQVRVRGHLIRIDADSLNTFLETPVVLEEGETLPTYSRFTRMRIDPQEFVAPLCIPGRGFVLNAEGHPWKLLRKDLTTLAHTWSVLSYYNLTHTSHTSDLSMDRAKLVYSLVTGMDMNIRALISGQISIIAQSNSSRLGFPALVTALCRASGVTSGNVPSSSAPPAPPTSATPTLAAYDSQHFEAMLQRSILSVEQFIEKVSWPGTLLSTVGE

SEQ ID NO: 111553 - protein, 456 aa, Glycine max
  Coding DNA Sequence Number=SeqID_19868
  Homolog annotation: Hit_ID=Q2HSV3; Match level="QueryCoverage=74%, HitCoverage=68%, E-value=1e-11, Identity=33%"; Hit description=IMP dehydrogenase/GMP reductase, putative
MVKTRGLGHALGRVVARGLGRGEGDDSNGVPQQRRPTASARRRRVPIIVDDVVPALGMSPETNAQDIGAQDAADEPEGFPGGPRDPSVLTEYADHVAASVWSEQEHLELKLSSHGRKVHNLGRPVLAIEDMVAGTGLSPLIVCSIDTGNRGLISSFVERWHRETSSFHLPVVEQRWPWSRQANVVDHMYACSSCETYTSANVRCSTRQLSLVLIFYIFWVALFLLIGVQPMFMSHTYRPCVTSLLLGDMHGELLASPICTINLMMPVSAPANSLLEHFPSVAECNADPDYDERLDRLRILDVCWMSHAKHRPVQDFHPISCFSGQIRWGPVVVRYRPKRVMRQFGYVQCIPAHPVHSWVSYDDMGDTWTHYSDHLAIAGDLCVVPGQCAPNYIDWFFVISHPFMTAPLTNPPRDAYATQPSHIPHEATPASTHADLDADEPRHAVEACHAIVDALE

SEQ ID NO: 111554 - protein, 202 aa, Glycine max
  Coding DNA Sequence Number=SeqID_19869
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTPLSREGDADADDDYVVDIMVAQRALDPWPAQDGDPLESPAGMQAWHWPSFYNVVTGKTLALPNLIALQHIPLSPAGVIAKRPAPIALPNSCAA

SEQ ID NO: 111555 - protein, 175 aa, Glycine max
  Coding DNA Sequence Number=SeqID_19870
  Homolog annotation: Hit_ID=A6NQ44; Match level="QueryCoverage=19%, HitCoverage=35%, E-value=3e-12, Identity=100%"; Hit description =Putative uncharacterized protein
ELPTSFSEGNWLQQSADTKYCSSSVAVVRPPLQELCSTATYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 111556 - protein, 138 aa, Glycine max
  Coding DNA Sequence Number=SeqID_19871
MGETDEVQERIKADLEATKEQMGTMIEAMMSMKKIMKVNAAAVSATSVVVEVDWTPTSGLNQINHAISDMVGQKGKELGSTSGPHFVQVQNKHSIPPYGLAPNHTLPNVAHTPNEDVNNPAPIPIESQQPQADHAHVS

SEQ ID NO: 111557 - protein, 123 aa, Glycine max
  Coding DNA Sequence Number=SeqID_19872
TSPSGRVTGFAGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSHKEGSSKAT

SEQ ID NO: 111558 - protein, 92 aa, Glycine max
  Coding DNA Sequence Number=SeqID_19873
  Homolog annotation: Hit_ID=A7QMW5; Match level="QueryCoverage=47%, HitCoverage=8%, E-value=8e-10, Identity=72%"; Hit description =Chromosome chr14 scaffold_128, whole genome shotgun sequence
MEVVTDAASLDLELLQLPEFSGLALKSNLNFIEKLFDQWLSLPEVIDCCINESANARGEAVCVLGALPLPRSLTRCARSFGCGERYQLTQRR

SEQ ID NO: 111559 - protein, 124 aa, Glycine max
  Coding DNA Sequence Number=SeqID_19874
PPAAAEGPPHNEVSLFLEEGPPPFFQTANAVQDPLHGCSHKRWIDGRQVLPKGSQDGAILTRQLESGSVQTHVIRIRLRTRRASSYPDNSSFTGFYLSFTGLICTQLHDGTPLGQSSLDSSSVL

SEQ ID NO: 111560 - protein, 176 aa, Glycine max
  Coding DNA Sequence Number=SeqID_19875
  Homolog annotation: Hit_ID=A6N073; Match level="QueryCoverage=17%, HitCoverage=76%, E-value=7e-08, Identity=90%"; Hit description =Putative uncharacterized protein
LQWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGVRLWSMEQCRQGKSAKWIRNLGKRIGSEGWARGSQSRTRRLSVTARAASAARAGRRVP

SEQ ID NO: 111561 - protein, 123 aa, Glycine max
  Coding DNA Sequence Number=SeqID_19876
VMWDATVFGVFNDNFHLYIKHEDLFEIAHSDQCLNISIIQLWILHMTKTSMQVGNADVYGFLEPHSIQRFGQSQFESESYIKNLMQNSKRDVYLRAYLNGALKGLDDTPQSKSKVATRWIVVK

SEQ ID NO: 111562 - protein, 135 aa, Glycine max
  Coding DNA Sequence Number=SeqID_19877
  Homolog annotation: Hit_ID=Q9KHC4; Match level="QueryCoverage=32%, HitCoverage=9%, E-value=1e-07, Identity=68%"; Hit description=SocE
MAESTHSKTNLERMEEVIAELASNQLHITTKLNELIQRITVLETNQQQSASPSSSSTNPSHIAPSSQLPRMKLEVPRFDGTDPSGRETCRASCINESANARGEAVCVLGALPLPRSLTRCARSFGCGERYQLTQR

SEQ ID NO: 111563 - protein, 34 aa, Glycine max
  Coding DNA Sequence Number=SeqID_19878
MQPMKSTDRKMQGSCMSEHENRRCTRNMLDADAR

SEQ ID NO: 111564 - protein, 235 aa, Glycine max
  Coding DNA Sequence Number=SeqID_19879
  Homolog annotation: Hit_ID=Q5XM22; Match level="QueryCoverage=49%, HitCoverage=89%, E-value=2e-21, Identity=42%"; Hit description =Resistance-like protein HAAS-2
MVRTRGLSHALGQVTGRGVGRGDRDDSDDAPQRRRPTASARRQRVAVTADHIDESVIPVPDVQDDLMEALAAVEDIPADDAVQMLVDLLMVSPESARAETVQCRGPYVRLQWAGHWTAAARAYLLHLLGCTLFANKSATNVHVVYLEALRDLSMTERYAWGVAALVHMYDQLNDASMSHSRQLGGYITLLQHFPSVAESTADQDYDEASPRACRWIAMKKTVKSIRTPSYRERLD

SEQ ID NO: 111565 - protein, 140 aa, Glycine max
  Coding DNA Sequence Number=SeqID_19880
  Homolog annotation: Hit_ID=Q6UUU1; Match level="QueryCoverage=42%, HitCoverage=40%, E-value=1e-18, Identity=78%"; Hit description =Putative uncharacterized protein
ELTPYNQYEEERVRDLDNKIIKGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 111566 - protein, 101 aa, Glycine max
  Coding DNA Sequence Number=SeqID_19881
  Subcellular localization annotation: CTP_CleavageSite=63; ConfidenceScore=5.73e-01
VPSCSATDGVVRNGKSTRRTSALASVAVTLRVTTTPAALNAPLQGASHSPFRLRNCWEGRSVRASSLLRQLAKGGCAARRLSWVTPVFSQSRRCKTTASEL

SEQ ID NO: 111567 - protein, 233 aa, Glycine max
  Coding DNA Sequence Number=SeqID_19882
  Gene Ontology: Mol. function=siderophore-iron transmembrane transporter activity; Cellular component=cell outer membrane; Biological process=siderophore transport
  Homolog annotation: Hit_ID=A1ZVY3; Match level="QueryCoverage=93%, HitCoverage=30%, E-value=6e-79, Identity=61%"; Hit description =Ferrichrome-iron receptor
  Pfam annotation: Domain name=Plug; Domain location=43-140; Score =53.7; E_value=6.2e-13; Accession=PF07715.6; Description=TonB -dependent Receptor Plug Domain
VIHAQKIKKDSIPVTIQTVEITGRKSKDYISDYSFAATKIAMKNKDLPLTLNTVTKELINDRQAFRLGDVLKNVAGVSNVSFYNQYSIRGISQNEEGQIINGMRTRQYYFLQPMTPHIERVEVFKGPASITMSSVDPGGTINMVTKKPLANSRYEVSLSGGSFDTYRLSADVTGPLNTTPSISFIPNDRTSVNVEMIYNEMNGNLDRGQPIFGAVAGKTDLNSTPVSLNLGAP

SEQ ID NO: 111568 - protein, 229 aa, Glycine max
  Coding DNA Sequence Number=SeqID_19883
MRSDCLVQFSILNPFSEPMNCVFVHESSTFEFGAMRSDCLVQFSILILFRSPMNCVFVHVSSSFEFGALRSDCLVQFSILNPFSKPMNCVFIHVSSTFEFGAMRSDCLVQFSILNLFRSPMNFIFVHVSSTYEFGAMRSDCLVQFSILNLFRSPMNCVFVHVSSTFEFGAMRSDCLVQFSILNLFRSPMNCVFVHVSSSFEFGATRSDCLVQFSILNPFSKPMNCVFIH

SEQ ID NO: 111569 - protein, 148 aa, Glycine max
  Coding DNA Sequence Number=SeqID_19884
MAPKKISTKRSRRDAAAEGFSATPEFDSHHFRSAEHQQRFEAIKGWSFHRESHVQLREDEYTYVQEEIAHRHWTSLVTPTAKFDPEIVLEFYANAWPTEEKASNVSSARGGTGPMGLTRRPLPSCYAHWGRISPGPLQGGGCGSCAPA

SEQ ID NO: 111570 - protein, 113 aa, Glycine max
  Coding DNA Sequence Number=SeqID_19885
MDRRPQEVNISLPYFHGKDNVEAYLDWEMKGTALAPTYPQAKGHFGAIAARPGELNLIPEVISSPRKSAKNTNMGELINLGVVLSPGSIRNVLEETTARLGEHIASGGSYELA

SEQ ID NO: 111571 - protein, 52 aa, Glycine max
  Coding DNA Sequence Number=SeqID_19886
MAGTMSDDESCEGTNIEDPTVDFEREADRLEDEEDKDMGFSPELERMVAQED

SEQ ID NO: 111572 - protein, 215 aa, Glycine max
  Coding DNA Sequence Number=SeqID_19887
  Gene Ontology: Mol. function=glutamate-ammonia ligase activity; Cellular component=cytoplasm; Biological process=nitrogen compound metabolic process
  Homolog annotation: Hit_ID=UPI0000ECBAF8; Match level="QueryCoverage =19%, HitCoverage=48%, E-value=3e-16, Identity=100%"; Hit description= UPI0000ECBAF8 related cluster
MRKRHASRREKGGQVSGKRQGRNRRAHEGASRGKRLGGGAYGKTPATRPFYGSWPFAGLLLTCSFLRYPLILWITVLPPLSELIPLAAAERPSAASHWHDRFPDWKAGSERNAINGPYYCGIGANKAFGRDIVDSHFKACLYADINITGINAEVMPGQSRPAGMQAWHWPSFYNVVTGKTLALPNLIALQHIPLSPAGVIAKRPAPIALPNSCAA

SEQ ID NO: 111573 - protein, 99 aa, Glycine max
  Coding DNA Sequence Number=SeqID_19888
MHKALRANAPLPYPHLVTLFLHHFNIPLDDEPYVKVKWSFSIGAGAVTSFHYRKDVDGQWVRKQDLPPPIPDERTPSPPAQRNDSTSLLTEVLTELCIL

SEQ ID NO: 111574 - protein, 79 aa, Glycine max
  Coding DNA Sequence Number=SeqID_19889
MMLIGLVVQTQENLLLDGSLDSLKHNQLRCMLTTPVPYRLQQIQFTMNGLNILRLTITLFAMPMIEESSVYHTSQLPFK

SEQ ID NO: 111575 - protein, 171 aa, Glycine max
  Coding DNA Sequence Number=SeqID_19890
LELQHSISSVPDILRDSIGHPSKKLLSFELAQSLTFNFERFVILRDSIKHTSKKLLSFEFAKRFNIQFRASRYISGTDSDIRGKKVKHAISSVSICYRTQSDIREKGYCRLNWLRASTFNFERLDILRDSIRHPSKKLLSFELAHKFNIQFRASRYITGLNQTSEEKVIVS

SEQ ID NO: 111576 - protein, 105 aa, Glycine max
  Coding DNA Sequence Number=SeqID_19891
MVTIISKYQEKLNLAMAHEHKVADEYARVYAEKEARGRVIDSLHQEATMWMDRFALTLNGSQELPRLLAKAKAMADTYSAPEEIHGLLHYCQHMIDLMAYIIRSR

SEQ ID NO: 111577 - protein, 59 aa, Glycine max
  Coding DNA Sequence Number=SeqID_19892
  Gene Ontology: Mol. function=transferase activity; Cellular component= transcription factor complex; Biological process=positive regulation of transcription, DNA-dependent
  Homolog annotation: Hit_ID=A2WSM9; Match level="QueryCoverage=88%, HitCoverage=5%, E-value=2e-17, Identity=80%"; Hit description =Putative uncharacterized protein
  Pfam annotation: Domain name=TPR_1; Domain location=8-41; Score=30.3; E_value=7e-06; Accession=PF00515.19; Description=Tetratricopeptide repeat
  Pfam annotation: Domain name=TPR_2; Domain location=8-41; Score=31.6; E_value=2.9e-06; Accession=PF07719.8; Description=Tetratricopeptide repeat
  Pfam module annotation: Pfam domain module=TPR_1::TPR_2; Domain location=8-41::8-41
MENDLKSHVCCNVYGLLYLSEREYREAIKCYRNALRIDPDNIEIVSDLSHLKVASLMHL

SEQ ID NO: 111578 - protein, 79 aa, Glycine max
  Coding DNA Sequence Number=SeqID_19893
  Subcellular localization annotation: CTP_CleavageSite=70; ConfidenceScore=5.33e-01
MGYMGIGMTRDGNWVKEEKGKRKRKVFVSPNPAVGSSSNSLRRRRLPPPLLCVFSSLHRRLLLFPPLRAVVAVFSSIIP

SEQ ID NO: 111579 - protein, 107 aa, Glycine max
  Coding DNA Sequence Number=SeqID_19894
  Homolog annotation: Hit_ID=A6FJQ2; Match level="QueryCoverage=35%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLSTLEDPHAKRKKEIPEGECVVAEKEKCESEKEEVNVAMEAEIYPTGTTAI

SEQ ID NO: 111580 - protein, 42 aa, Glycine max
  Coding DNA Sequence Number=SeqID_19895
MYLLGGIDRYEDLKHSLLVDGLSMVTMNKWMNNRYGLCDCIK

SEQ ID NO: 111581 - protein, 53 aa, Glycine max
  Coding DNA Sequence Number=SeqID_19896
MMMQSYLARALDRKLQVDWARDAREGPRVLMSLRVGYPRNIGFFSPCISGHLD

SEQ ID NO: 111582 - protein, 58 aa, Glycine max
  Coding DNA Sequence Number=SeqID_19897
MAMIISMHTIAINLQEIQSKSTDHSLTGLGLQVALFAFNFSCKTHYTSQSSKINGFHF

SEQ ID NO: 111583 - protein, 124 aa, Glycine max
  Coding DNA Sequence Number=SeqID_19898
MYNYHEKGRAPDLKSVLADFMTYQASSKEIEAHQESILQDTTIHHQLVNKEEQDEVSSTPEYPCMATTGYVVGKDKGHLELSVEDQKISFDLFEAMKHSDTGDAYVEEEEVDHEIALSASTMVL

SEQ ID NO: 111584 - protein, 129 aa, Glycine max
  Coding DNA Sequence Number=SeqID_19899
MIMRGQDIYSSQDEATTSPSSSESEEAKGEESSEEIYPQEEGQPLMVREECKEVSVSSNRLAKKESVEGRSLELQEPLDLRSNPFQGGGNDEILPPKGIDRRLQEDWARDARESLRVLMSLKVDFGPMG

SEQ ID NO: 111585 - protein, 106 aa, Glycine max
  Coding DNA Sequence Number=SeqID_19900
MLVSFPSSAPYVEAAEESLETTFQSFEVVTCTSVETSPLLPCLSNAALMVARVMLRHGYEPGTNVQIWVGVDKSETLAPTYPPSKRKSDLRSSFLRVNQGFFLLGR

SEQ ID NO: 111586 - protein, 138 aa, Glycine max
  Coding DNA Sequence Number=SeqID_19901
  Gene Ontology: Mol. function=2-oxoglutarate decarboxylase activity; Cellular component=chloroplast; Biological process=menaquinone biosynthetic process
  Homolog annotation: Hit_ID=A7PNB6; Match level="QueryCoverage=76%, HitCoverage=17%, E-value=1e-36, Identity=68%"; Hit description =Chromosome chr1 scaffold_22, whole genome shotgun sequence
MITWHRVRCISDLICDPSRCYARVLLDHANELSNSLKESANINTVWASLIVEECTRLGLMYLCIAPGSRPSPVAVAVASHKLITCISCFDERSLAYHAVGYGRGSHIPAVAITSSGTAVSNLLPAGDQNCGLSIIGDQ

SEQ ID NO: 111587 - protein, 122 aa, Glycine max
  Coding DNA Sequence Number=SeqID_19902
MLPQHAPHQLVQNCHVQDERSPRHRRHKYVRVHEALFDLSKCLLTVLVPVDGLVLVLGDHVVYVDFDLSVHHVVEQSHHSPLIGRPGVLEPKGHHLIAERSPQGDGRGLFHILWRHLYLIVA

SEQ ID NO: 111588 - protein, 102 aa, Glycine max
  Coding DNA Sequence Number=SeqID_19903
MAKARQKSKIGEKLAAQLAQASKVASSRSNSLLEGPSGPGCYLHPPLSKKLRKLTDCAKTPLFDFRHITEFHESRKPASFRFLRRLGTSFIACHLVIIPGQN

SEQ ID NO: 111589 - protein, 77 aa, Glycine max
  Coding DNA Sequence Number=SeqID_19904
  Subcellular localization annotation: CTP_CleavageSite=10; ConfidenceScore=5.03e-01
MAMNTLSVSCCAKRMNSLSRPYPAKKRKATASRPQPHYDTHRFTSEWNRYADNILSRNILPERSMKLFVTEFDEFRT

SEQ ID NO: 111590 - protein, 87 aa, Glycine max
  Coding DNA Sequence Number=SeqID_19905
MSSRAQRVISSFSEKIVSSVLSARMALSQISLTHAKRAFMDKKSFLSLNCKEWKREAKFIKRHLRTKFNLNLAKLARHRCLVFVPSA

SEQ ID NO: 111591 - protein, 102 aa, Glycine max
  Coding DNA Sequence Number=SeqID_19906
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=73%, HitCoverage=10%, E-value=2e-35, Identity=98%"; Hit description=DNA -directed RNA polymerase subunit beta'
MVLCLLPVLPPELRPIIQIDGGKLMSSDINELYRRVIYRNNTLIDLLTTSRSTPGELVMCQEKLVQEAVDTLLDNGIRGQPMRDGHNKVHHFHYIDVDCPAK

SEQ ID NO: 111592 - protein, 163 aa, Glycine max
  Coding DNA Sequence Number=SeqID_19907
  Homolog annotation: Hit_ID=A5FD50; Match level="QueryCoverage=64%, HitCoverage=29%, E-value=1e-12, Identity=32%"; Hit description =Peptidase S41 precursor
VTAPVYLELYKPGSTDPYFGSQTIRVKIKQDIGANMIVLQEKAEGGTVQIIGDIDIADYLSAVIVSCRSEEESVPDFPDGSVESVNVWVHENMKRYYFWEDQMPAKPDYHLPVKKFFASLLSQNDLLQLANGQITAVIKLVLQDSPAQNAGLKRGMIIKKING

SEQ ID NO: 111593 - protein, 86 aa, Glycine max
  Coding DNA Sequence Number=SeqID_19908
MENGTKQSLRIAPNSKVEEMNENAFHGAPKRWRLENCTKQSLRIAPNSKVEEMNENAFHGALKRWRMENCTKQSLHIAPNSKVEDT

SEQ ID NO: 111594 - protein, 133 aa, Glycine max
  Coding DNA Sequence Number=SeqID_19909
MSHHSSSVNGEGTSHKDPLSRILDELSSLKLWKEKQERKEKGKKRVEEISQDKREKIREEERRKIMKEMKREKHAFYSSHDSCKSLSEELSDYFRGRHSSHTKHHSQKREKHRRPQEVNISLPYFHGKDNVEA

SEQ ID NO: 111595 - protein, 59 aa, Glycine max
  Coding DNA Sequence Number=SeqID_19910
MPGLGRDWSSLVLGNSTPPDVPKDYGVPITCGTRWRSGDGAQQVFHIHNDAILPPKGIG

SEQ ID NO: 111596 - protein, 50 aa, Glycine max
  Coding DNA Sequence Number=SeqID_19911
MCARSWLWSAENTGSTSYKVVAECANVMNEMVSDDEGEMMGAAGVTNLEE

SEQ ID NO: 111597 - protein, 318 aa, Glycine max
  Coding DNA Sequence Number=SeqID_19912
MLAIIAKYQEELSLATAHEHRVADEYAQVYAEKEARGRVIDSLHQEATMWMDRFALTLNGSQELPRLLAKAKAMADTYSAPEEIHGLLGYWKNTITKRATRHPYRTRSKSRTMGDQEETQEQMKADMSALKEQMASMMEAMLGMRQLKEKNAATAATVSSAAEADPTLLATAHHPPSNIVGRGRDTLGHDGSPHLGYNRAVYPYGLPANYSPPVLQDDAGHIASPVLEREPPQQPEEVHKDPQDYARRDVEFYPPIPEGPAPSTLPQPNIATQPIVLSTEGPSPATEERRKLDLLEERLRAVEGFGDYPFADMTDLCL

SEQ ID NO: 111598 - protein, 98 aa, Glycine max
  Coding DNA Sequence Number=SeqID_19913
AGAVTSFGYCKDRNGQWLKKDALPPQDERTPSPPPQRDDSALMTEVLSELRGLHTYVGERFDSLDNRFAGMDIRLTQLEEDVGYIRQSFNLPPPPPPS

SEQ ID NO: 111599 - protein, 82 aa, Glycine max
  Coding DNA Sequence Number=SeqID_19914
  Homolog annotation: Hit_ID=Q5M9T0; Match level="QueryCoverage=65%, HitCoverage=53%, E-value=2e-07, Identity=62%"; Hit description =Putative uncharacterized protein orf103d
MVQRLFIVLAREPKHACYLLYWTFDQAFYPCRIGTNHHCIALEQLSGRRPATSVPYTDIDSFFVPGPTSQPFAGWSEVSLVW

SEQ ID NO: 111600 - protein, 60 aa, Glycine max
  Coding DNA Sequence Number=SeqID_19915
MTLQLADCFITRPYGVIEDVLVRVKHFIFSADFVVMGICEDNDIHVMEVGKEVLEVRTKM

SEQ ID NO: 111601 - protein, 188 aa, Glycine max
  Coding DNA Sequence Number=SeqID_19916
MEGERPYKREVSFPTVGIKRILVCCIPDELHSMETCLAVEELLQRMIDQGRLEFVDERSFGRPKPLVIYFTKGAASQKPRHPLAAKPVPFPCQNSHAVPWRYTPPNKKEEEATDISSLSAKVTNITGLSGVTRSGRVFAPPDLPIQPTNVKGKEKVVEEQDDKTPLTPNEDIPVKGLPEKRDGYGKKK

SEQ ID NO: 111602 - protein, 174 aa, Glycine max
  Coding DNA Sequence Number=SeqID_19917
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
  Pfam annotation: Domain name=DUF1723; Domain location=12-61; Score =42.7; E_value=1.3e-09; Accession=PF08330.1; Description=Protein of unknown function (DUF1723)
GLSPLITCFLDTGDRGLMYAFVERWHKETSSFHLPVEEVIITLDDVASLLHLPVVGAFHSFELLHVDDAGEMLVELLEVSAAEARAETIQCHDSYVRLLWLRDVYELKIEACDWIIAVRPAGMQAWHWPSFYNVVTGKTLALPNLIALQHIPLSPAGVIAKRPAPIALPNSCAA

SEQ ID NO: 111603 - protein, 259 aa, Glycine max
  Coding DNA Sequence Number=SeqID_19918
MSNHKSTESALKNLKVQVGQLAKQIADKSSNIFVANIEKNPMEECEAMLTRTKRFVEDKDEESVVHKKKVAEKKGTDGKKNNVRGESNQEKEKQIMVKKKEFNDQEKENEVEKEKENKKIEKDEKNEKEEKSRSDKVYHNGHIVDNPVQGLVYTCAKPIFIYGRARYILAQLLDNDDLRGTMEIILQNPQLNSAKFYAIIELIPQPQPSSPQPSCPQLQLPLPQQLPYNNQDLNKPVSSYKNLEKQDPFDIYSSYMMQS

SEQ ID NO: 111604 - protein, 128 aa, Glycine max
  Coding DNA Sequence Number=SeqID_19919
MGSKIYPKVHENPKAFFINSSPILLEPLTHGSGNWSFPKEDCITFDMGEEAEETQVRQVAAAIPERSLEATLEPSAPVVNLPSPQPAADPSTPLLQIPEDPTTPVLAVDTSPPTTPVLQLTDEEDGQT

SEQ ID NO: 111605 - protein, 68 aa, Glycine max
  Coding DNA Sequence Number=SeqID_19920
  Subcellular localization annotation: CTP_CleavageSite=26; ConfidenceScore=5.01e-01
MHYRADRGVDFVADLGVTFVDDWAFLASRVANGKFGHARMAATTWVSPSFLFPPFSPGLISPEFIKAA

SEQ ID NO: 111606 - protein, 181 aa, Glycine max
  Coding DNA Sequence Number=SeqID_19921
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=65%, E-value=4e-33, Identity=100%"; Hit description=LacZ protein
  Subcellular localization annotation: CTP_CleavageSite=57; ConfidenceScore=5.27e-01
MTMITNSSSVPYTSLIKQKEKKTNFKSKMRSFPLFHNNYNIRVRPDAILSPRALDRRLQEDWVKDAREGPRVLMSLRVDFRPMDYGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 111607 - protein, 47 aa, Glycine max
  Coding DNA Sequence Number=SeqID_19922
WCLQSSFFLIHSNAIDLQEAKDSIDEEDPRPTSSTWSYTMWYQSIFI

SEQ ID NO: 111608 - protein, 118 aa, Glycine max
  Coding DNA Sequence Number=SeqID_19923
MRDLRMKLRRSTASDLIPIDLEINATCRRHNSERIRIFLQDLETAATPEEEPRSSKASSSFPIAGHSHIEPVEDPIMAEEPRRVTLEDYSSSTVPQFFTSIAQPEVQAQTITYSPSLI

SEQ ID NO: 111609 - protein, 135 aa, Glycine max
  Coding DNA Sequence Number=SeqID_19924
  Subcellular localization annotation: CTP_CleavageSite=57; ConfidenceScore=5.30e-01
MDLCSLAKCVVATRLAHKSFFLRHVKRVTCAKRLMASRMRKAITLVSQTGYDRSRFVSQEAWDRYSDNVFARNILPKGNVKLYIAEFDDFRREWIRRNWHKQLTILTEGSIDVAIVKEIYANLYVPEDKFPKQVR

SEQ ID NO: 111610 - protein, 103 aa, Glycine max
  Coding DNA Sequence Number=SeqID_19925
METISKRFKEFDVCGKVILKSKLREIAYPDLNSMCHPLEKVNTKVKRSTTSSSDQAIPRRTMPMLDQFHPYIHDSIENIVDVKTNDNCGYRAIVALVGMGEDS

SEQ ID NO: 111611 - protein, 62 aa, Glycine max
  Coding DNA Sequence Number=SeqID_19926
MNHKGIPSFVFSDYNQEVIPTSCNEPQGSVCNQEDLLLKIVTKSRSLEKLFVRMEEERKKIE

SEQ ID NO: 111612 - protein, 77 aa, Glycine max
  Coding DNA Sequence Number=SeqID_19927
  Subcellular localization annotation: CTP_CleavageSite=48; ConfidenceScore=5.20e-01
MVLRQSSQAVSPLKLWGKQKNSQAEKGMKKMNSTSFVFKVWKTRKLKKAFAKEEEEEDVQRDSKVVKDCNNCYESIE

SEQ ID NO: 111613 - protein, 198 aa, Glycine max
  Coding DNA Sequence Number=SeqID_19928
  Homolog annotation: Hit_ID=Q949K7; Match level="QueryCoverage=20%, HitCoverage=45%, E-value=9e-08, Identity=62%"; Hit description =Putative gag polyprotein
  Subcellular localization annotation: CTP_CleavageSite=32; ConfidenceScore=5.24e-01
MEANAVIVAATSAVAKVNLMLPSGLKQMNHPTSNMVGKYLGSTDDPMMCKFKTSTPSRHMACLPNYTPPNVAYIPNEDVNNSTPILIKSQQPQSDHAHVSRPMEETHGMPHHNLADFEPYLGYATEGQAVGEERLRAIEGGKDYAFANLEELFLVPNIVTPPKFKVLDFDKYKGTTCPKNHPKMYCRKIRAYAKMRNC

SEQ ID NO: 111614 - protein, 143 aa, Glycine max
  Coding DNA Sequence Number=SeqID_19929
MVKEECKEVSVSSKRLAKKESHFEIKTNIKETSPLRQPPHLLLCKKTLVSTVTPLGLEVIPQVKKFLDEGLVRKSLNPMCFVGAQNSDQGVPTDPKRIKVIPDWPTPPSIEGRSPEYQEPRGLRSNPFQGGGDNAILPPKGIG

SEQ ID NO: 111615 - protein, 441 aa, Glycine max
  Coding DNA Sequence Number=SeqID_19930
  Gene Ontology: Mol. function=methyltransferase activity; Biological process=cobalamin biosynthetic process
  Homolog annotation: Hit_ID=A6X058; Match level="QueryCoverage=100%, HitCoverage=77%, E-value=0.0, Identity=84%"; Hit description =Precorrin-3B C17-methyltransferase
  Pfam annotation: Domain name=CbiG; Domain location=71-321; Score= -44.8; E_value=7.9e-05; Accession=PF01890.7; Description=CbiG
  Pfam annotation: Domain name=TP_methylase; Domain location=315-441; Score=-40.6; E_value=0.0085; Accession=PF00590.11; Description =Tetrapyrrole (CorrinPorphyrin) Methylases
  Pfam module annotation: Pfam domain module=CbiG::TP_methylase; Domain location=71-321::315-441
MERRMTLAILVLGEAAVPTAQRIAMALEHAEIRGLQSRVASVDDTFVHFGDAIRSLYEEGRPIIALCAAGIVIRALAPLLENKRIEPPVLAVAEDGSAVVPLLGGLSGVNDMARQVAAALEVAPAITTSGELRFGINLLHPPAELTLANPDDAKSFMSNLLAGQKLRLEGQSRWLAQSKLPFADDGALTISITPHNRVPRPDELIYHPRSVAIAVDMVRENPQANVEHALARAGIARQSLALLLAKEKDCAASELHEAARMLGIPLRFVADAPHARELVLRSVEQPIELIEDDGLAIAVALTPADVLFVGRKRGKLVVIGLGPGSRSLMTPAVQHELQQAEDILGYETYVRMAEENLRPFRPDQTIHMTDNREEMQRARHAFELAASGRHVVMVSSGDPGVFAMAAAVVEALHETDNPAWHGVELVIQPGISAAMAAASRI

SEQ ID NO: 111616 - protein, 222 aa, Glycine max
  Coding DNA Sequence Number=SeqID_19931
AKVPLQDFLRYDQLLASGAAHAEAELRGGPAETARQLVQVAGIDVERPRGAGPTALVRVQGAPDRLALAGIDRGPQGLGGAGRQGGRFGRGRGHGDIVQVQQAGAQRDDLVAMGAVAHGLDGGAADDMFQFAHVAGPAVAAEHLLGLGRQAQAAQPQPRAVQFQVAAGQQQHVAAALAQRRDRHRIDREPVIQVGAEIALAHAIAQVAVGGRDDAHVDRARA

SEQ ID NO: 111617 - protein, 110 aa, Glycine max
  Coding DNA Sequence Number=SeqID_19932
MTGPLNESISCFLIRVDPWVLEPIAFRGLHALAFRGLHALTFRGLHVVTFRGLHTLAFRGLQVLTFRGLHVLAFRRLHVLTFRGLHTLTFRGLHVLTFRGLHALAFRGLH

SEQ ID NO: 111618 - protein, 175 aa, Glycine max
  Coding DNA Sequence Number=SeqID_19933
  Homolog annotation: Hit_ID=Q6WAY4; Match level="QueryCoverage=86%, HitCoverage=27%, E-value=5e-15, Identity=34%"; Hit description =Putative uncharacterized protein
MGTNQIEKRFYQVKIKGLDVTNLKELGRLMGPLQRQAFRKVYRKILDLTTAEVFTEAVVSLAQYFDQPLRCFTFGDFQIVPTVEELEEILGCPLGGRKPYLFSGFLPSLSKIAAMVGDSARELDRMKQTRNGVVGVPRKYLEGKARDMANQEEWVSFADILALLIFGVVLFLNVD

SEQ ID NO: 111619 - protein, 173 aa, Glycine max
  Coding DNA Sequence Number=SeqID_19934
MGGVYKRRTKSSEADGPIGGYRKWLKAHVQGLDWLPSLRTAKREEVEAPKEDEEVQALRTELEQAQTVKERFKSMALRIRKENAELRDVNVAITKALEQETKRARREEHSRNKFRGALWGPREVCLKRLYETETNMLDIISKYQEELSLATAHKHRVADEYAQVYAEKEARGR

SEQ ID NO: 111620 - protein, 258 aa, Glycine max
  Coding DNA Sequence Number=SeqID_19935
  Pfam annotation: Domain name=zf-CCHC; Domain location=132-149; Score =21.0; E_value=0.001; Accession=PF00098.14; Description=Zinc knuckle
MKREKHASYSSHNSCKNLSEELRDYYEGRHRSHHRPHSHRREKERKPQEANINLPYFYEKDNVEANLDFEIRVEQQLKEKSTSKSYGSHSYPKKDQGQGILGVIPSKPKDDKVKIIEKQAPKASMQEKTSSIKCFKCLGRGHITSQCRTTKTMIMRGQDIYSSQDEATTSPSSNENEEAIGEESREEIYPQEERQPLMVKEECKEVSVSSKRLAKKESHFEIKTNIKETSPLRQPPHLLLCKKTLVSTATPLGLQVIP

SEQ ID NO: 111621 - protein, 114 aa, Glycine max
  Coding DNA Sequence Number=SeqID_19936
MGYVGVRELSWRWATGDGGFMRALWMWKNLLCTIARPPPSTTCDGVVPGDMSRGSGDLGDVRRAPGSQQIKGKQDHKARRLVVAGQLLENEVRKLREPLVIDYQACVIDYTGGM

SEQ ID NO: 111622 - protein, 58 aa, Glycine max
  Coding DNA Sequence Number=SeqID_19937
MVSVKKIQTEALPKRFREEFRELSTILRRSSFVLHRSSIFNGETKAKINSPSQARPQK

SEQ ID NO: 111623 - protein, 69 aa, Glycine max
  Coding DNA Sequence Number=SeqID_19938
MPFKICIFVDRQHKEPFKKCTHEMAMRKLSAKRSRSDAAAEGTSAAPEFDSHRFRSAGRRWSPPWLSLT

SEQ ID NO: 111624 - protein, 110 aa, Glycine max
  Coding DNA Sequence Number=SeqID_19939
  Homolog annotation: Hit_ID=A6FJQ2; Match level="QueryCoverage=34%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPGDARLDGASSKEGKCAESPPMFI

SEQ ID NO: 111625 - protein, 76 aa, Glycine max
  Coding DNA Sequence Number=SeqID_19940
MAAEWRRKRERRRHFKEKMSLEEAHHHRRPWIRAWRKKEMNEERGREEHEILCSKRALKSEPTNPRSSPRFSTKCV

SEQ ID NO: 111626 - protein, 162 aa, Glycine max
  Coding DNA Sequence Number=SeqID_19941
MVTMMVDTLPVFYYEKLVGYMPSSFADLVFARERIEVGLKRGKFDYVSSVGASGRRTGTAGAKKKEGDAHTVTSTPAWPKPPQTPHGTHQYAQHHPSFLACTGGSSDTVLAQPRAPTPPQWGLFRLRLQPGLTRPTMPTLARAPTRQGTSRQGRLRFSPRSQ

SEQ ID NO: 111627 - protein, 186 aa, Glycine max
  Coding DNA Sequence Number=SeqID_19942
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=93%, HitCoverage=27%, E-value=2e-94, Identity=84%"; Hit description =Photosystem I P700 chlorophyll a apoprotein A1
LFVCVVWKEEDSMIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQVIWRASGITSELQLYCTAIGALVFAALMLFAGWFHYHKAAPKLAWFQDVESMLNHHLTGLL

SEQ ID NO: 111628 - protein, 90 aa, Glycine max
  Coding DNA Sequence Number=SeqID_19943
MAAQLIHDRVEMECLEGAWETLEGNTRCRFRGTIRFTATSLVHPDEPARTLQRTVEWTAPWIRFAFDDCIHVAEATTMDTFALDDTVVIP

SEQ ID NO: 111629 - protein, 87 aa, Glycine max
  Coding DNA Sequence Number=SeqID_19944
LLFCISSVSIYYGTQLDIRVKGTLDPDKSNRALGFPALITGLCQSFRVPVTPNASPPPHQADPAGSFDTERYLRHLVCQQAANHRGQ

SEQ ID NO: 111630 - protein, 257 aa, Glycine max
  Coding DNA Sequence Number=SeqID_19945
  Gene Ontology: Mol. function=hydrolase activity; Biological process =proteolysis
  Homolog annotation: Hit_ID=A1FWI4; Match level="QueryCoverage=82%, HitCoverage=36%, E-value=1e-117, Identity=97%"; Hit description =Putative uncharacterized protein precursor
MGKSDRAFVIGALGLLLAFEWVGAMTVTGVAAAMAVLCVLTMINREREFHSFDQVPLFYRYWAGTTATPATRAIVLLHRGHEHSGRVTHLVDELDLPDTAFFAWDARGNGRSPGARGDAPGFPALVRDLDSFIAHIGAEHGIAVEDIVVIAQSVGAVVAATWVHDYAPRLRALVMASPAFKVKLYVPFARPGLALMQKLRGNFFVNSYVKPQWLTHDPARVESYRTDPLITRPISVRVLLGLYEAADRIVADAQAIS

SEQ ID NO: 111631 - protein, 88 aa, Glycine max
  Coding DNA Sequence Number=SeqID_19946
  Homolog annotation: Hit_ID=UPI0000ECBAF8; Match level="QueryCoverage =46%, HitCoverage=48%, E-value=1e-16, Identity=100%"; Hit description= UPI0000ECBAF8 related cluster
MVSLENSMSDFEHENPSLPSPKDLSSSVPITYAFSGMQAWHWPSFYNVVTGKTLALPNLIALQHIPLSPAGVIAKRPAPIALPNSCAA

SEQ ID NO: 111632 - protein, 51 aa, Glycine max
  Coding DNA Sequence Number=SeqID_19947
MEKFENKNIGEKKAKKAYITRDDNDLESSDDSEKEVINLCLMGKNYESDKE

SEQ ID NO: 111633 - protein, 142 aa, Glycine max
  Coding DNA Sequence Number=SeqID_19948
MPISPYESISWSMSSRHRGRTHKTPSGLGEVQQGPGVSSSGYEALDRARKTPSGPGEVQQGLGVSNSDYGPHSVLQSACPPQQGIAPARHPVDPEKSNRVLGFPALITGLCQFYGVSVTPNKVIRPLTNRAFIKKYYVPRQA

SEQ ID NO: 111634 - protein, 278 aa, Glycine max
  Coding DNA Sequence Number=SeqID_19949
  Homolog annotation: Hit_ID=Q2HSV3; Match level="QueryCoverage=45%, HitCoverage=19%, E-value=2e-09, Identity=33%"; Hit description=IMP dehydrogenase/GMP reductase, putative
MPSYRERLDRLRIPDVCWIPYGEHREVQDFHVRSCYSGLLCWGPVVVYYRSERVVRQFGYTQTIPASTVDSWVSYDDIHDRWMHYEDHIVPAGEVCVVPGACSSDYIDWFFRTSHPFMTPGHAVDPLPHGHAPQPRVVPQAPQTDIPCVSEPGTSSTSTEEPRHAVEVCDDIAKRLERHLSLGVVTPGSSTHEMIEECLKLARSVTQDHLILYMNSFHAVKVCDNIAERLERHLSLGVVTPGSSTHEMIEECLKLARSVTQDHLVYVRCRRRRCTDQA

SEQ ID NO: 111635 - protein, 37 aa, Glycine max
  Coding DNA Sequence Number=SeqID_19950
MDVKTTLLYGELDEVILMKELEGSEARDDGTHKSRGG

SEQ ID NO: 111636 - protein, 73 aa, Glycine max
  Coding DNA Sequence Number=SeqID_19951
MAEKGKLDHIEERLKDIEGGEDYAFANLEELFLVPERGHSQDATIEHVQKWGMNLSKNTPKGGGIRQPKWFPQ

SEQ ID NO: 111637 - protein, 212 aa, Glycine max
  Coding DNA Sequence Number=SeqID_19952
  Subcellular localization annotation: CTP_CleavageSite=48; ConfidenceScore=5.30e-01
MDRARLIFGLVTQLDMNVGDLISGQITSMAQSNSSRLGFPTFITALCRGARRPSARPAEVLATSAAPPPARMTATPSTLPPVDFQRFEAMLQNIHQGQIILLQSLQLVAPPDSIPTVEQFNEWVAWPGTQPPLHREDEDPAAQVSHQPEDESSESSTPEPLIRKRRVVITHEAAATSKKSLEATPEPLAPVADTTSPQQAADPSTPEDQSTL

SEQ ID NO: 111638 - protein, 83 aa, Glycine max
  Coding DNA Sequence Number=SeqID_19953
MASYGVASPLSLPFSIPLPFIFQEAKESIDEEDPRPTSSNGACITLLLDSNSSRDGTNPHFQFPIWQLTNNETKRQAITKDKK

SEQ ID NO: 111639 - protein, 79 aa, Glycine max
  Coding DNA Sequence Number=SeqID_19954
EEQGIKENSPNKKIEEAKEHHLDEDALIPHDVSSIGACRPRIFFINGFLCFLEDERQRNGEGRERGDATEFKIKSKILH

SEQ ID NO: 111640 - protein, 50 aa, Glycine max
  Coding DNA Sequence Number=SeqID_19955
  Subcellular localization annotation: CTP_CleavageSite=42; ConfidenceScore=5.12e-01
MPSRFPTRELAGGGMPGDPTTSPVKVLISGTRPSISSKKRVRRRMKKTKM

SEQ ID NO: 111641 - protein, 172 aa, Glycine max
  Coding DNA Sequence Number=SeqID_19956
MVAITPAKVRQPPFLREYDSNATCACHGEAPGHSIEHCRGLKRKVQVTMLNEMDKVDIFVPHPLTNASLLIQLSPECGCKPLVHLLKRPVLLSLDFQDHSIRDYSSYTLGGGAAVKQRGQPFPCVQESPTTREPRSLNPFSEIRRREEEISLKRDRLYSEDQSKFLIEYASG

SEQ ID NO: 111642 - protein, 67 aa, Glycine max
  Coding DNA Sequence Number=SeqID_19957
  Homolog annotation: Hit_ID=UPI0000ECAFAB; Match level="QueryCoverage =88%, HitCoverage=91%, E-value=3e-23, Identity=74%"; Hit description =UPI0000ECAFAB related cluster
MQAWHWPSFYNVVTGKTLALPNLIALQHIPLSPAGPEWRMAPDAVFSPYASVRYFTPHMVHSQYNLL

SEQ ID NO: 111643 - protein, 103 aa, Glycine max
  Coding DNA Sequence Number=SeqID_19958
MVDFSQVSTPLPELGLSFDLNLAVALWKVVLRIWILMLPRNPLWGVVGITPQASLPVLSWFVELMLAARIWCVELVVIARAVWGADFANRSGWSLVLARCHFE

SEQ ID NO: 111644 - protein, 146 aa, Glycine max
  Coding DNA Sequence Number=SeqID_19959
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=A7PJU9; Match level="QueryCoverage=78%, HitCoverage=5%, E-value=6e-53, Identity=85%"; Hit description =Chromosome chr12 scaffold_18, whole genome shotgun sequence
MKLNFDSNFAFSISNKPVQHDQTSTVRFHYGHSDIFDRIFHITRGGISKASKVINLNQDIFAGFNTTLRQGFITHHEYIQVGKGHDTGMNQISLYEAKDAIGNGEQTLSRDVYRLGQRFDFYRMLSFYFTTVGFYFSSMDMGKICG

SEQ ID NO: 111645 - protein, 266 aa, Glycine max
  Coding DNA Sequence Number=SeqID_19960
  Gene Ontology: Mol. function=aspartic-type endopeptidase activity; Cellular component=small subunit processome; Biological process=DNA integration
  Homolog annotation: Hit_ID=A5CBT1; Match level="QueryCoverage=83%, HitCoverage=25%, E-value=3e-32, Identity=33%"; Hit description =Putative uncharacterized protein
  Pfam annotation: Domain name=zf-CCHC; Domain location=194-211; Score =10.7; E_value=0.037; Accession=PF00098.14; Description=Zinc knuckle
MASAGPVFSFSGTPTITTAKLNWKNYLSWFASVELWFLGQGYHDHLEKGVGTVPNDKKSEWEKLDFQLSAVLWQSVELNFWKSLDCKARAAVEELKRFLVTDSLEEVDKKLDKFYMVLILRSLHSDFDHVRDQVLVGDQIPSMDSLITRLFRVPHVLKDENLAEVVETSAMVASRGRGGGRNNRGGRSGRSGRPQCTYCKRMDHTQENCYSLHGFPNKAAHVSRSEKSESKFSDEEYQEYLKLKSEKSNNQAQSSSVPCISTACIS

SEQ ID NO: 111646 - protein, 31 aa, Glycine max
  Coding DNA Sequence Number=SeqID_19961
MAVGGDAAAEGNGVVVGNNCKKVVRNARTVL

SEQ ID NO: 111647 - protein, 113 aa, Glycine max
  Coding DNA Sequence Number=SeqID_19962
MAILMVLVLDVYVRTGREIYVVWLLRASRSCGYICGEHNLAERSPIVLGFGAFIFIVIKYYKEAKEKEWFCTLEYMLHEANQSVDFFAKMGITVVGPMVIVSGGTLTGPRLCL

SEQ ID NO: 111648 - protein, 141 aa, Glycine max
  Coding DNA Sequence Number=SeqID_19963
  Homolog annotation: Hit_ID=A2Q676; Match level="QueryCoverage=73%, HitCoverage=55%, E-value=3e-08, Identity=32%"; Hit description =Putative uncharacterized protein
MHTKRCSVKRVQKLEAELNKLESEAELSGLKINFAKSRFGAFGISDQWKHDAAKVLNSKYGGWRNLDIKDIKTFNTALLGKWRWELFQQPDEPWARVLFSKYAGWRSLEEGKTGGHDSFWWKDLISIHNLQENRALRREIE

SEQ ID NO: 111649 - protein, 70 aa, Glycine max
  Coding DNA Sequence Number=SeqID_19964
  Homolog annotation: Hit_ID=A7PJW3; Match level="QueryCoverage=95%, HitCoverage=17%, E-value=4e-16, Identity=49%"; Hit description =Chromosome chr12 scaffold_18, whole genome shotgun sequence
MIAGLAKCGEVDKSRRNKRLMEALELFRKMQRQRVQPSQFTIVSLLGACAHLGALQHGDWVHDYVERGQI

SEQ ID NO: 111650 - protein, 34 aa, Glycine max
  Coding DNA Sequence Number=SeqID_19965
MRREEEAAVAGIGRNEVETIPEKAEVKVVRTVHY

SEQ ID NO: 111651 - protein, 187 aa, Glycine max
  Coding DNA Sequence Number=SeqID_19966
ALPPPPPRLAIDAMDHLKHPQHQIVLDPKYLDIAFFDDETFDCYQVFQNSGLVDFMSLKLPHYPELVRVFYNNLRIQDRTLYSKVHGIPLVIDQSLFFSLTKLPNQGVPFEGTIIDDWKFDYLSHDARRMVCNDQADMIGKFLVGSLTFEGIYVLIPLSSYGIVTPTGKNGERGVPIERMAKRMAKG

SEQ ID NO: 111652 - protein, 118 aa, Glycine max
  Coding DNA Sequence Number=SeqID_19967
  Pfam annotation: Domain name=Transposase_23; Domain location=45-115; Score=-15.5; E_value=0.06; Accession=PF03017.5; Description =TNP1ENSPM transposase
MQSQFQSQMQSHGLALPPESEVSPLVARVSTKESCVDASGNDPNTGESEKYELYVEENPPRLVAIGRLYEGSTTVHNIPLANDQVKIGVEEVRDADARIFVPTQEVQLVGLTLNTFVA

SEQ ID NO: 111653 - protein, 140 aa, Glycine max
  Coding DNA Sequence Number=SeqID_19968
MAIGESFNGNNRRNLRWPWLTGMRAQEGMEVRGTKGSCFGTTANPSGEELDTDMMKVQGLYYEDKHFTCLVAFGKVYGGVSIVHYVHLTNDVVKVCVEEVRDANYEVSVPTLEVQLVRQVIDSFIAWLRLVKPISHEVFT

SEQ ID NO: 111654 - protein, 131 aa, Glycine max
  Coding DNA Sequence Number=SeqID_19969
MTNANCPQEALHSVSNGNLRLLDWRGTVLKQQSCLAIIDSMEFVELNPLFQNPKSMSYSMLLLQHGVGLVFGGLEVVVDSGNSMVFSLVGVVVSGRHREGVRVGVRVGVDEDGGKGEGTLEVGEMGTCRDS

SEQ ID NO: 111655 - protein, 171 aa, Glycine max
  Coding DNA Sequence Number=SeqID_19970
  Pfam annotation: Domain name=Transposase_23; Domain location=52-121; Score=-4.1; E_value=0.0033; Accession=PF03017.5; Description =TNP1ENSPM transposase
  Subcellular localization annotation: CTP_CleavageSite=34; ConfidenceScore=5.25e-01
MASFSQMQSQFQSQMQSQGLALPPEPLVGPSGPRVSTKENCVDPSGNDPETSDSDMCGLYIEANPARLVALGIVYEGCTIVHNTPLLPSQVKVGVEEVKDPNAPVPVPTDEVSLVGQAIHTFLAWLTHLIKPLSQQAAVSPTKPPQKLDPEVDDLLYLMTLTILELFLRPY

SEQ ID NO: 111656 - protein, 60 aa, Glycine max
  Coding DNA Sequence Number=SeqID_19971
MIRKVAFRSYPLGWCKPTGGHHAQRNQISNHHSVYLQMGGRGNGGGNLCFLSLGMSLAST

SEQ ID NO: 111657 - protein, 77 aa, Glycine max
  Coding DNA Sequence Number=SeqID_19972
  Homolog annotation: Hit_ID=A7QR03; Match level="QueryCoverage=83%, HitCoverage=8%, E-value=5e-18, Identity=65%"; Hit description =Chromosome undetermined scaffold_147, whole genome shotgun sequence
MQNHIEKAFYSGHASYRVSHSTRYLDIWEPATLAITREGYSIKCSGQSGVVITEKFSPSTTANLRRNFLAVWPDVSE

SEQ ID NO: 111658 - protein, 45 aa, Glycine max
  Coding DNA Sequence Number=SeqID_19973
MVALLPQKGLPDLNVTLSTNLALSATYVFPDSPLLAKHADAGLSR

SEQ ID NO: 111659 - protein, 104 aa, Glycine max
  Coding DNA Sequence Number=SeqID_19974
  Gene Ontology: Mol. function=threonine endopeptidase activity; Cellular component=proteasome core complex; Biological process =ubiquitin-dependent protein catabolic process
  Homolog annotation: Hit_ID=A7P520; Match level="QueryCoverage=65%, HitCoverage=29%, E-value=2e-24, Identity=73%"; Hit description =Proteasome subunit beta type
MALLYIYFHWQNFLETGLIVGGWDKYEGGQIYGVPLGGTIVQQPFAIGGSGSSYLYGFFDQAWKEGMTKDEAEAWDTAARKLDNSGDEGARLGRKKMREVARFA

SEQ ID NO: 111660 - protein, 436 aa, Glycine max
  Coding DNA Sequence Number=SeqID_19975
  Gene Ontology: Mol. function=transporter activity; Cellular component= integral to membrane; Biological process=transport
  Homolog annotation: Hit_ID=Q58J24; Match level="QueryCoverage=71%, HitCoverage=77%, E-value=1e-166, Identity=94%"; Hit description =Putative plastid glucose 6 phosphate/phosphate translocator
  Pfam annotation: Domain name=DUF6; Domain location=228-353; Score =30.6; E_value=5.6e-06; Accession=PF00892.11; Description=Integral membrane protein DUF6
  Pfam annotation: Domain name=TPT; Domain location=362-436; Score= -31.0; E_value=0.038; Accession=PF03151.7; Description=Triose -phosphate Transporter family
  Pfam module annotation: Pfam domain module=DUF6::TPT; Domain location= 228-353::362-436
MGGVSPLRMATFMCFANGDGETYGGLAGRNDDMHGHILTLPASWVVEPNVPSALTPLTHNPGIFVSNDVVVASDGEVKAGNDNVDASRECVMRFSYFGGMDDLPDGEVEVNGEENSGNTVPMLPVVGISGSDLLLRQRHATPIKARSFLPSLSREKGQGSLVSVQKPLHIGASLGVGNFVSVKSDAKRGDLVKCEAYEADRSEVEGASTPSEAAKKVKIGIYFATWWALNVVFNIYNKKVLNAYPYPWLTSTLSLACGSLMMLISWATGIAEAPKTDPEFWKSLFPVAVAHTIGHVAATVSMSKVAVSFTHIIKSGEPAFSVLVSRFLLGESFPVPVYLSLIPIIGGCALAAVTELNFNMIGFMGAMISNLAFVFRNIFSKKGMKGKSVSGMNYYACLSILSLAILTPFAIAVEGPQMWAAGWQTAMSQIGPQFIW

SEQ ID NO: 111661 - protein, 31 aa, Glycine max
  Coding DNA Sequence Number=SeqID_19976
MAVNENFLETADKSVAGTLMSTLTTMKFDGS

SEQ ID NO: 111662 - protein, 120 aa, Glycine max
  Coding DNA Sequence Number=SeqID_19977
MARSPDKIKSIDGSKETLKLSVRISDLWFIGTPNKSEQAEMVFVDSDGDEIHAVCKQDQLKECVLEDIPFRKYRFAGFADVVAGQFEPRLLVDVIGVVEEVVFRQVSGKGRRVVFKLKDL

SEQ ID NO: 111663 - protein, 90 aa, Glycine max
  Coding DNA Sequence Number=SeqID_19978
MAITKQADLEVDQIRVRVTGGGGGGGEGVSMHGGATVDGGLRWRVTEGQPEVRRPSKRAEKHPVPNEPAKKGHPMEQVAVDVDMVNHSVA

SEQ ID NO: 111664 - protein, 35 aa, Glycine max
  Coding DNA Sequence Number=SeqID_19979
MTSASSTASSKIFHRYPEPKFNILTSVFVTFPIAI

SEQ ID NO: 111665 - protein, 70 aa, Glycine max
  Coding DNA Sequence Number=SeqID_19980
MKWIDRFAFTLNGSQELPRLLARAKAMADVYPAPDKVHGLFDYYQHMIELMSQIIRNHRGVCIYALALAR

SEQ ID NO: 111666 - protein, 609 aa, Glycine max
  Coding DNA Sequence Number=SeqID_19981
  Gene Ontology: Mol. function=ATP-dependent helicase activity; Cellular component=nucleus; Biological process=metabolic process
  Homolog annotation: Hit_ID=A7NST3; Match level="QueryCoverage=86%, HitCoverage=71%, E-value=0.0, Identity=76%"; Hit description =Chromosome chr18 scaffold_1, whole genome shotgun sequence
  Pfam annotation: Domain name=DEAD; Domain location=177-347; Score =233.9; E_value=3.5e-67; Accession=PF00270.20; Description=DEADDEAH box helicase
  Pfam annotation: Domain name=Helicase_C; Domain location=417-493; Score=115.3; E_value=1.8e-31; Accession=PF00271.22; Description =Helicase conserved C-terminal domain
  Pfam annotation: Domain name=ResIII; Domain location=173-342; Score= -27.1; E_value=0.0089; Accession=PF04851.6; Description=Type III restriction enzyme, res subunit
  Pfam module annotation: Pfam domain module=DEAD::Helicase_C::ResIII; Domain location=177-347::417-493::173-342
MSPSFVFDPPSDEEIEHSEHEEEEESEEEPESGSGTGSESESEGEGEEEEGHEEARVPKKKKKKTQSPWDFAKYTESVAEEHARRSTTSVDEKISKALKQRSTPLVAELDHSSESEPDEQEDYRPEEEDEEEGNDGDSKSFFAPSDGTSFHADSFLQLNLSRPLLRACEALGYSKPTPIQAACIPLALSGRDICGSAITGSGKTAAFALPTLERLLFRPKRMRAIRVLILTPTRELAVQVHSMIEKLAQFTDIRCCLVVGGLSTKVQEAALRTMPDIVVATPGRMIDHLRNAMSVDLDDLAVLILDEADRLLELGFSAEIQELVRLCPKKRQTMLFSATMTEEVDELIKLSLSKPLRLSADPSTKRPATLTEEVVRIRRMREVNQEAVLLAMCSKTFTSKVIIFSGTKQAAHRLKIIFGLAGSKAAELHGNLTQAQRLEALEQFRKQQVDFLVATDVAARGLDIIGVQTVINFACPRDLTSYVHRVGRTARAGREGYAVTFVTDNDRSLLKAIAKRAGSKLKSRIVAEQSIHKWSHIIEQMEDQISEVLQEEREERVLRKAEMEATKAENMIAHREEIFSRPKRTWFVTEKEKKLASKASKVFKKVLGK

SEQ ID NO: 111667 - protein, 107 aa, Glycine max
  Coding DNA Sequence Number=SeqID_19982
  Gene Ontology: Mol. function=helicase activity; Biological process =protein amino acid phosphorylation
  Homolog annotation: Hit_ID=Q2R0Z1; Match level="QueryCoverage=100%, HitCoverage=5%, E-value=2e-27, Identity=59%"; Hit description=AT hook motif-containing protein, putative
MASSGITSLLLPRGRTAHSKFKILVPTFDDSIFNIHQGSELAELLKVTKLIIWDEAPMAHKFFFETLDKSLRDIMGLGNESSTIFGGNAIVFSGDFRQILSVVPRGS

SEQ ID NO: 111668 - protein, 273 aa, Glycine max
  Coding DNA Sequence Number=SeqID_19983
  Gene Ontology: Mol. function=binding; Cellular component=microtubule
  Homolog annotation: Hit_ID=Q9T041; Match level="QueryCoverage=76%, HitCoverage=23%, E-value=2e-68, Identity=64%"; Hit description =Microtubule-associated protein TORTIFOLIA1
  Pfam annotation: Domain name=HEAT; Domain location=127-163; Score =4.5; E_value=5.8; Accession=PF02985.13; Description=HEAT repeat
  Pfam annotation: Domain name=HEAT; Domain location=173-209; Score =6.9; E_value=2.5; Accession=PF02985.13; Description=HEAT repeat
  Pfam annotation: Domain name=HEAT; Domain location=37-73; Score=12.6; E_value=0.36; Accession=PF02985.13; Description=HEAT repeat
  Pfam annotation: Domain name=HEAT; Domain location=78-114; Score =23.2; E_value=0.00098; Accession=PF02985.13; Description=HEAT repeat
  Pfam annotation: Domain name=Toxin_18; Domain location=193-235; Score= 2.0; E_value=0.093; Accession=PF08087.2; Description=Conotoxin O -superfamily
  Pfam module annotation: Pfam domain module=HEAT::HEAT::HEAT::HEAT::Tox in_18; Domain location=127-163::173-209::37-73::78-114::193-235
MVELKQKILTSLSKLSDRDTHQIAVEDLEKTISGLSPDAIPMILNCLYDAATDPKPAVKRDALRLLAAVCGAHSDAAAAHLTKIIAHVVRRLKDADSAVRDACRDTVGALAAQYLKGDGGGGGGGVGTVVGLFVKPLFEAMGEQNKGVQAGAAVCMAKMVECAGGSGGEAVPVAAFQKLCPRIYKLLNSPNFMAKAAILPVVASLSQVRVALASAEANSNEGCSCSGRFGIILVRFGWMQEAQNERPKRKITPPQCFHDYVQLLVLRNIARCC

SEQ ID NO: 111669 - protein, 651 aa, Glycine max
  Coding DNA Sequence Number=SeqID_19984
  Gene Ontology: Mol. function=phosphoinositide phospholipase C activity; Biological process=intracellular signaling cascade
  Homolog annotation: Hit_ID=A7P0T9; Match level="QueryCoverage=63%, HitCoverage=76%, E-value=2e-93, Identity=44%"; Hit description =Chromosome chr19 scaffold_4, whole genome shotgun sequence
  Pfam annotation: Domain name=DUF1723; Domain location=120-169; Score =75.0; E_value=2.5e-19; Accession=PF08330.1; Description=Protein of unknown function (DUF1723)
MEVREDFMDESTLSMMEVREDFMVSPIGDSEPSLRTAYFLKPLAKSLDGSVSEVLSSSKTMQLPPVFEPKEWPLVVHFKGWPKLKRKWVEWVDALQVRYGSVWKKVGIFDAIMSTKCSIVKDENLCFGVAEKWCPKTNTFLFPWGEATITLEDVMVLGAYPLVGDPIFTPLQSQEMIEVEKKLIHARQQPLRKNGAKVTTSLWMNLFLNSGSEIEHEAFLATWLTMVGFSHNGLMSKFVFPIAIHLARGNSIALGPAVLASIYKDLSLLKKTIVDFTNDKLELEVTLLSPFYLVQIWVWERFMNLQPQPMLINQEDPMLFRWHKVNTLKIDNVRLALDSAMEHFRWRPYVQYAGKFKVFYPENETLVLIDTNLDKEPTGLLVSFVTCLRVSVLVGIQSTIKKYLPHRVAMQFGMDQDVPGRVPTFHGTEAIAWKNYCRTISDRSLYFPARLFEGDVTTRYAMWWKQSVLCRHHDFAKNIVQRKRSLRPPPHGPHVLKANKKGYDADVPPGFSHLKTAPSGNSGEDNGEPLMGGLEEDFGDANGRKESRLSSESCSCASGIKVKMYKAKLQELCHQRKWGLPRHFAMKDGPDHIPSFKLLIMSIVSPSLLVPLVPLKKLITKLPCLLSSASLLCFLLAGDDGLEVGNYGFVK

SEQ ID NO: 111670 - protein, 103 aa, Glycine max
  Coding DNA Sequence Number=SeqID_19985
MSPFKDGPPTDVDIQRHCVTTMRHNRYLKLEFEPSSTPSFKIEGNFRMFIPLPATALWRKLVANCTITDMLVHPKGITSRNPIATPSKLEEDHSMDVLDRSRN

SEQ ID NO: 111671 - protein, 167 aa, Glycine max
  Coding DNA Sequence Number=SeqID_19986
MAEIFKATGSTPYPETMWPSLKRGAIDQNILEEDDNELSEIWSEKRVHGDLEQRGRIAQSKQHYFKLVMAVMCPECAWSPPELLSPASDSGDIDMGGCSPTMSGAEDEYGGPSFSPEARFEVDGRGAQTYEEGAESPVGLTKGQSTSLYGSTMCLTDDGKSDEVDCG

SEQ ID NO: 111672 - protein, 53 aa, Glycine max
  Coding DNA Sequence Number=SeqID_19987
  Homolog annotation: Hit_ID=A5BR97; Match level="QueryCoverage=100%, HitCoverage=3%, E-value=6e-08, Identity=43%"; Hit description =Putative uncharacterized protein
MAKNPVHHSRTKHIAIKTEDQIADIFKKALPRPRFEELRAMLGVTKICIKEEC

SEQ ID NO: 111673 - protein, 27 aa, Glycine max
  Coding DNA Sequence Number=SeqID_19988
MAELETGQGTNATTYTVVYKIPESKSC

SEQ ID NO: 111674 - protein, 146 aa, Glycine max
  Coding DNA Sequence Number=SeqID_19989
MKAQLMLRDLTNMSLASLFGKLQEHEMELMRLHQLEENDIKRKGIALIASSSSIQEESDKEDFTKIEEDDDDFRFFVKRFNKFLRNKRNKRELNFNTNKKEEDSSLAPICYESNQPGHMRFNCLVFKRRMEKSNKRNLKEKKEKKA

SEQ ID NO: 111675 - protein, 34 aa, Glycine max
  Coding DNA Sequence Number=SeqID_19990
MDTNNQVEDVALSSYKAKEEAFKEQRTGSTRQNL

SEQ ID NO: 111676 - protein, 593 aa, Glycine max
  Coding DNA Sequence Number=SeqID_19991
  Homolog annotation: Hit_ID=A7PUG7; Match level="QueryCoverage=99%, HitCoverage=97%, E-value=1e-120, Identity=41%"; Hit description =Chromosome chr7 scaffold_31, whole genome shotgun sequence
  Pfam annotation: Domain name=Ank; Domain location=122-156; Score=6.4; E_value=3.8; Accession=PF00023.21; Description=Ankyrin repeat
  Pfam annotation: Domain name=Ank; Domain location=303-335; Score=3.0; E_value=12; Accession=PF00023.21; Description=Ankyrin repeat
  Pfam annotation: Domain name=Ank; Domain location=337-366; Score=3.3; E_value=11; Accession=PF00023.21; Description=Ankyrin repeat
  Pfam annotation: Domain name=Ank; Domain location=40-70; Score=2.9; E_ value=13; Accession=PF00023.21; Description=Ankyrin repeat
  Pfam annotation: Domain name=Ank; Domain location=85-121; Score=22.1; E_value=0.002; Accession=PF00023.21; Description=Ankyrin repeat
  Pfam module annotation: Pfam domain module=Ank::Ank::Ank::Ank::Ank; Domain location=122-156::303-335::337-366::40-70::85-121
DNVNRDSLFRRCVLQGAWEEYVIPAYKNNSDFHKIKINESRGTALHVAVNDGRMELVNKLVGAILEHEGREVVSDESALKSTNERGDTPLHLAASRGFIDMCKCIIGKHGERKELIKVKNNKGETPLFRAVATYHKKTFVYLYHASKDLDVSLTNNEGDTILHRAIWGELFDLAIIITHCYPGRLVDTRNKDGATPLKVLASKPSAFKSGRSLPWWKQILYYFTIQVESAAQKARTMRRAQTFVGQKYATSVRCAKNVVRLAFEGLSLSGLGVTPREVKEEFPKEAADCSSEMMPKQEHDTNKKETAFMAAAKNGIVEIVFALQTAIPSAIHETNCNNENVLLVAVKNRQTEVVEELRKSLNKKLFVSLILVVDNKENTVLHLAAGTTSNSQMTWQIAGTAMQMMWHIKWYEDGETPWEIFEQKHKDLIKDSSEWLKETSNSCSVVAALIAGVSFATSSTVPGGTDQGKPTLEGQPAFDAFAIASLIGLSFSVTALIMFLAILTSRKQAEDFRKSLPLKLLFGLTSLFVSIASMLVSFCAAHFFVLKDKYKNILFPIYGATCLPVTFYAVIQFPLYVDLLKAIFKKVPQRAKR

SEQ ID NO: 111677 - protein, 19 aa, Glycine max
  Coding DNA Sequence Number=SeqID_19992
MDLSSIPTPECLDGTSYPE

SEQ ID NO: 111678 - protein, 158 aa, Glycine max
  Coding DNA Sequence Number=SeqID_19993
MGNMPTDEDAINLAMEDPLLNDCPMIMLINGAFHPSKVAAKAVTLSIRQQFEELGRSVYVDEVFQQSHLRKDTGQFVDDRSRRTHEKFEARLSQARSDVASSVGESQLTPLDPVEEQRLRSRCWIAAAGPKHKGHIYGTGDLAHTYKCRNDSFMQHTQ

SEQ ID NO: 111679 - protein, 576 aa, Glycine max
  Coding DNA Sequence Number=SeqID_19994
  Gene Ontology: Mol. function=RNA polymerase II transcription factor activity; Cellular component=membrane; Biological process=protein transport
  Homolog annotation: Hit_ID=A7P0T6; Match level="QueryCoverage=41%, HitCoverage=95%, E-value=1e-116, Identity=87%"; Hit description =Chromosome chr19 scaffold_4, whole genome shotgun sequence
  Pfam annotation: Domain name=BT1; Domain location=5-342; Score=28.2; E_value=6.7e-11; Accession=PF03092.7; Description=BT1 family
  Pfam annotation: Domain name=EAP30; Domain location=334-550; Score =268.3; E_value=1.6e-77; Accession=PF04157.7; Description=EAP30
  Pfam module annotation: Pfam domain module=BT1::EAP30; Domain location=5-342::334-550
MADVVVDAMIAEASVIKYLPCWSGHHLQEISSRYLGLLWLWEEYVGEKSENTKAEPEDSIVRDSHMNGSTLDEDSPLSKKSHSSTRRRKKGKKNAKGRAVNSSKSKIYKKGDSLALKWFHSLKEAIYDLCRAFRQPMIWRPMSWFFLAHVTIPNLSTVIFYYETEVLKLEASFLGTSRVVGWLGLMMGTFIYNRHLKYMTLRKILMCAHIGLAFLNLLQIAVVSRKNIAFGISDKIMVLFGSALADGINQFKFMPFLILSGQLCPPGIEGTLFALFMSINNLGSTLGSFVGAGLASILNIDSGSFDNLLLGIIVHALCNFIPIAFLFLIPKEATGLQTHAAARDQFRLLGENVAKIRTDLMKEQLATFRSQLEDFARKHKNDIRKNPAFRSQFHEMCAKVGVDPLASNKGFWSELLGLGDFYYELGVQIVDICLATRVHNGGLIDLQELCHLLRHRRKTDREVVSEDDCLRAIKKLKVLGSGFEVISVGKKKLVRSVPTELNKDHNEILELAQAQGFVTVDEVERRLSWSSGRAIDALDTLLDEGLAMIDDGDKDGRRRYWFPCVSPISSSIGVDS

SEQ ID NO: 111680 - protein, 430 aa, Glycine max
  Coding DNA Sequence Number=SeqID_19995
  Gene Ontology: Mol. function=triacylglycerol lipase activity; Biological process=lipid metabolic process
  Homolog annotation: Hit_ID=A5B608; Match level="QueryCoverage=89%, HitCoverage=85%, E-value=1e-144, Identity=68%"; Hit description =Putative uncharacterized protein
MSTQTATPVIKGEEEKEGTKEVVQEEEEEAEEASHPYAFHVSGPRNLANLNWRDLISSSCALIRFEVVKCDGGWDLSMSMRSLRNGKDATYKRTVIACFIQAVYLLELDRQENRMQENALAPNWWSPFKYKLTQTLIDERDGSIFGAILEWDRSAAMADLVLIRPSGAPKAVLALRGTLLKSPTMRRDIEDDLRFLAWECLKGSVRFKVALEVLKSVSDTYGSSNVCIAGHSLGAGFALQVGKALAKEGIYVETHLFNPPSVSLGMSLRNIGEKAELVWKRLKSMFPSSSSEEAQAGNDGDKTLSMGLKSWIPRFSSFKNAGFGVGKWVPHLYVNNSDYICCSYTDPECSGGEKNDADKENIGPTNGQVEAKLFVVTKEKQKFHEAHALEQWWSSDAQLQQANSKLISRQLKSLYTSGTSSQVMQGKLPR

SEQ ID NO: 111681 - protein, 82 aa, Glycine max
  Coding DNA Sequence Number=SeqID_19996
  Homolog annotation: Hit_ID=A5AWV0; Match level="QueryCoverage=100%, HitCoverage=5%, E-value=5e-07, Identity=37%"; Hit description =Putative uncharacterized protein
MKMLKGYTKNLRCPEASVVERDIAEEAIEFCSGYIEKVKPIGLLESRLDKRVGVHDKALVNESNLKMTKNRVLKKHNKTFLN

SEQ ID NO: 111682 - protein, 364 aa, Glycine max
  Coding DNA Sequence Number=SeqID_19997
  Gene Ontology: Mol. function=ATP binding; Biological process=apoptosis
  Homolog annotation: Hit_ID=A7Q674; Match level="QueryCoverage=97%, HitCoverage=57%, E-value=2e-31, Identity=27%"; Hit description =Chromosome undetermined scaffold_55, whole genome shotgun sequence
MKAIPLVLKRLRATRITTKLDASSAAKLEELMSLLDKKKDLFKTVKSNGDEFLDILTLLDGHLRYLNKDNLDNAKFEKDMEAILQRIKDSAEKLLPKGATNEGETQALGSSSKVRPLDNQMKKLHSDPSSSQNKNELLDHDLYQKIEVSYEELKDSLNICLLSLLVFPEGAVIRKRHTIYWWIGEGFVTSNGEKTAEEVGEGVIDELLKCKMIVAYGNGLNPVVKKFKVNPHICGQLVSFVSREKLQHLGFSFQIISHHEQPSWLVVERQKVNLGDKGHLKSDHWKTIFNLRASYLNFVSQWLAKMKNLAVLQLGRWQDPPFHHIEVASEDFLKELKDQKQLKYLSLRGISRMSQKNYKVWAKI

SEQ ID NO: 111683 - protein, 287 aa, Glycine max
  Coding DNA Sequence Number=SeqID_19998
  Homolog annotation: Hit_ID=Q1RSH0; Match level="QueryCoverage=33%, HitCoverage=50%, E-value=3e-08, Identity=35%"; Hit description=H+ -transporting two-sector ATPase, alpha/beta subunit, central region, related
MGDHKVTGWEWDFHWRRHLFDCEVSMADNFINEMTGVRVQLNCRDDWVWKPEPSGQYSAKSDYDMLRGVVVQGADVADFEQLWKLRIPSKAAIFVSRSTAEDTPHLFFQSSKILPLWWETTSWVNISTVFPKHQRQHFAQHMIDGVKGICISRWKDATFLFWTWLRNYEKDFVTNFNHWSSNLTESALGNHPTGLYVSVPLPHLKDTMRWLADPSGLYSSKSAYSLLTNVNRNLPHPNIYKSFWKLNIPPRAAISSRGGWPLVFQLQGHYCFMVGIHELEQDGRSPG

SEQ ID NO: 111684 - protein, 138 aa, Glycine max
  Coding DNA Sequence Number=SeqID_19999
MSSLLVIRENSNPNPNPYPINSSIPCQSQDGYPQVKYQLEDYSSLENNILNDVNIKGIVKGKEIVILLATIAVVFGCVEEDDKKTMINFLRTANLTYMCRLIHNFLFNMAFKDKFNPKVKKNLIPFRMLFAQIMSLLE

SEQ ID NO: 111685 - protein, 59 aa, Glycine max
  Coding DNA Sequence Number=SeqID_20000
MYPPMCWDKEFSSGEGKNQKNSQAISPLNSLGKREERHKRIQAVSPSILFAKGEVNEEE

SEQ ID NO: 111686 - protein, 443 aa, Glycine max
  Coding DNA Sequence Number=SeqID_20001
  Gene Ontology: Mol. function=drug transporter activity; Cellular component=membrane; Biological process=multidrug transport
  Homolog annotation: Hit_ID=A7P0R5; Match level="QueryCoverage=81%, HitCoverage=93%, E-value=5e-59, Identity=41%"; Hit description =Chromosome chr19 scaffold_4, whole genome shotgun sequence
  Pfam annotation: Domain name=AT_hook; Domain location=19-31; Score =15.0; E_value=0.061; Accession=PF02178.10; Description=AT hook motif
MDQQNQNNTPDGSGEVPLKRKRGRPRKYPKPDSEESSYILVSQNKRQNPVRAEQAPVPPGFEGVNGNQQLQRGQDNHSNNELVGQVVSGVIEAVFDAGYLLSVRVGDSDTTLRGLVFKPGRYVPISPDNDVAPSVPMIQRNEVSFPSRAAQVQTPLPKERNEQPVNVHRVETLAMNGSPSVPQVPRGAVSSSNLVASTGKSVPSVTGQITHQLPRGNVVPVLLQPNNFSNGVPVSNQPSQVKTQVSLGSGVIAAKEIPVDGSHALVSLTQTSQNLLPSSVQSEGVSPHNQSSSNVLNEDQAKSMRMPGMPFEQLVTEVVKRIQAPSDAMDTETDNSKSGDNTVVKYPSCRQEDKVNEMDQPILIKPLQAVQSLPQESSTSAPKPADYTETGRVNELLQHNKTENQASTIAAELGSGNKLDDIRNLGTGLEDGGTFNQQSLSEH

SEQ ID NO: 111687 - protein, 110 aa, Glycine max
  Coding DNA Sequence Number=SeqID_20002
MALLQGSKESSGQVDEDAEVVFVESNLYPNVTSYQSIVSRRPLAQGSLKQFIKSSAPPNTKFKIITGSKHKQQRDTGLKEHSNRVTPKAYTPKSPSRPLPPDSGPTQKTF

SEQ ID NO: 111688 - protein, 149 aa, Glycine max
  Coding DNA Sequence Number=SeqID_20003
  Gene Ontology: Mol. function=zinc ion binding; Cellular component =intracellular
  Homolog annotation: Hit_ID=A6YQW4; Match level="QueryCoverage=65%, HitCoverage=65%, E-value=3e-32, Identity=72%"; Hit description =Constans
MLPTSSGRATRVSRSARCASSCHERIPVTPFFEFVHSFKASLPINFHHRFFSNTDADADADVSTEEAEAASWLLANLKTDLNLSQYLFSETKPVPYIDLDYAAIDPKTEEKSSAIADDIVPVQSNFESFTYEHRTSFFTATFLNLQPSE

SEQ ID NO: 111689 - protein, 277 aa, Glycine max
  Coding DNA Sequence Number=SeqID_20004
  Gene Ontology: Mol. function=transporter activity; Cellular component= membrane; Biological process=oligopeptide transport
  Homolog annotation: Hit_ID=A7PC99; Match level="QueryCoverage=26%, HitCoverage=12%, E-value=1e-27, Identity=82%"; Hit description =Chromosome chr2 scaffold_11, whole genome shotgun sequence
MDEVGEPDLKPVVFRDGHSGLEDGEAPRGDEAIVDGTVGAVEAIGEVEEEAGEGTNQEEEVDHEGVNVGALAVLVYGGEDHLKSEEGSCGEEVTEEGGFEEGFGVSCSGAGVALLLYTLMPICCSFRSIFMCVRNWNGGFGWKEALLSLPSCTKERVESSPANSLDRQPSTAHRDIDQHNRLFCLLVSIQSSAAFPVTFAHVIGLKSFGSALCMTSISLGNSVSSLLVAIVMKISATDEMPGWIPGNLNKGHLDMFYFLLAALTAADLVIYVLMARW

SEQ ID NO: 111690 - protein, 168 aa, Glycine max
  Coding DNA Sequence Number=SeqID_20005
MSICRVISTGHLTTSSSNFLLSNFIRKFRLVIFFWKFRLDISIISLYINLLIIVKTRTKIREKEQRKESQILNSSCDEHKTSFRIIYDFLSILLRSVPTTKKKVFYIGSNGLSTSVMTRGGNPGSLTYNIGFMTVFEGRLFYIGCLATTDVEWIAFYSGSKAETMLNG

SEQ ID NO: 111691 - protein, 296 aa, Glycine max
  Coding DNA Sequence Number=SeqID_20006
  Gene Ontology: Cellular component=integral to membrane
  Homolog annotation: Hit_ID=Q2HUS3; Match level="QueryCoverage=90%, HitCoverage=58%, E-value=4e-78, Identity=61%"; Hit description=Amino acid/polyamine transporter II
MSEELSCKSSLDVPLLPQWNHLDEKANIASHHSTKNTIVSLFAPALMDSMQYQVSFSTNTCTSLTRVALALVSRCWDSLSSICSCIRRVVKLGSFVCYCHHNILHKHVDERCMDKNSNIKTYPNIGELAFGKTGRLIISVSMYMELYLVSTGFLILEGDNLSNLFPIGEIQIAGLAIGGKQLFVILVTLIILPTVWWDNLSLLSYVSTSGVFASAFIILSISWTATFDGVGFHQKGTLVNWNGIPTAVSLYAFCYRAHPVFPTLYNPMKNKHQFSYVSALNNFTYFGSVVLLIFAI

SEQ ID NO: 111692 - protein, 92 aa, Glycine max
  Coding DNA Sequence Number=SeqID_20007
  Homolog annotation: Hit_ID=Q0ZCC5; Match level="QueryCoverage=41%, HitCoverage=1%, E-value=3e-08, Identity=63%"; Hit description=CCHC -type integrase
MVKFDMPKELTFGFHVKVSRLLRKGFHGHLAMIKDVDVLEVELKKVIMVYEYSDVIMHGKMVAYTSRQHKRHEKNYPTHDLEMATMVFTLKI

SEQ ID NO: 111693 - protein, 93 aa, Glycine max
  Coding DNA Sequence Number=SeqID_20008
  Gene Ontology: Mol. function=protein dimerization activity; Cellular component=nucleus; Biological process=regulation of transcription, DNA-dependent
  Homolog annotation: Hit_ID=A5BIU7; Match level="QueryCoverage=96%, HitCoverage=15%, E-value=2e-30, Identity=65%"; Hit description =Putative uncharacterized protein
MDQANKENDEVYTQVTLLPWAEGKELEELGTDEEGNETTPTKSTPHMFRKTLTARYQHSWGDYKQQRPSQELVAKDLHGVEWNFRHIYRGQPR

SEQ ID NO: 111694 - protein, 194 aa, Glycine max
  Coding DNA Sequence Number=SeqID_20009
MSILELYIEKDVAGGSMFHSANSLISCENYLSNDETQLSTNMSNLHVDEDDDDYYYFVSNSYVEESLDEDDSVDGISDTDDEVTDMIQPVRIVHPAEGAQGIENPFWNHALHYNNINWSYPDEEDICGLEMPLTFNVGQELYVGMEFDSKDEVKNAVKEYVMKVHQSFKVVESKSNKHDQRRSINKSFFDSRED

SEQ ID NO: 111695 - protein, 41 aa, Glycine max
  Coding DNA Sequence Number=SeqID_20010
MMTQLRARTMKHHEALEGPMTRGARAGGGGGGDEYHQLDGA

SEQ ID NO: 111696 - protein, 53 aa, Glycine max
  Coding DNA Sequence Number=SeqID_20011
MALEMRRIIQPKEAVTILSEKEVMKCNPTLQGYWIDDSKKIGPKMQEKVLGFS

SEQ ID NO: 111697 - protein, 303 aa, Glycine max
  Coding DNA Sequence Number=SeqID_20012
  Gene Ontology: Mol. function=transporter activity; Cellular component= membrane; Biological process=oligopeptide transport
  Homolog annotation: Hit_ID=Q2HUR9; Match level="QueryCoverage=78%, HitCoverage=47%, E-value=1e-75, Identity=58%"; Hit description=TGF -beta receptor, type I/II extracellular region
MVMTLLSNKDCLHGLSLLLAFVSVKDLFNVTSTTRKVLKIDGYDCTRYQIYFPRDDKAAFITSKDLEQLEENKCNPWCLSTVTQVEEVKCILRLLSIWLCTILYSVVFAQIASLFVVQGDAMATGISSFKIPPASMSIFDILGVAFFIFIYRHAPDPFVAKVTKSKLTELQRMGIGLVLAIMAMVSTGLFTFHFLASATFNAQTPDELKSFGSALYMTSISLGNYVSSFLIAIVMKISTKGDILGWIPGNLNLGHLDRFYFLLAALTTANLVVYVALAKWYKYINFEGNNEEDIKKENHEVMV

SEQ ID NO: 111698 - protein, 158 aa, Glycine max
  Coding DNA Sequence Number=SeqID_20013
GEREEAQTSDDAGVRRTRCSTLDKMMVRWRTYNFKVDGEQIEQESMDGEEDREKEKTTRRRQNIPRYGGEGEEAETCDDARVRQRRCSSATNTMLRCRQGRSLDLLMMGKHVTILIPHPDTLKCSLRIVILDLLMWWWCDVNDGFGVKGDDGASREEV

SEQ ID NO: 111699 - protein, 242 aa, Glycine max
  Coding DNA Sequence Number=SeqID_20014
  Gene Ontology: Mol. function=binding; Cellular component=nucleus; Biological process=regulation of transcription
  Homolog annotation: Hit_ID=A4Q7Q0; Match level="QueryCoverage=27%, HitCoverage=25%, E-value=1e-20, Identity=57%"; Hit description=HEAT
  Pfam annotation: Domain name=NAM; Domain location=134-198; Score= -9.0; E_value=1.2e-06; Accession=PF02365.6; Description=No apical meristem (NAM) protein
MEKAIKNKVAKAVVPAIDVMFQALRSEQDKEPEQEAVLEVVGPGPSEESGNDATKWSERKEAVVDLTKLASTKRISPGDFSEVCRTLKKVDQSLGENMMNYKHLPPAGEILRLLFYVLASPIAALLYYFIFALFHPPDEELVAYYLKRQINGRKIELEIISEVDLYKCEPWDLPVKARAPPRRVIKQEVKAYGLFGLTIVRPPRFDCREAAERVATPEATAIVGKGELHLTGQLGDVIKESA

SEQ ID NO: 111700 - protein, 656 aa, Glycine max
  Coding DNA Sequence Number=SeqID_20015
  Homolog annotation: Hit_ID=A7P0R0; Match level="QueryCoverage=96%, HitCoverage=96%, E-value=0.0, Identity=57%"; Hit description =Chromosome chr19 scaffold_4, whole genome shotgun sequence
  Subcellular localization annotation: CTP_CleavageSite=31; ConfidenceScore=5.35e-01
MKISGDSTRPLRPFPPAIAAPSPDSDLQPLRRATRRHPRTPSTRLRRAGGHTGKRSRPETPLFKWKIHDGVRERSVGGDPLEEVGRKKEAPPHASVSARKLAAGMWRMQLPEEAAGDSGRRRGSRKIGEDRLGVQLKPSFQLSSTAMEGATKWDPVCLKTSDEVQHIYSQMKLLDQKVSTVSAVSALEAELEQARVQIQELETERFSSKKKIEHFLKKVSEERASWRSKEHEKIRAYVDDIKSEMSRERKSLQRIGIVNSRLVNELADVKLLAKRYMQDYEKERKARELIEEICDELAKEIGEDKAEIEALKRESMKLREEVEEERRMLQMAEVWREERVHMKLIDAKVALDEKYSQMNKLVADLETFLKSINVNPNAKEMKEARSLQQAAAAVDIQDIKGFSYEPANPDDIFAIFEDLNFGESNEREIEPCVAHSPVSHASKIHTVSPEAKLISKDNFQRCSDVFMDDNGDIEEDESGWETVSHVEDQGSSCSPEGSALLVNKNRRESDVSGRSVLEWEENAGLETPITEISEVCSVPAKQSKKVSSMARLWRSGPNSGDNYKIISVEGMNGRLSNGRVSSGGIMSPDWELGNGGLSPQDHLYQLSSPESANLHNRGMKGCIPRTVQKSSLKARLLEARMESQKVQLRHVLKQKI

SEQ ID NO: 111701 - protein, 409 aa, Glycine max
  Coding DNA Sequence Number=SeqID_20016
  Homolog annotation: Hit_ID=Q2HTA0; Match level="QueryCoverage=60%, HitCoverage=51%, E-value=8e-13, Identity=24%"; Hit description=IMP dehydrogenase/GMP reductase, related
  Pfam annotation: Domain name=DUF1723; Domain location=90-137; Score =43.1; E_value=9.7e-10; Accession=PF08330.1; Description=Protein of unknown function (DUF1723)
MGGLASHCHERLTNTKGKQERAAPVLQPSSKPPTVPIASARRQQEVVVVAEDVPHVDDAAEEKFGRPSAEIKGLVVVTGLSHLVTCSLDTDDRVLILAFAERWHKETSSFHLPVGDVTLDDMAFLLHLPITGAFYIFETLHVDEVVLMLVELLKVSGHEARTEAEQCHGAYVRLSWLRDIYRSKCDTRHWTSGHYAWGVATLVHMYNNLNDASKSSSRQLAKYITLLQAFTDEDYDERSPHAYSWTSTKALPVSTMPYGDHRAFGYVKTIPLYSPGSRLCLEDIDDKWMHFSDYLALVGQICVVPGQCAPYYMDWFYMISHSFMRPTQPRDPPRYPPIAAAMEEAHAHAPSDVEQPRHAVETCQAITGRLERLLNLRIVTKGTKTNGVMQDSLRIARGVTMDCYVYVRT

SEQ ID NO: 111702 - protein, 150 aa, Glycine max
  Coding DNA Sequence Number=SeqID_20017
MVFEIPNWFLPKVLALSLSLSRDFLEGSPTRSGTTYEHNSTMAEPRENEEAEEVAEVKGLCGGVEATVGLEGWRFQEFAVERVADDGLDQTVLFDVRYERACGGVAGSCGCVRGGPTRRLKLLGGGVVNYPLVVGDYNNNGGAEGQDNVE

SEQ ID NO: 111703 - protein, 106 aa, Glycine max
  Coding DNA Sequence Number=SeqID_20018
MDRLFCFHLLSLNSNLAEFDILEASDSRTKRKLLQTVGERWRQFKSYLTRKWALAADQDGVEDTVCDKYGISKEKWAQFCQTRRDPSWEDVRIKAQAIQKQNTAPH

SEQ ID NO: 111704 - protein, 97 aa, Glycine max
  Coding DNA Sequence Number=SeqID_20019
MGEGGGEIFKEIFPESKTVEGKVEISSFHQFPDESLSEALDRFHASDYVILRDRAYTPTKKILLELTSQDALVAQNKLLAKQLETLIETLSKLPQQL

SEQ ID NO: 111705 - protein, 195 aa, Glycine max
  Coding DNA Sequence Number=SeqID_20020
  Homolog annotation: Hit_ID=A7P0N9; Match level="QueryCoverage=87%, HitCoverage=67%, E-value=2e-33, Identity=37%"; Hit description =Chromosome chr19 scaffold_4, whole genome shotgun sequence
MAEGYGGGDEVNMLRRLLLGTPTKFGVGANGAGVASHFIQKYGCIDIDKSSWHEKQYLDQKVQDSLDSEKVGVVVLDDAMQVSEHTLKDIESIVLGIEKSVPIFLIKMDPTYLFEVGTINVKILLTALHEATILCVSAIGSAEPFVKQIQKMGALYVDRIDFSDHHLLLARIHFSPPEFGSTNLLMNTMLLQINI

SEQ ID NO: 111706 - protein, 155 aa, Glycine max
  Coding DNA Sequence Number=SeqID_20021
  Subcellular localization annotation: CTP_CleavageSite=48; ConfidenceScore=5.01e-01
LFYPGDVVVDSLLAQFLAVPRNVLKKATLFVTQPYVFNNRKLDCSHVLAKMFSNLRSQDVPQVTQTPPIQGSVVWKPPRVGLFKLNFDASVRQGTGTGMGMIVRDHQGQVLVAATYLSDVVMEIREVEATTFRWAIIKAVLDKLGSIAIEPNHIY

SEQ ID NO: 111707 - protein, 279 aa, Glycine max
  Coding DNA Sequence Number=SeqID_20022
  Gene Ontology: Mol. function=tetraacyldisaccharide 4'-kinase activity; Biological process=lipid A biosynthetic process
  Homolog annotation: Hit_ID=A7P0N9; Match level="QueryCoverage=97%, HitCoverage=89%, E-value=9e-81, Identity=53%"; Hit description =Chromosome chr19 scaffold_4, whole genome shotgun sequence
  Pfam annotation: Domain name=LpxK; Domain location=12-275; Score= -144.0; E_value=0.016; Accession=PF02606.5; Description =Tetraacyldisaccharide-1-P 4'-kinase
MIGYGGGDEVNMLRRHLLGTSTKFGVGANRAVVASHFIQKYGYIDIGKSSWHEKQYLDQKVQDSLDSEKIGVVVLDDAMQVALERDLDIVMVNELTLWGNLQLLPRGPLMEPLTALRRADEVVIHHADLVSEHTLKDIESMVLGINKSVPIFLTKMDPTYLFEVGTINAKIPLTALHEATVLCVSAIGSAKPFVKLIQKDIEMIRAKLGELEGKFGSKPIVVITEKDYDRDPEILKQLHPFKVFVLCSALKVLPYRGSREDSFKKFLKDHLKLELPPAR

SEQ ID NO: 111708 - protein, 110 aa, Glycine max
  Coding DNA Sequence Number=SeqID_20023
MNALLLLVEDPEVAKFREQCLKFLPEMKFLFKDSRKYEGFNTRTEETNDNIDDNTDMEVNEPEIDTTTQNTSLAKENGQRKRGREGDKRIGVAAKLSSQLDRIIQTFESS

SEQ ID NO: 111709 - protein, 93 aa, Glycine max
  Coding DNA Sequence Number=SeqID_20024
MEKLINKTQLFPKIIPASSRRLGGSSTESHFLHPTTVILLPRTRFAIITGTFGKVNTPPPHEHTQHPTNETWAPSSTLIMDELKILRHPLGDA

SEQ ID NO: 111710 - protein, 224 aa, Glycine max
  Coding DNA Sequence Number=SeqID_20025
MVFHVKVVEDAEGIVEGNESSGVGREVDESACGVGVGDEACEDRLREKLFEGDNNNDGDGVSSNEGRDTNNGCSGNGATIVVMVVMQMVGVLVALMVVATSGDDVGGDSDKCGIGDNDSGGGSDDGNTNVNSDSDDIDDDSSSGSGDNVDGDDNKRGIGGNESGDNGGGIGGSDSGDDGGDDSNNIIGVSDDGSDSGGNGGDIDIESNDDNSDGGNNKKWDCQM

SEQ ID NO: 111711 - protein, 101 aa, Glycine max
  Coding DNA Sequence Number=SeqID_20026
MSASEHSLGGVAETYVNFPWPTMTPSEQHDVPIETPNVPLGTQWNVPEAIPNVDELLGVDLRHQFSLEADQHEEGGHRSRRNPTKMGSSMRHILTTSSTSR

SEQ ID NO: 111712 - protein, 203 aa, Glycine max
  Coding DNA Sequence Number=SeqID_20027
MCWGDLTLCFLRPALASSVGCTSRDRCQYGFCVSHCSFVAILEGHIRQRTSAAVLNFCLQFSCMDFVSLHPTLKIAEETTTAVGYVVERLYTEREHAAAPYFRIKRVEIEDQLYDMTSPLTQTLNQLSMSEILRKPINRKSHGARVTLACHKIPKSLSDKPDMLAAWQPASQSLLTVVEHEPNNDSLTLSHDVVLMNTMTALG

SEQ ID NO: 111713 - protein, 126 aa, Glycine max
  Coding DNA Sequence Number=SeqID_20028
  Gene Ontology: Mol. function=protein serine/threonine kinase activity; Cellular component=chloroplast; Biological process =regulation of photosynthesis, light reaction
  Homolog annotation: Hit_ID=Q9S713; Match level="QueryCoverage=53%, HitCoverage=12%, E-value=7e-11, Identity=53%"; Hit description =Serine/threonine-protein kinase SNT7, chloroplast precursor
MFSLRKEEDRTQAETETQAEAIEVTQGVATSTTQVHKAEKTKRAVKKPTYLKARTLSEGDIKPQNISLFEESHIFNIIDLGAATDLRVGINCIPKEFLLDPRSPYVVTHGPEDVTDAAVIAVTMPL

SEQ ID NO: 111714 - protein, 384 aa, Glycine max
  Coding DNA Sequence Number=SeqID_20029
  Homolog annotation: Hit_ID=A5C201; Match level="QueryCoverage=26%, HitCoverage=8%, E-value=1e-14, Identity=46%"; Hit description =Putative uncharacterized protein
  Pfam annotation: Domain name=Kinesin-related; Domain location=3-325; Score=-265.7; E_value=0.00071; Accession=PF06548.2; Description =Kinesin-related
MVLNFIVVSQKTFTLRENVTDAAVIAIMMPWKSSDISVSADCVQFYSVEENCDAETTSSGDEIERSVHANNLQYLTYHSCARKTQTTSMAISSSYLASRNNSSKAESLPASLQKKLQILDYHQQNSALNISSTSFPFARLTLTPCRDIENAESDEKNKTIQQKPSSDEVHCASCLTKISTHDSTEVQDSLKSWFETTEKAGNPNGEDCEIKEVPEELVQRDRERAVVGHSRIVEHYTDLLEKYDDLVAKHDAIVKRGEEGNSKSLKKDHACVAKSLSAELSVLRKDVSRIGICHSGKEFLELGHNFWKSLFEMGFLECWHVLHLHQVPDIEYDHFAIVELQDEAILEVVEHFAVVALGHGSGAGIADFLWYRVSVNKIRGIFVL

SEQ ID NO: 111715 - protein, 114 aa, Glycine max
  Coding DNA Sequence Number=SeqID_20030
  Gene Ontology: Mol. function=nucleoside-triphosphatase activity; Cellular component=integral to membrane; Biological process=transport
  Homolog annotation: Hit_ID=A7P7L9; Match level="QueryCoverage=42%, HitCoverage=3%, E-value=1e-11, Identity=72%"; Hit description =Chromosome chr9 scaffold_7, whole genome shotgun sequence
MEKSLLIVEEANLSSRSFSGRVSDDKANRSGRKEMKKQGVFEECRELLKGVSGVFRPRVLTTLMGASGAGKTTLMDAIQGVPKIKEGYNPATWMLEVTSAGIEASLKIFQTKGY

SEQ ID NO: 111716 - protein, 237 aa, Glycine max
  Coding DNA Sequence Number=SeqID_20031
MARTKHASYVDGCDPSHECPSPSHERDDAKERHRRLTVSTRGQRHWSTKLEPEPKPQVKAHPSNRIIGPPFGREVMKILLMTHLSINSKEEAITATTVDARDRLTLLADLYALAWSGAESLSLRGSAPPSAAMPVPGIGTGTGFSGMLQLGSKVGPTRRFMAMPRLWSFLAIRSMAKEIDKFGFESREWSNECGIWFWIWGMEEGKNSMKKERCIESGYELQEATFQQLLTSWNMDE

SEQ ID NO: 111717 - protein, 371 aa, Glycine max
  Coding DNA Sequence Number=SeqID_20032
  Gene Ontology: Mol. function=nucleotide binding; Cellular component =membrane; Biological process=defense response
  Homolog annotation: Hit_ID=A7QA99; Match level="QueryCoverage=99%, HitCoverage=43%, E-value=1e-44, Identity=32%"; Hit description =Chromosome undetermined scaffold_70, whole genome shotgun sequence
  Pfam annotation: Domain name=LRR_1; Domain location=103-124; Score =8.9; E_value=6.8; Accession=PF00560.24; Description=Leucine Rich Repeat
  Pfam annotation: Domain name=LRR_1; Domain location=245-267; Score =7.8; E_value=11; Accession=PF00560.24; Description=Leucine Rich Repeat
  Pfam annotation: Domain name=LRR_1; Domain location=318-340; Score =2.5; E_value=1e+02; Accession=PF00560.24; Description=Leucine Rich Repeat
  Pfam module annotation: Pfam domain module=LRR_1::LRR_1::LRR_1; Domain location=103-124::245-267::318-340
GGQIKSCGVHDLVHEIIREKNEDLSFCHSASERENLSRSGMIRRLTIASGSNNLVGSVVNSNIRSLHVFSDEELSESSVKRMPTNYRNSKIVNLPKSIDVLHNLETLDLRESHVLMMPREFYKLKKLRHLLGFRLPIEGSIGDLTSLETLCEVEANHDTEEVMKGLERLTQLRVLGLTLVPPHHKSSLCSLINKMQRLDKLYITTPLALFMRIDLQFDVCAPVLQKVRIVGGLKEFPNWVAKLQNLVTLSLRRTYLTVDPLPLLKELPYLSSLFINRSAYEGKVLQFPNRGFQNLKQILLGSLFILKSIVIEDGALPSLEKFKLVGIPELKEVPSGLYKLPKLEVFHAINMSDEFQENFNLNRGQGQWIIE

SEQ ID NO: 111718 - protein, 183 aa, Glycine max
  Coding DNA Sequence Number=SeqID_20033
  Subcellular localization annotation: CTP_CleavageSite=54; ConfidenceScore=5.79e-01
DCWNLNDPSITFPGTQKSKARRSEAPSTFAPPASTPSTSALPSPPAAPVFPSPSAQSLESLMSMLQSLHQGQLLIMQSLQDVAQQRPVMSLEKFVEKASTALEPQSNQEDDIPEPSEPIPPKPFTFEFDLVIIQEDVAVPEPFPRPEPEPSAPVPDLPLSQDSQLGTPTLDLNEHATDSAQDC

SEQ ID NO: 111719 - protein, 303 aa, Glycine max
  Coding DNA Sequence Number=SeqID_20034
  Gene Ontology: Mol. function=protein binding; Cellular component =nucleus
  Homolog annotation: Hit_ID=A7NVG5; Match level="QueryCoverage=66%, HitCoverage=28%, E-value=4e-18, Identity=34%"; Hit description =Chromosome chr18 scaffold_1, whole genome shotgun sequence
MHLNHPNSQPHVETEVFSDHDVQILQFSTVIKRSVNHPHSSVTTIVALERALESEENNAPSALAAPVLENVSHDQFQAFSYVPSDSFAFDSDSSFVITPPPILEGRDIVKCYGTKALVVPMHSAYWFLPATVHRLERQVSVLPGILQGDKSNSLLYNSVDNRKKICWNEDFHSKYNGCRWKGGRLRLEKAKEDCLVRLKREWEQGALDYATQKPPTAASEEEMPNTTQSSKICILILWVGLVMVGYWELVVHSSNKEGKDTESIIPLPWYPENLAWHSNFSRKQLRKNQTLGRFRLNDWPQQK

SEQ ID NO: 111720 - protein, 185 aa, Glycine max
  Coding DNA Sequence Number=SeqID_20035
  Gene Ontology: Mol. function=aspartic-type endopeptidase activity; Cellular component=small subunit processome; Biological process=DNA integration
  Homolog annotation: Hit_ID=A5CB76; Match level="QueryCoverage=99%, HitCoverage=70%, E-value=7e-30, Identity=36%"; Hit description =Putative uncharacterized protein
MTSAGPAFSFSGTPTITTAKLNWKNYLSWSASEKGIDIVPSDRKSEWEKLDYQLCAVLWQSVKADVLEILRSFKTCCSFWKKAREIFANDIQSLFDATMKVTALKQTSHDMIAHIGKARAAVKELKRFLVADSLEEVNKKLDKFYMVLILRSLHSDFDHMRDQVLTGDQVPSMDSLITKLIRVAH

SEQ ID NO: 111721 - protein, 141 aa, Glycine max
  Coding DNA Sequence Number=SeqID_20036
MTFFMPMYFLQHLKSTLHAFFLLNLFKGIWEIGRDAIENPSDKFTTNIRISGRRESEDEMRELSSDRFVVEGGEGDKEMEDDEVRVESEKGLKEVRDREGAKELGESVGDIDDWGERVGDMVGEAPEAEGSTVMYEQRVSK

SEQ ID NO: 111722 - protein, 240 aa, Glycine max
  Coding DNA Sequence Number=SeqID_20037
  Gene Ontology: Mol. function=transferase activity, transferring pentosyl groups; Cellular component=imidazoleglycerol-phosphate synthase complex; Biological process=amino acid biosynthetic process
  Homolog annotation: Hit_ID=A7P0M4; Match level="QueryCoverage=98%, HitCoverage=41%, E-value=2e-72, Identity=62%"; Hit description =Chromosome chr19 scaffold_4, whole genome shotgun sequence
  Pfam annotation: Domain name=His_biosynth; Domain location=1-240; Score=-6.5; E_value=1.6e-09; Accession=PF00977.12; Description =Histidine biosynthesis protein
MELMSFLNITGFRDFPLGDLPMLQLGEELEISQIQLGVASEYFRSGADKISIGSDAVYAAEEYLKAGVKTGKTSLEQISRVYGNQAVVVSIVPRRVYVKDPNDCAIEDHKGFKSRIMPSNYCHIELYTVHCYGIGGGGWGRKCAEVCSRVNGGREGRPIGAYELAKAVEELGAGEILLNCIDCDGQGKGFDVDLIKLISDAVSIPVIASSGAGAPEHFSEVFYKTNASAALAAGIFHRKE

SEQ ID NO: 111723 - protein, 133 aa, Glycine max
  Coding DNA Sequence Number=SeqID_20038
  Gene Ontology: Mol. function=transferase activity, transferring pentosyl groups; Cellular component=imidazoleglycerol-phosphate synthase complex; Biological process=amino acid biosynthetic process
  Homolog annotation: Hit_ID=A7P0M4; Match level="QueryCoverage=43%, HitCoverage=10%, E-value=2e-21, Identity=86%"; Hit description =Chromosome chr19 scaffold_4, whole genome shotgun sequence
  Subcellular localization annotation: CTP_CleavageSite=43; ConfidenceScore=5.91e-01
MEAPPPFASSSSSSLFSLRNKPLSSPTITHFGNTKPSKSFSVRASSSRDSVVTLLDYGAGNVRSVRNAIRFLGFEIKDVQTPQDILNASRLVFPGVGAFAAAMEVLSKTGRNGLDQDSVMYWGLLHLLTSTNY

SEQ ID NO: 111724 - protein, 207 aa, Glycine max
  Coding DNA Sequence Number=SeqID_20039
MGVASQTGEFWEGRLQALAGLADVLFSVKGNCHCQWYIMNSVITVLYFNGRVYEENDGVIFEGSKKAIQIKRGISFNALKKKIGDKVKFLVSGKYVALQICDDEDVETMLKSFQQQDQISVLELYIEKDVAGGSMFHSANSLTSCGNNLSNNEAQPSRNVSNLHGDEDDDDDDYLMSNSYVEESLNEDDNIDGISDTDDEVTDMIQP

SEQ ID NO: 111725 - protein, 93 aa, Glycine max
  Coding DNA Sequence Number=SeqID_20040
  Homolog annotation: Hit_ID=A5AU60; Match level="QueryCoverage=98%, HitCoverage=10%, E-value=4e-10, Identity=33%"; Hit description =Putative uncharacterized protein
MFTHAWILRFIGGVLFVDKSSSKVFLRWLRRENQHIGNDDLIVFRRKLDIMKQHEFLWEPYTTTVMSVLPPICLVGSVLWCAVVPLICFHVVE

SEQ ID NO: 111726 - protein, 45 aa, Glycine max
  Coding DNA Sequence Number=SeqID_20041
MVQSYYGVHGGATTQYPVYGSGPALAAGGMMSDGVVEQRYRQYHN

SEQ ID NO: 111727 - protein, 55 aa, Glycine max
  Coding DNA Sequence Number=SeqID_20042
MTTTMLSKIMVEKGKNSVQRWSFLPPSLLKNIVITKMSPLKQLQRVLNTGVEGVS

SEQ ID NO: 111728 - protein, 733 aa, Glycine max
  Coding DNA Sequence Number=SeqID_20043
  Gene Ontology: Mol. function=catalytic activity; Cellular component =cytoplasm; Biological process=carbohydrate metabolic process
  Homolog annotation: Hit_ID=A7P0L5; Match level="QueryCoverage=74%, HitCoverage=54%, E-value=0.0, Identity=56%"; Hit description =Chromosome chr19 scaffold_4, whole genome shotgun sequence
  Subcellular localization annotation: CTP_CleavageSite=43; ConfidenceScore=5.71e-01
MSSTLSIPLGFCFPPTVATSFPHSQTKPQNVTFQRRKTTTKACAASENPNQRQNPKQNQKEAKTKNAGDDDGEKGINPAGFLAKRGISHKAFAQFLRERQEFWKMRMEVVWYKVLKDMKDEILKRHENFMILASGFELLGMHRHPEHRVDYMEWAPVANTLALAKRCDTEKSLFCQVAIVTKKNMLFEHDFVHPFLFSDKQVNAGARYCAIIGDFNGWSPTEDCAREHYFGHDDFGYWFIILQDKLREGEEPDKYYFQMYNYVDDYDKGDSGVSVEELIKKANEKYWQPGEDRFVNNRFEGPVKLYEQIFGPNGPQTIEDIPDIPDPETRYKAWAAEHGPSPTAAIDSGKEYDIYNVIVDPQWQEKIRALEPPVLYWFETRKGRKAWMKKYSPGIPHGSKYRVYFNTANGPLERVPAWATYVQPEVDGRQACAIHWEPSPEQAYKWKNMSPKVPKSLRIYEAHVGISGSEPKISSFNDFTDKVLPYIKEAGYNAIQLIGIVEHKDYFTVGYRVTNFFAVSSRYGTPEDFKRLVDEAHAENPGIMLWPNTTKSCGRSTIPGILTLKFGDKKSMLDYIRLLTCLHYNRRITFTVTSKPTGYLSKLKEEKKQKQVKPEMVTAPGKHRSQSRGTKRTFSRGAEYGKAQKESNEASLPSRLCVRVEKGFSGDSAVRAGDKLNGIDSVIFLLHQKIRILLAEDSINKYVNKIRIMNENISSLPYSFFPFSMEALVLETS

SEQ ID NO: 111729 - protein, 609 aa, Glycine max
  Coding DNA Sequence Number=SeqID_20044
  Gene Ontology: Mol. function=molecular_function; Cellular component =endoplasmic reticulum membrane; Biological process=intracellular protein transport
  Homolog annotation: Hit_ID=A9P8P9; Match level="QueryCoverage=48%, HitCoverage=98%, E-value=1e-165, Identity=89%"; Hit description =Putative uncharacterized protein
  Pfam annotation: Domain name=WD40; Domain location=1-39; Score=26.2; E_value=0.00012; Accession=PF00400.23; Description=WD domain, G-beta repeat
  Pfam annotation: Domain name=WD40; Domain location=139-191; Score =35.2; E_value=2.4e-07; Accession=PF00400.23; Description=WD domain, G-beta repeat
  Pfam annotation: Domain name=WD40; Domain location=199-241; Score =38.6; E_value=2.3e-08; Accession=PF00400.23; Description=WD domain, G-beta repeat
  Pfam annotation: Domain name=WD40; Domain location=248-286; Score =13.5; E_value=0.68; Accession=PF00400.23; Description=WD domain, G -beta repeat
  Pfam annotation: Domain name=WD40; Domain location=45-85; Score=42.6; E_value=1.4e-09; Accession=PF00400.23; Description=WD domain, G-beta repeat
  Pfam annotation: Domain name=WD40; Domain location=92-132; Score =35.5; E_value=1.9e-07; Accession=PF00400.23; Description=WD domain, G-beta repeat
  Pfam module annotation: Pfam domain module=WD40::WD40::WD40::WD40::WD4 0::WD40; Domain location=1-39::139-191::199-241::248-286::45-85::92 -132
MPSQKVETGHQDTVHDVAMDYYGKRLATASSDHTIKIIGVSNTASQHLATLTGHQGPVWQVVWAHPKFGSLLASCSFDGRVIVWKEGNQNEWTQAHVFDDHKSSVNSVAWAPHELGLCLACGSSDGNISVFTARADGGWDTARIDQAHPVGVTSVSWAPSMAPGALVGAGLLDPVQKLCSGGCDNTVKVWKLNNGLWKMDCFPALQMHTDWVRDVAWAPNLGLPKSTIASASQDGKVIIWTVAKEGDQWEGKVLNDFKTPVWRVSWSLTGNILAVADGNNNVTLWKEAVDGEWQQIFISKHKNKGGRRYGFVRFKGVSDERRLERQIDNIIIELKMYVNVSKYWRGNERHKEHNVKPRTQADGDNNEVEAPGQMAMHYRATSMSYAKAASTTKTNIGQRRHPQPITLRPEGSYSSVQLEIPAGERKWYTDAWDEIPWEIGTNVVPKYIGDDMILLLGLSDTKAEELIIEETRHGTSPFHSLEKWNPTMRPGHRLVWTQCWGIPLEAWDIGQIHKIMAAIGDLVEVDHDIEELDAGKCTHHYRSAIRSSEEIDSDDSDSSTPNAKTIETPELHHSPNSLAGDRIDEVETQQRAPLPNGPRDIEDPMGNDR

SEQ ID NO: 111730 - protein, 469 aa, Glycine max
  Coding DNA Sequence Number=SeqID_20045
  Gene Ontology: Mol. function=sequence-specific DNA binding; Cellular component=nucleus; Biological process=regulation of transcription, DNA-dependent
  Homolog annotation: Hit_ID=A3RI55; Match level="QueryCoverage=98%, HitCoverage=90%, E-value=2e-47, Identity=32%"; Hit description=WRKY protein
  Pfam annotation: Domain name=WRKY; Domain location=262-297; Score= -7.8; E_value=0.0068; Accession=PF03106.6; Description=WRKY DNA -binding domain
MSFNGKRLVVDEIDFFTEKKKKSEDVDNQLVHHQMELPINTNLDLLITKSSTSNRSNMEEGPSESRDNTRNKFAAMLAELHIINAENQHLRELVDQVNNKYNDLHKDLTKLMQKQHKNEINGAIEEKDKRDDMIISRSFLDIGIATKEDPSQQHSEAKLQESKNITELMECKNRDVVELDSGKDSAKSRRDKHESSETMSMIKKARVSVRTKTDSSMMDVNGESMGRRWQKGIHVRDLIIVAQWELLVQFGSKYPFVEGRSSFSWKYGMDYFSAVQRNAEDLSVLITTYEGQHNHVLPPTAKAIASTTSAAASMLLSGSMLSSDGLIYPNILESASLPFSQNLATLSTSAPFPTITLDLTQSTTNNSSQLLQGAPQDNQHIYSLLSPLLAQKFMSSATNIFYQNHQTKVSSLHGSQGTETASFVDTVNAATAAITGDPKFSAAVMAAITSIIGSSHPNINGTSGDPALQ

SEQ ID NO: 111731 - protein, 136 aa, Glycine max
  Coding DNA Sequence Number=SeqID_20046
MLEEEFLMIFWNCSPRGSSIAIFGTSSSVGTFPTVGDEDGVDVDIRDDSCALIGDGDGVGATSEDLVGIDTVDDDGIDDDRLSLGGAGGDLQGSDPVPQNVGCDFEGAGGDFHGVELVLQDFACDIHGAENDLGNL

SEQ ID NO: 111732 - protein, 41 aa, Glycine max
  Coding DNA Sequence Number=SeqID_20047
MAFVPLFNNTDIRLELKRCRQKGERGGERRHGKCCYAIGID

SEQ ID NO: 111733 - protein, 165 aa, Glycine max
  Coding DNA Sequence Number=SeqID_20048
MLQSSIETQGIDRRRDTVEAEEYSQQMAERGHGMYYTPQTFAEYSTQMYQYPFQGHHTDTSASQQSFGGVAETQAHFSWPTMTPSQQYHGPIPTPNAPLGTQWNVPGQIPNTGDLFGVDLRHAFSAEADEEEAGRHRGRRNPDRQARRWDRPCGTSSRHHGHQNE

SEQ ID NO: 111734 - protein, 160 aa, Glycine max
  Coding DNA Sequence Number=SeqID_20049
  Homolog annotation: Hit_ID=A4PP05; Match level="QueryCoverage=69%, HitCoverage=28%, E-value=1e-11, Identity=37%"; Hit description=IMP dehydrogenase/GMP reductase, putative
MYDHLNHACRSGGRQLVGYITLLQIYEHFPLVAECMVDPDYDDVSPRACRWIATKASLKSISTSTYSQCLDGLRIPNVCWMPYGPVAIKHRPERVMHQFGYMQSIPAEAIDSWLSFEEIDNRWMHYSDHFAPTDQVDPYRPLICMVYMDQLDPYKPYGST

SEQ ID NO: 111735 - protein, 155 aa, Glycine max
  Coding DNA Sequence Number=SeqID_20050
MNRWMTMKNLMLEDTGTPRSDRMYKLEVMVYHKKQSSNFVLWDRECIELIGKSTQELNDMMFVDTTRHQVPLSNNKDDFFQYETQSLSAISDHNPELAMAATPTKKVVDEVPNHDSQAEMPVTLVQLRSFQMIIFLNNFFLLSSQLPRSISRMNE

SEQ ID NO: 111736 - protein, 298 aa, Glycine max
  Coding DNA Sequence Number=SeqID_20051
  Gene Ontology: Mol. function=helicase activity; Cellular component =chromatin; Biological process=protein amino acid phosphorylation
  Homolog annotation: Hit_ID=A2Q378; Match level="QueryCoverage=90%, HitCoverage=19%, E-value=1e-64, Identity=43%"; Hit description =Putative uncharacterized protein
MDKSLKVGEDEWRERERERRSTKFYASNKEYVEAIKEAKNWGTGHYFRKLFATMLITGSINKLEEVWKQTWHWLADDILYYQRRVLHDEALQLSDDELKNLTLLEIEKLLCSSGKSLKDYPPMPFTTTEFPNEKLQIFNQVMQVVIEEKGGMFFLYGYGGTGKTYMWRTLASALRAKKKIVLTVASSGIASLLLPSGRTAHSKFRIRVPTLDDSVCNITQGSDLAELLKVTSLIIWEEAPMAHKFCFKALDKTLNDIMKISDNSDTVLGGKTVVFGGDFRQILPMIPRGTRLDIVLDK

SEQ ID NO: 111737 - protein, 169 aa, Glycine max
  Coding DNA Sequence Number=SeqID_20052
MVRSQFVVVVVGCCGATIQEMDEDQWRYENIMSEEVNMNKDNEEEPGVFENINCSDVFHTSQVFATRDDVLHWACFVAYDIGFVTVCLNQIAAEFERVKYVGIDRSRCGCIMKTTHGLSYQCLSEPEVSITEEIEAISRRFKELDVKTKGAQKKRMTKQQRSMKHDPSH

SEQ ID NO: 111738 - protein, 100 aa, Glycine max
  Coding DNA Sequence Number=SeqID_20053
IAPTRRPVDPKKSNRALGFPALVTGLCQSYRVPVPPARSCHRDIGIAPTKTPSGNEIVPARHPVDPKKSNRVLKFSSSNYGSLSVLRSTCHLQQGNQAPY

SEQ ID NO: 111739 - protein, 356 aa, Glycine max
  Coding DNA Sequence Number=SeqID_20054
  Gene Ontology: Mol. function=nucleotide binding; Cellular component =mitochondrion; Biological process=response to cold
  Homolog annotation: Hit_ID=Q9SD94; Match level="QueryCoverage=88%, HitCoverage=81%, E-value=2e-59, Identity=37%"; Hit description =Putative uncharacterized protein F13G24.100
  Pfam annotation: Domain name=mTERF; Domain location=89-354; Score =68.4; E_value=2.4e-17; Accession=PF02536.5; Description=mTERF
  Subcellular localization annotation: CTP_CleavageSite=88; ConfidenceScore=5.29e-01
MLPHFLITRLTSSFTHYKSTQIPLGSLLQHRHYVFLFSFNSFTSGRDNHKGVTFTVSYLINSCGLSPELAYKLSNGVSLKTPNGPNAVLDTLKDYGFSKTEVAKLVEKHPRVLVANAEKTLLPKLQFFHSIGVSNTDMSKMIIKNPLILRRSLAKFLVPLCRMIRRVVHDDLEVVKVLRKSPFAFTYADMVNGLVPNIEVLRQSGVPQGSISLLMVHFPSVAYGKHSRFVEAVKRVKKFGFDPLKTAFVMAIQVLYNMRKLALELRFEIYERWGWNREMALQAFVKYPNFIKLSDEMVTKKMNFLVKDMGLSPEYIAAYPTVLGYNLEKRIVPRLSEDLPLLPDVYKGLIHHENVI

SEQ ID NO: 111740 - protein, 120 aa, Glycine max
  Coding DNA Sequence Number=SeqID_20055
MAELLMDETALPCLSGCDCDMSNANTSPGIKFESAYCVKVSYTRCPICPQFKGVFGTALLGTLFNKYMTVFKAYIHKDMGKVKLINILLIISIKVQLRLSDTPFCCGVLGIVYCAQMPRF

SEQ ID NO: 111741 - protein, 160 aa, Glycine max
  Coding DNA Sequence Number=SeqID_20056
  Subcellular localization annotation: CTP_CleavageSite=48; ConfidenceScore=5.22e-01
MGSFPNYFQHGTVIYVKTMHAGPKPPEPVASLVSLSKSPAPMTIRACREETVSPNGDMLSALGTASQTGEFHGLRLQATSCHGSVAGSVQAKPLLPLAVCLAQGLPRNRYYHWRVAWFEFFWPSSIIKAEASGVLCFTLGTRFLSSSYYVSSLCLVNVRF

SEQ ID NO: 111742 - protein, 312 aa, Glycine max
  Coding DNA Sequence Number=SeqID_20057
  Homolog annotation: Hit_ID=A7PJW5; Match level="QueryCoverage=93%, HitCoverage=92%, E-value=1e-36, Identity=34%"; Hit description =Chromosome chr12 scaffold_18, whole genome shotgun sequence
  Pfam annotation: Domain name=BSP; Domain location=68-298; Score=78.9; E_value=1.7e-20; Accession=PF04450.3; Description=Plant Basic Secretory Protein
MEEEDNHSHLQPLIPYYSTLSFSSHSLQQHFADKNAKHFTSDSNNIVLRILSILLLALISLWANYEASKTFHITVVNDAKDSPAGRRFALSYVSNDEASRILLNTSSYVEHFLYPNSNNNDSNYPKKHIDSVTLQLPRRNLNVTDIVAVYTAAGNHLQRGGGKCFSYVIEISPTLLEDQRYDKIAIVGAILRGMAKVWIWEGAPQGLVDGMAEYVAEMAGFRRGMVSGGGEMPQCREGGGGWWWEDKDPSHVARLLHYCEKFKKGFIQRLNEAMRDTWHDRVVDEVLGMPVMELCGRLYNDNNASWVGSISM

SEQ ID NO: 111743 - protein, 105 aa, Glycine max
  Coding DNA Sequence Number=SeqID_20058
MAKERGFPLRERLKLWISTLESSETHLLFKLTLHLARLCAISAHWASPRGPSRAEPDLRAERELRAERDITLSLELLVKRVLRAEPTVQFFFTSFSSTLFSSNSL

SEQ ID NO: 111744 - protein, 204 aa, Glycine max
  Coding DNA Sequence Number=SeqID_20059
MSCEGVVVEKGFEDNKVDAGKWVGEQVIPLKDKVQVTVDLRVLESRYNRKLGIFQGSFVGYGRQDVLTTVIRLPVHIGCVRVAGASVTTRQYFGQASTGSHTSTSISPKDDETTNVVIQADAVQGIVHPIEPEVAPYGARGSTTAHHVPLGNDMVKVGVKEVRDVDARVHVSTEEDKQVPKRPIKPADRSEPDDNLIYQMALMT

SEQ ID NO: 111745 - protein, 183 aa, Glycine max
  Coding DNA Sequence Number=SeqID_20060
  Pfam annotation: Domain name=DUF593; Domain location=12-71; Score= -26.6; E_value=0.028; Accession=PF04576.6; Description=Protein of unknown function, DUF593
MEAANGVVSKKIEALERENAAKKDEIRRLKKEIDSLRREAAELRDSETSAALKNLLEERERTVTFLERETESLKQLKAESEMKVRDLERKLSVVEVRESEERSKRVRAEEETKEKVGEKEREIEEMRQRIEDLEKVRVVEMREKGERVDGEWTKWLGIVWPVVATGSGAVAAVFYLCFRKRSR

SEQ ID NO: 111746 - protein, 338 aa, Glycine max
  Coding DNA Sequence Number=SeqID_20061
  Homolog annotation: Hit_ID=Q5XM22; Match level="QueryCoverage=27%, HitCoverage=52%, E-value=2e-18, Identity=49%"; Hit description =Resistance-like protein HAAS-2
MIERNMPTAFTRRQRQQVRDVEDPSTACEGIERRAITTTHVEEGVTNVKGFPGGPHDTSVLRDFENHIALRVWNGDFHLPIREVTITLDDVASLLHFPIVRAFHSFKQLHVDDIVNLLVELLEVSTVEARVETIYCHGSYVRLSWLRDVYQTKIEACHWIVAARAYLLHLLGCTLFANKSVTHVHVVFLDALRDLTQSETYAWGTVCWIYEHFPSVGFALVAEDYDERRSPACQWTSGKALPVSTYRRRLDRLTLDVMGSLDDHSLTGENCTIVWQPVATTTPDEADVDVHHPGHAVDDYVAIVDKLDRLLNLRILIEGIEVYTVTEECLSITRSYIG

SEQ ID NO: 111747 - protein, 66 aa, Glycine max
  Coding DNA Sequence Number=SeqID_20062
MRSNTNISVRGRASFLLIACERSGRLTKDEKIVVVDMTKSMVKPRNILLTLKEHNANSCTTIKGIL

SEQ ID NO: 111748 - protein, 88 aa, Glycine max
  Coding DNA Sequence Number=SeqID_20063
  Subcellular localization annotation: CTP_CleavageSite=66; ConfidenceScore=5.38e-01
MAWAQSEGTTMSLIGQHNRGVRVAVFVVVTTNLIKLESLRKLMRVPKTRLVDSTRRLRARVRLRSRCAFVESHSESKNENESESESER

SEQ ID NO: 111749 - protein, 309 aa, Glycine max
  Coding DNA Sequence Number=SeqID_20064
  Gene Ontology: Mol. function=phosphoinositide phospholipase C activity; Biological process=intracellular signaling cascade
  Homolog annotation: Hit_ID=A7UQU7; Match level="QueryCoverage=54%, HitCoverage=28%, E-value=6e-25, Identity=39%"; Hit description=IMP dehydrogenase/GMP reductase, putative
MPGLRQGSVVDPMYACNGYVICISADASATHVHVMFLEALRDLSQTGRYAWGVAALVHMYDHLNDASVTNSRQLGGYITLLQCWIYEHFPSVAESTADPDYDEDSPRACRWIATKKIVKSIRTLTYREHLDRLQILDVCWIPNGEHRSIRDFHLISCYSGLLYWGPVAVYYWPKRVMRQFGYTQTIPAPPVNSWVSYDDIHDRWMHYLEHMVTAAEASDPLPDHHALQPPVVPPKPGAPSTSTVDEPRHAVEVCSDIVERLKRHLSLGVVTPGSSTHDVIEECIRMARSVTQDQLVYVRSRHRQRTYQA

SEQ ID NO: 111750 - protein, 305 aa, Glycine max
  Coding DNA Sequence Number=SeqID_20065
  Subcellular localization annotation: CTP_CleavageSite=39; ConfidenceScore=5.44e-01
MATPLSSLPPPPESATPSSPALKKTRKTTQLKPLTTRPVGAERPVVHEDPATRKADGPHRKKLRTYLRIVARDKSRRDLSWEDVQKKAHAIQKQNIASHVLSRKGYDYLEQKGSFIAHGHLDVLTTAIGRPEHPRSVHAAGVDVMIKQYFGMTSRRSRTSMSMAPKDLEHMTQKIKDHLEELITYKMQSQMQSQGLALPPEPKVGPSAACVSTKESCVDPSGQDPDTDSESLTIIHNIPMGNDQVKVGVNEVQDADARDKQCSKGSTKLADRPDPYVDPQYLMTLTIPQLFLKPLLVSWDVIVFG

SEQ ID NO: 111751 - protein, 114 aa, Glycine max
  Coding DNA Sequence Number=SeqID_20066
MDDPFIYRSSPITSYGLDVNRQGPYGAWHKSWIIDSWKRGDEVLHINEGDKESDDIERRGKGIGEDDGGGGRRRSPDIGSDGVSGDGGARDRAAVSVREDRDLDAGICCGVFLI

SEQ ID NO: 111752 - protein, 74 aa, Glycine max
  Coding DNA Sequence Number=SeqID_20067
MYLATGNRLHPLYCLEFLILKSPFASIATHHHDHHQNIKALHLHCDSSDLKFEFLCLIYRWAGAWWWPTPLNKS

SEQ ID NO: 111753 - protein, 182 aa, Glycine max
  Coding DNA Sequence Number=SeqID_20068
MELIENMTTSDHAILRDRTHIPTKRSLLELSSQDALLAQNKLLAKQLESLTVTLSKLPTQLQAAQPTHSGVMQIEGCSICGGAHESGGCMAQDDAFKEVNYMANHNRKGFHTGGFSGYQQGGNFNHNQGQGWRSHLGNQFNKDQGGSSNRPLNQGPNLYDRTTKVEDILTQQLKTWKSKWDM

SEQ ID NO: 111754 - protein, 70 aa, Glycine max
  Coding DNA Sequence Number=SeqID_20069
MDPITILVVQNSSPLKGVTRELRCKGFYSKLRHDFEIPNDENPRNWVGNRVLKFHDDPTVNEFEIVIFMR

SEQ ID NO: 111755 - protein, 338 aa, Glycine max
  Coding DNA Sequence Number=SeqID_20070
MASKKRRASSSKPQEPYDTSRFVSEIAWEQYETNVHHRNILLERNIELTYPYYDEFLRELERHQWHKNLTRQMENHIDLALVKEFYSNLYDPKDQSPRQCKTPMVLEPGKRYSSYSRYCHTHPDHQDIATKLSIPGRGFVLNAEGAPWKLLRKDLTTIAQTWSVLSYSSLAPTSHTSDLNMDRARLVYGLVMQMDMDLGSIISGQISQIAYPTINLAYIRKNCWNPEDSSIAFLGSCKAKARAPSDVPVTAPAPAPTPPTPIPAPAWPSVPNSDPIMSMEEYLAQAVEGTLEGKEAAEDTPEAEEASGAADVDIDDDYVANATATQGTWDPWPTPAQD

SEQ ID NO: 111756 - protein, 71 aa, Glycine max
  Coding DNA Sequence Number=SeqID_20071
MNPPRFETPTPSPPDTHKRILLCIFLNFPIATTMNPPRFETPTQKKYLKKEEVSFAANGITAAGLRAFSLA

SEQ ID NO: 111757 - protein, 96 aa, Glycine max
  Coding DNA Sequence Number=SeqID_20072
  Subcellular localization annotation: CTP_CleavageSite=39; ConfidenceScore=5.30e-01
MQPLNSIANGNPNNKIIIITKQKKGRKRRTVRKNRFDSVCGACKERKRGLEENPNRKVKEGGRRRRGRGRRSGTLRGEQCGHTGVAASYSSALVES

SEQ ID NO: 111758 - protein, 104 aa, Glycine max
  Coding DNA Sequence Number=SeqID_20073
MEDQTIEDIDKVEKSTPKEDNGVADFKLVQPPIQNQNTDVQNDVGVQQPEDEVDVFADDDDEEEHDMSQDENLEAMESEEKTKWLDAMKFEACCEIVDLAVTPT

SEQ ID NO: 111759 - protein, 93 aa, Glycine max
  Coding DNA Sequence Number=SeqID_20074
MFFPALSPDSVDNRITAFDWHDRFPDWKAGSERNAINEVHVDLGRGGWSTGSPMGFRSLAAPCNGLGRGNGDAYASIGDWDMVVVIVLGKEKG

SEQ ID NO: 111760 - protein, 64 aa, Glycine max
  Coding DNA Sequence Number=SeqID_20075
  Subcellular localization annotation: CTP_CleavageSite=41; ConfidenceScore=5.62e-01
MAEPSKKRKGSSSTASAAAHRHHGPSGAPTAPIPSSLSSPRSSTLFSSDDQRLRWLSSSKRRRM

SEQ ID NO: 111761 - protein, 307 aa, Glycine max
  Coding DNA Sequence Number=SeqID_20076
  Homolog annotation: Hit_ID=A5B5V0; Match level="QueryCoverage=78%, HitCoverage=54%, E-value=3e-12, Identity=25%"; Hit description =Putative uncharacterized protein
MEFFSNENFECFQAFENSNLIPFMSPKLPVYSELVKAFYSNLEIHDDVLMSEIYGIKMVIDQSLFYDLTKLPSEGVPFEGALIDEWKFDFSVHDARRLVCTNQADMTGRLLAGSLAFECRILHYLIVCILLPRSSNLAQVSKEDLIVMWAFHKGLQIDWAHLVRYRMHKALGLNAPLPYPHLVTLFLQHFNIPLDSEPYVPIKRSFLIGASVIASFGYIKEHDGSWVKKGARNISEEGHEGEDSSLLSKILERFDGLQTFVGERFDTLELQVDMRFNEMESRMTRVEEDVSYIRSSFDLPPPSPPSS

SEQ ID NO: 111762 - protein, 98 aa, Glycine max
  Coding DNA Sequence Number=SeqID_20077
  Homolog annotation: Hit_ID=A7P1N0; Match level="QueryCoverage=100%, HitCoverage=90%, E-value=8e-18, Identity=43%"; Hit description =Chromosome chr19 scaffold_4, whole genome shotgun sequence
MVSSIYTLMCVLHSTIALTCGALMIFYSKEISVLGHRSETASKLQGTTPHDQLLIDTSDSFSGLLLFTIGFLLLMRKLGDLAHEWPRHAVGDIALAIS

SEQ ID NO: 111763 - protein, 60 aa, Glycine max
  Coding DNA Sequence Number=SeqID_20078
MTYMYDDLRHAFHGQTARGQYEGDSLHDASSTASRRGFKERGERQICYDTPYPKMVAGTL

SEQ ID NO: 111764 - protein, 177 aa, Glycine max
  Coding DNA Sequence Number=SeqID_20079
MMHRKNVHKCLKWDKSRAGYLDLPSGYPTFSSYTQHFSCHYEFAIRKTITSSQSVRPWTSAARLTLTKYAAGGDLAHAMPTPSPSLASATMRISIASSDTGTEMPLGGTKGRAMAMKEVVVLRRIGGWSEAQWRGWSEGQWRWRGGGGVATWQRWRSKVGEEEVGKVLTLRIRHYGL

SEQ ID NO: 111765 - protein, 101 aa, Glycine max
  Coding DNA Sequence Number=SeqID_20080
MDKNKWIYDIIMSKEDNMNEENGEEPSVFENIDCSYVFHTSKVFATRDYVLHWACTVTYDIGFVAVIMKLDTNTENKGRISYVLIGCERSGRYRAYRKNLV

SEQ ID NO: 111766 - protein, 101 aa, Glycine max
  Coding DNA Sequence Number=SeqID_20081
MYQYPFEGHQTNASASKYSLDGVVETHPDFSCPTMTPSQQYDVPISTLNPPLGTQWDVPGAIPDMSDLLGVDLRHQFSAKADQVEVRRHRGSRNLDRQARR

SEQ ID NO: 111767 - protein, 150 aa, Glycine max
  Coding DNA Sequence Number=SeqID_20082
MAKRKSVDETTTFSKKAHQYQNTPQTAIQKRNQPQLQNHTKNAKGQNLTKTYFKKSEKEEEKQHQQYLLEVRGSDSAIWGDFDLVLLAGPLVDDGDSTLQVHRRRGSGGGGEAVGAEDRGGGGGVGGKQVSCEGGQTVACSLFGRRSCCF

SEQ ID NO: 111768 - protein, 417 aa, Glycine max
  Coding DNA Sequence Number=SeqID_20083
  Homolog annotation: Hit_ID=Q2HVW1; Match level="QueryCoverage=28%, HitCoverage=49%, E-value=8e-11, Identity=33%"; Hit description =Putative uncharacterized protein
  Pfam annotation: Domain name=RRM_1; Domain location=75-145; Score =26.1; E_value=0.00013; Accession=PF00076.13; Description=RNA recognition motif. (a.k.a. RRM, RB
MDREENLHGGKRINVQGRVNTLADEDNWTTVVTRRSAKAMKKQSLTGRQSKNLESGGHSKHYSLNWRNYADITSFYFTHFPEEVNEELLWGYFKKWGDVREVYIAKRLNKEGRRYGFVRFKGVSGVKGLEVRLDNIFINDCKLFVNLPRFERPAMKKDLQQKSSNGRKSFDGPSKHCGATTGPPRRSYADITTNGAYTGGTKREEATITTILINPEEDRGYWCKEAWVGKLKKVMEVGTLEDRIAWELGYNTRTKFLEDDMVLLPGMPDQKAQHIIRSEMESGNSLFYSLEKWTPDCRPNNRVIWLQVWGFPIQVWELDHLRKAVATIGDVIELDDDTEDRYRLDRARLLVRTPLPPSIRTEVHIHVGDLEYRVWIVEEMGLEVGLTRKANSPSEGWSEEILSDDVIDDGDTSSSFS

SEQ ID NO: 111769 - protein, 435 aa, Glycine max
  Coding DNA Sequence Number=SeqID_20084
  Gene Ontology: Mol. function=carbon-nitrogen ligase activity, with glutamine as amido-N-donor; Cellular component=cytoplasm; Biological process=translation
  Homolog annotation: Hit_ID=A7PJP2; Match level="QueryCoverage=93%, HitCoverage=79%, E-value=1e-163, Identity=70%"; Hit description =Chromosome chr12 scaffold_18, whole genome shotgun sequence
  Pfam annotation: Domain name=Amidase; Domain location=45-435; Score =471.3; E_value=1.2e-138; Accession=PF01425.12; Description=Amidase
MGHVEDNMTVLGCVTLILIFGSRKTWSEILSIRHVLLSRRASAADLVLSHLARLRLTEPHLPDDDVLLSHARRLDAQIAAGEDPGPFAGVLVGVKDNICTADMPSTAGSRILEGYRAPFDATAVKRVRELGGVVVGKTNMDEFGMGSTTEASAFQVTANPWDESRVPGGSSGGSAAAVSARQFVVSLGSDTGGSVRQPASFCGVVGLKPTYGRVSRFGLMAYASSLDAIGCFGSSVADTGILLHAIAGHDRFDATSSKQGLRVGLICETIDDGIDAGVISAIRAAALHFEELGCSVNEVSLPSFSLGLPAYYILAVSESSSNLSRYDGIRYGNQVYADELDSLYGGSRAKGFGSEVKMRILMGTYSLSAGYYDAYYKRAQQVRTIIRNSFKEALNQNDILISPAAPSAAYKIGEKKNSPLAMYAGDIMTVSISFF

SEQ ID NO: 111770 - protein, 33 aa, Glycine max
  Coding DNA Sequence Number=SeqID_20085
MEILASILMLLFLLVFLSQDWVIVLKHTFHEVI

SEQ ID NO: 111771 - protein, 596 aa, Glycine max
  Coding DNA Sequence Number=SeqID_20086
  Gene Ontology: Mol. function=aspartic-type endopeptidase activity; Biological process=proteolysis
  Homolog annotation: Hit_ID=A7R819; Match level="QueryCoverage=79%, HitCoverage=42%, E-value=1e-66, Identity=29%"; Hit description =Chromosome undetermined scaffold_2171, whole genome shotgun sequence
  Pfam annotation: Domain name=DUF755; Domain location=333-432; Score= -36.0; E_value=0.026; Accession=PF05501.2; Description=Domain of unknown function (DUF755)
  Pfam annotation: Domain name=zf-CCHC; Domain location=442-459; Score =29.4; E_value=1.3e-05; Accession=PF00098.14; Description=Zinc knuckle
  Pfam module annotation: Pfam domain module=DUF755::zf-CCHC; Domain location=333-432::442-459
MAIPFKTKDVNEEVTSKDIKSLMEQANYTNKYLQALGETIKTKVVPKQKSIEEASPSVPIEKTLFKPFKVSEKAKRKIRELRKTKSLIEGVGDNHSELLNKIGCLLKVIPDTPQASENTSKMVTRSTSKLINVINEDSDQNSDNTTEIGSVSEKNINPLNSKHWKTPSKLYYQRPTAPDLLLEERGENNFKSFSANNIYEWNIDAQTEYNIMNTLQHMTMEKSKIYSAVKTDLNGKVITNDDDKEIPDAVNTLIFTIAQHFIGDPSLWKDMSVELLSNLKCRTLADFRWYKDTFLTRVYIREDSQQPFWKEKFLAGLPRSLGDKVRDKIRSQSVNGDIPYENLSYGQLISYVQKVALKICQDDKIQRQLAKEKAQTKRDLGSFCKQFGLPACPKQKKKRTSRKEAQDHKPANRRRFSKRRYSQKPSTSREMENPKQKIKPKITCYNCGKHGHISKYCRLKKKLRNLNLEPSIEEQINNLLIETSEEETETETSSSVLSDENLNLIQQDDQLSSTDDDGQINTLTREQDLLFEAINSIPNPQEKKVFLEKLKKTLEVKPRQKDFITNNKFDALIPEISDNERWEVRSADEVGILEIC

SEQ ID NO: 111772 - protein, 511 aa, Glycine max
  Coding DNA Sequence Number=SeqID_20087
  Gene Ontology: Mol. function=neuropeptide hormone activity; Cellular component=extracellular region; Biological process=neuropeptide signaling pathway
  Homolog annotation: Hit_ID=A5C2P6; Match level="QueryCoverage=94%, HitCoverage=70%, E-value=5e-91, Identity=39%"; Hit description =Putative uncharacterized protein
MATLFATFYLKVLETRDVDELVLANWKSQGVTGSMSMLEDNEVLFFMIQVGSYVSKWITIKNPSQHPMVMQLILNSREIINECRDLDDLLHPSSSSNLVLDEGATSEKYGFSIPENALTEAYVHPHDHGYGGLLSLVLLERSEHVDNVDFDLKMPKTLNFSLPYTLLHMKEISSACSQHLVKELYAKNTGDLPLEVKSIRVSGRECGLDGFKILSCKAFAIEPGESTKLLISYQTDFSTAVVHQDLELILATSIFLLPMKASFPYYMLSSYKRSIGDNLIHTTIKSVEKTLMLHHDQRKSKLSMSNEMNHLIEASSGKYSYVQGNPFELEISQQLTHKFENHEQTSHALDIQSERKLSSSTVQNSDPMEASQLGYLTVKTGKEKGRRRKRKSLGAKLVAFSEVSSSQSGNSTPLSPLSHTPSTTPKCNWPMSPDEEQPPKAPSSMTQVATQHSANDQASATVVVSNILKPASTQRCTNSKVSHSAARSATSFLKYHKYCFMTKTSIVFTHL

SEQ ID NO: 111773 - protein, 201 aa, Glycine max
  Coding DNA Sequence Number=SeqID_20088
  Gene Ontology: Mol. function=transporter activity; Cellular component= mitochondrion; Biological process=response to nematode
  Homolog annotation: Hit_ID=A9NVU0; Match level="QueryCoverage=86%, HitCoverage=29%, E-value=1e-83, Identity=85%"; Hit description =Putative uncharacterized protein
  Pfam annotation: Domain name=Na_sulph_symp; Domain location=1-201; Score=-98.3; E_value=7.3e-09; Accession=PF00939.10; Description =Sodium:sulfate symporter transmembrane region
MFVEVLLNIQSQCKADHRTYVHLLYSQVGLWVFGGLLNIDAVSAAILGLSVLLVTGVVTWKECLAEGVAWDTLTWFAALIAMAGYLNKYGLISWFSQTVVKFVGGLGLSWQLSFGILVLLYFYSHYFFASGAAHIGAMFTAFLSVATALGTPPFFGAIVLSFLSNLMGGLTHYGIGSAPVFFGANYVPLAKWWGYGFLISI

SEQ ID NO: 111774 - protein, 290 aa, Glycine max
  Coding DNA Sequence Number=SeqID_20089
MAINSSIPFQHQFLHDERGEHILPPIPIPSRDPNHTNCNNNNNNISGHDLKPPELLIPVPNMPHFMPQDNTKFDSSSIGSDHLESLWDSVSSPQSTLSSTLISIQGSSEDSSQEPSPNSYDFCWNSTYDVVEMLEKMKLDERDSSKYNPGYGNHRLEISNVGACSLLHEQIQAIQLSRVRQEQILSEKHKLTAYRGKNHGQISQQFQKKVKGIDDGCDKGWRTRPPWHNRSHQQAGSRGKSCGTGVFLPCGRTSAPLESRKRPGSVSVALRIWRCFIISYNCLFAGRRLR

SEQ ID NO: 111775 - protein, 60 aa, Glycine max
  Coding DNA Sequence Number=SeqID_20090
MPSVHHVKCPTRMADTPPSIQIIWPVMYDDAGKQRKATREETSAGSPRRLSGVLEYTSSR

SEQ ID NO: 111776 - protein, 115 aa, Glycine max
  Coding DNA Sequence Number=SeqID_20091
METSQAQTLMDYLTPTLGDTNPILLPELLKEVIFDFKYEFLQMLENNLFSSATHEDPMHGTGYAHYLRTTSPHGTSAQGNLMLKPPIDAIEIIEDMCSNPCNNSGDMRIMKRGVN

SEQ ID NO: 111777 - protein, 483 aa, Glycine max
  Coding DNA Sequence Number=SeqID_20092
  Gene Ontology: Mol. function=sugar:hydrogen symporter activity; Cellular component=integral to membrane; Biological process =carbohydrate transport
  Homolog annotation: Hit_ID=A7NYV4; Match level="QueryCoverage=88%, HitCoverage=89%, E-value=1e-138, Identity=57%"; Hit description =Chromosome chr6 scaffold_3, whole genome shotgun sequence
  Pfam annotation: Domain name=MFS_1; Domain location=107-432; Score= -0.8; E_value=0.02; Accession=PF07690.7; Description=Major Facilitator Superfamily
  Pfam annotation: Domain name=Sugar_tr; Domain location=103-481; Score= 122.6; E_value=1.2e-33; Accession=PF00083.15; Description=Sugar (and other) transporter
  Pfam module annotation: Pfam domain module=MFS_1::Sugar_tr; Domain location=107-432::103-481
  Subcellular localization annotation: CTP_CleavageSite=58; ConfidenceScore=5.53e-01
MASTSLFNFRLPLFNFNPLHHRRIKRPKSLLSSPRNSPRLVSSINDHLALTRVTYPLLQSHSAPKRRFHVGVQKEYSDGESSESIVSDATYQEEFSWSSVVLPFLFPALGGLLFGYDIGATSGATISLQSPELSGISWFNLSAIQLGLVVSGSLYGALLGSLVAFAIADFLGRKKQLITAALLYLFGGVITAYAPELGVLLAGRLIYGLGIGLLGYFVGSFLIETVGGWRFMYGFSAPVAVLMGLGMWTLPNSPRWLLLRAVQGKGSFQDLKEQAIASLSKLRGRPPGDKESEKQIEETLVSLKSVYADQESEGNFLEVFQGPNLKAFIIGGGLVLFQQSAGFSAASDATKVSVVIGLFKALSLVLLSAYYKFLGGFPLVAVGALLLYVGCYQISFGPISWLMVSEVFPLRTRGKGISLAVLTNFASNAVVTFAFSPLKEFLGAENLFLLFGAIATLSLLFIIFSVPETKGMSLEDIESKILK

SEQ ID NO: 111778 - protein, 361 aa, Glycine max
  Coding DNA Sequence Number=SeqID_20093
  Gene Ontology: Mol. function=metal ion binding; Cellular component =cytoplasm; Biological process=cell redox homeostasis
  Homolog annotation: Hit_ID=Q2HS43; Match level="QueryCoverage=78%, HitCoverage=81%, E-value=7e-88, Identity=56%"; Hit description=Zinc finger, RING-type; Thioredoxin-related
  Pfam annotation: Domain name=DUF1117; Domain location=242-360; Score =117.0; E_value=5.5e-32; Accession=PF06547.3; Description=Protein of unknown function (DUF1117)
  Pfam annotation: Domain name=zf-C3HC4; Domain location=182-222; Score= 43.1; E_value=9.6e-10; Accession=PF00097.16; Description=Zinc finger, C3HC4 type (RING finger)
  Pfam module annotation: Pfam domain module=DUF1117::zf-C3HC4; Domain location=242-360::182-222
MNLDTQPGTPSYWCYSCTRFVHLSVQATIACPHCQSGFVEEIRAGAEASPRHRLSPFPDDPLSFRRQGFRRRRREGAGNRSPFNPVIVLRGPGDDSAAADHDGASTFELFYDDGDGTGLRPLPPTMSEFLLGSGFDRLLEQFAQMEMNGFGRPENPPTSKAAIESMPTVEIGETHVETDAHCAVCKEVFELHAEARELPCKHIYHSECILPWLSMRNSCPVCRHELPSDLETRVPSQIDEEAIGLTIWRLPGGGFAVGRFSGGRRTGESHLPVVYTEMDGGLNTNGGAPRRISRSVRSNRVRESRGFGRVFRNFFSFFGRIGSRNSSSSSEHGSVSRSRSHVSSMFNRSSRRHSRTWVMDD

SEQ ID NO: 111779 - protein, 131 aa, Glycine max
  Coding DNA Sequence Number=SeqID_20094
MEGFFCEKLLGIVVLEVEELFWDKLLIKRGEFEEEEEEEPLVEQLLENNDDLLDDVLEPASFFDTFHFSSMKNKGTVISTTSYGTECVCERERESENGKVCTPILPMLELSKLYHFTKLVSVQLAQDALLP

SEQ ID NO: 111780 - protein, 140 aa, Glycine max
  Coding DNA Sequence Number=SeqID_20095
MATATLPNTFETTSNANTVHDPLPIIETTFYLLQYLFHEALNFVNADVEERCWPILLVFNSIFFRRMDSDKHPQITNQLMIIRTSIHKLSPLTEANKVWNIRKKKRINPKVNTMSSENISIGNSLTYYISKININKTAIS

SEQ ID NO: 111781 - protein, 131 aa, Glycine max
  Coding DNA Sequence Number=SeqID_20096
MATATLPNTFETTSNANTVHDPLPIIETTFYLLQYLFHQALNFVNADVEDRCWPILLVFNSIFFRRMDSDKHPQITNQLMIIRTSIHKLSPLTEANKVWNIRKKKRINPKVNTMSSENISIGNSLTYYISK

SEQ ID NO: 111782 - protein, 83 aa, Glycine max
  Coding DNA Sequence Number=SeqID_20097
MQTITGKSFQVQANLAMQQQIINMKFSDQWKKLPANSRNAERKSDTDPNVVGLNEPLIQDEDGKKRWGRVYVRKKPRMGDVAH

SEQ ID NO: 111783 - protein, 989 aa, Glycine max
  Coding DNA Sequence Number=SeqID_20098
  Gene Ontology: Mol. function=protein binding; Cellular component =nucleus; Biological process=regulation of transcription
  Homolog annotation: Hit_ID=A7NYY1; Match level="QueryCoverage=86%, HitCoverage=95%, E-value=0.0, Identity=51%"; Hit description =Chromosome chr6 scaffold_3, whole genome shotgun sequence
  Pfam annotation: Domain name=GRAS; Domain location=347-653; Score =466.1; E_value=4.4e-137; Accession=PF03514.5; Description=GRAS family transcription factor
MDPHIKSNFINGVKPSQVPNTVDAEDHFFDPVNGMMKPFDFRLMDNPFLIPPDPNAAQNPFSLSNDEDSPVDEIDFSATVLRYINQMLMEEDLEAKPCMFHDSLALQAAEKSFYEVIGETYPSSSSSSSIQNYHNVDSPDESSFSGTTTSTGNSFGSQWNNVDLADYKPSILQTTFPTDFVFQASSIQSSMNTTSKFAVTNSEFLASSAAGFLGPGSTNLFSKSESVLQFERGVEEANKFLPKGNPLVIDLENPSFRMVPLQQEEIKAERDIDEISAESRGRKNHEREDEETDLQDGRSNKQSAVYIDDSEISELLDKVLLGTWCRNEPAPSCIGYTDLPSGPSLGKLEETNKSGGGKSRVKKQGNKKGVVDLRTLLILCAQAVSSDDHVSANELLKQIKQHASPLGDGTQRLAHCFANALEARLAGTGTQIYTALSHKRTSAADMVKAYQMYISACPFKKLSMIFANHTILQLAKEVETLHIIDFGIRYGFQWPAFIYRLSKQPGGPPKLRITGIELPQPGFRPAERVQETGLRLARYCDRFNVPFEFNAIAQKWETIKIEDLKIKENELLVANAMFRFQNLLDETVVVNSPRDAVLKLIRKANPAIFLHATVNGSYNAPFFVTRFREALFHYSTLFDVLDTNVAREDPMRLMFEREFFGRQVMNIVACEGSERVERPETYKQWQVRNMRAGFKQLPLDKHLINKLRCKLKGVYHSDFMLLEDGNYMLQDSFGGFPIIDPSSLEDNNDFSETAKFIMIMKAAAKAETVHVIDFGILYGFQWPNLVKFLSDREGGPPKLRITGIEFPNMAFAPQKELRKRVATWLTISYDIVAVNCHWRFEHLLDEYTIENSPRNALFHYSATYDLIGTVLPRENEWRLMIERELLGREIMNITTGCFKVGSAAFCLLPLVGCQHNEKLLDSLRGIVPLALADHLSLEIFQHVAMVKLVLLVILFDVLVPTCLTFSCCGEDCTKLYIKLLRKIMARLFG

SEQ ID NO: 111784 - protein, 459 aa, Glycine max
  Coding DNA Sequence Number=SeqID_20099
  Gene Ontology: Mol. function=phospholipid binding; Cellular component= cytoplasm; Biological process=steroid metabolic process
  Homolog annotation: Hit_ID=Q93Y40; Match level="QueryCoverage=100%, HitCoverage=100%, E-value=0.0, Identity=79%"; Hit description =Oxysterol-binding protein
  Pfam annotation: Domain name=Oxysterol_BP; Domain location=29-431; Score=136.5; E_value=7.5e-38; Accession=PF01237.9; Description =Oxysterol-binding protein
  Subcellular localization annotation: CTP_CleavageSite=17; ConfidenceScore=5.08e-01
MGSPSKKNESKGFFAAMSSMFTSAVNRSVNGLSVEVINPEGGKEDAEEEAQRGRWKQEERDGYWKMMQKYIGSDVTSMVTLPVIIFEPMTMIQKIAELMEYSYLLDQADESEDPYMRLVYATSWAISVYFAYQRTWKPFNPILGETYEMVNHGGITFLAEQVTWDLAHNKVSHHPPMSAAHAENEHFTYDVTSKLKTKFLGNSVDVYPVGRTRVTLKRDGVVLDLVPPPTKVNNLIFGRTWIDSPGEMIMTNLTTGDKAVLYFQPCGWFGAGRYEVDGYIYNSSEEPKILMTGKWNESMSYQPCDSEGEPLPNTELKEVWHVADVPQNDKFQYTHFAHKINSFDTAPRKLLASDSRLRPDRYALEMGDLSKSGTEKSSLEERQRAEKRSREEKGHSFTPRWFDLTEEVTSTPWGDLEIYQYNGKYSEHRAAADNSGSIDDVDAKSIEFNPWQYGNLATE

SEQ ID NO: 111785 - protein, 31 aa, Glycine max
  Coding DNA Sequence Number=SeqID_20100
MVHTPNAQNVYVAPTFSHHIHYKNHVNMATL

SEQ ID NO: 111786 - protein, 550 aa, Glycine max
  Coding DNA Sequence Number=SeqID_20101
  Gene Ontology: Mol. function=transcription factor activity; Cellular component=nucleus; Biological process=regulation of transcription, DNA-dependent
  Homolog annotation: Hit_ID=A7NZT8; Match level="QueryCoverage=99%, HitCoverage=99%, E-value=0.0, Identity=71%"; Hit description =Chromosome chr6 scaffold_3, whole genome shotgun sequence
  Pfam annotation: Domain name=AP2; Domain location=163-220; Score =43.5; E_value=7.5e-10; Accession=PF00847.11; Description=AP2 domain
  Pfam annotation: Domain name=AP2; Domain location=262-314; Score =58.9; E_value=1.8e-14; Accession=PF00847.11; Description=AP2 domain
  Pfam module annotation: Pfam domain module=AP2::AP2; Domain location =163-220::262-314
MNNNWLSFPLSPTHSSLPAHDLQATQYHQFSLGLVNENMDNPFQNHDWNLINTHSSNEIPKVADFLGVSKSENQSDLAALNEIHSNDSDYLFTNNSLVPMQNPVLDTPSNEYQENANSNLQSLTLSMGSGKDSTCETSGENSTNTTVEVAPRRTLDTFGQRTSIYRGVTRHRWTGRYEAHLWDNSCRREGQSRKGRQGGYDKEEKAARAYDLAALKYWGTSTTTNFPISNYEKELDEMKHMTRQEFVAAIRRKSSGFSRGASMYRGVTRHHQHGRWQARIGRVAGNKDLYLGTFSTEEEAAEAYDIAAIKFRGLNAVTNFDMSRYDVKAILESNTLPIGGGAAKRLKEAQALESSRKREEMIALGSSSTFQYGTSASSSRLHAYPLMQHHHQFEQPQPLLTLQNHDISSSHFSHQQDPLHHQGYIQTQLQLHQQSGASSYSFQNNAQFYNGYLQNHPALLQGMMNMGSSSSSSSVLENNNSNNNNNNVGGFVGSGFGMASNATAGNTVGTAEELGLVKVDYDMPAGGYGGWSAADSMQTSNGGVFTMWND

SEQ ID NO: 111787 - protein, 81 aa, Glycine max
  Coding DNA Sequence Number=SeqID_20102
  Subcellular localization annotation: CTP_CleavageSite=27; ConfidenceScore=5.15e-01
MACISKSRAMFFFMAFFVGLLFAAGVSAQTSEFPQAPAPAPTMDAGAGFLVTYSGAFEGEETQLMSHFGKEKAERERDELM

SEQ ID NO: 111788 - protein, 24 aa, Glycine max
  Coding DNA Sequence Number=SeqID_20103
MAQQVEGRTWHLGLEPLNVRIGNG

SEQ ID NO: 111789 - protein, 66 aa, Glycine max
  Coding DNA Sequence Number=SeqID_20104
MRSKSTTSTWKLVIKINQEMGMKIPIDITSNNYILFYTNAIRGVDRLIQATEVWMTPLPVKEDKSG

SEQ ID NO: 111790 - protein, 183 aa, Glycine max
  Coding DNA Sequence Number=SeqID_20105
MNAQVEKDEGPEAETLSRLLITYQGNPCGVYPDLSSLTGSGVYPDLSSFTGSGVYPDLSSFTGSGVTSETLDIEQWMQLSNSNGHNNSLGGPIQEHNISRCTKLNNGSSREIQMLITFHTESSDSSASHIETLEMEQRKFSRNSNGHNFSFGGSIQAHNISRPSKLSNGSSRKITMVTTLHSE

SEQ ID NO: 111791 - protein, 141 aa, Glycine max
  Coding DNA Sequence Number=SeqID_20106
MASMHEPEIKENKLKDEIFNLNKDPNEIFVNDSLKKAIKIEEDEDSFDKIVDDSSVASEDENEVGETFFRRKHKTWLEEDLTENKEVCSNGCAPLSSSGFVNNNLVYLNKYPDDVHDFGFESEDMNKNVLSMLKIYFDIFY

SEQ ID NO: 111792 - protein, 44 aa, Glycine max
  Coding DNA Sequence Number=SeqID_20107
MVNLFEIGAGIERQRSLQWQGILLMYCRRSNLPCHLPCVSPNSF

SEQ ID NO: 111793 - protein, 122 aa, Glycine max
  Coding DNA Sequence Number=SeqID_20108
MHVIGGMFVEALPQQSLAGEEFSTKGRREEGNKRKQRVAPPPKIAPSSGRQSAAVKEETVDPYILENFTGGTRWRKKELKGECRGSTTMKKPEKKKGKREVEQKKEKILVIDLKINTSSGVK

SEQ ID NO: 111794 - protein, 42 aa, Glycine max
  Coding DNA Sequence Number=SeqID_20109
MGGNWMIHSMHGDWVDEQSPLFLRATKVLAIPSTKEKKKKFR

SEQ ID NO: 111795 - protein, 206 aa, Glycine max
  Coding DNA Sequence Number=SeqID_20110
  Gene Ontology: Mol. function=DNA binding; Cellular component =chromosome; Biological process=nucleosome assembly
  Homolog annotation: Hit_ID=A7NZ58; Match level="QueryCoverage=46%, HitCoverage=63%, E-value=2e-45, Identity=98%"; Hit description =Histone H2B
  Pfam annotation: Domain name=Histone; Domain location=113-183; Score =108.5; E_value=2e-29; Accession=PF00125.15; Description=Core histone H2AH2BH3H4
MMSIWARKEIREERDFNFMEKEKKHLNRPSTGSSIASSSIRTSFNLILIGRDRLFSFTSKIAEKKPAEKKPAEEKKSTVGDKAPAEKKPKAGKKLPKEGGAGGEGGKKKKRNKKSVETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 111796 - protein, 68 aa, Glycine max
  Coding DNA Sequence Number=SeqID_20111
MGFVVFMNNPSRRARKQERVRNRSKSLRSEATEALSANNEEPILLQFRVMARLAGGGVGVEEGTKKKG

SEQ ID NO: 111797 - protein, 55 aa, Glycine max
  Coding DNA Sequence Number=SeqID_20112
MKPKGVSILEQEVNHNGQINVVAFWVEKEIQSIRTKKVGEGGYGMGMACVKTQDM

SEQ ID NO: 111798 - protein, 114 aa, Glycine max
  Coding DNA Sequence Number=SeqID_20113
  Homolog annotation: Hit_ID=Q69F85; Match level="QueryCoverage=42%, HitCoverage=2%, E-value=8e-07, Identity=48%"; Hit description=Gag -pol polyprotein
MARTRSVYKSQTGGYSKVGGGDRTLVAHQSESALPKPESSNILSSHVLLKGGKRVLWGYHCTPQSSMQNNPFKLTYDADTMVLVEISEPSLCRNKFNVANNSKFWKIEEVRSEA

SEQ ID NO: 111799 - protein, 203 aa, Glycine max
  Coding DNA Sequence Number=SeqID_20114
MVDYVGPVESLDASEIFLGWSLATIHHWKETMAKANNKTKTMAAKLKSMKVEVGKTKELKLELPKSKELVGKLQEDLDKHVRYSLNQQVKDISAKVKELTSEKKIVEENLTTAKDKVADLEKKIEDLKSELRKKEEVKSTLTVKFDKAKRLIVLNHQEGFKKAQRQVKVLLPSSDFSQLDVNCDVVDGEIVRESQLCFESKGE

SEQ ID NO: 111800 - protein, 113 aa, Glycine max
  Coding DNA Sequence Number=SeqID_20115
MDEANPISSPMVGGCKLSKASFEDFFNLAFYRSNIEAEYRSLALATVEVTWIKSLLVELKMSHAPLIIVTIKVVHVPVVDQRANILTKAISPSTFTVYKSKLRVVNKPLANPS

SEQ ID NO: 111801 - protein, 110 aa, Glycine max
  Coding DNA Sequence Number=SeqID_20116
MVAYILNKAQVEKDEEAKLHGESKVIQRCFDDNNDDDKGDDKKLKDQSKNNSSESRTIQEFKIRIKKNSRTQEESLKTRIKIQGSRSQESRSRFKTQDSRIKRRLNQDKY

SEQ ID NO: 111802 - protein, 169 aa, Glycine max
  Coding DNA Sequence Number=SeqID_20117
  Homolog annotation: Hit_ID=A7NZI1; Match level="QueryCoverage=81%, HitCoverage=38%, E-value=1e-48, Identity=69%"; Hit description =Chromosome chr6 scaffold_3, whole genome shotgun sequence
MTKRIRKDCSLQEDVEKVNNSFVELDTREGMNDGFPRAGPNDSLLPGLFDDVALNCLAWASRSDYASLACINKRYNLLIRSGYLSELRKKLGIVELEHLVYLVCDPRGWEVFDPKKNRWITLPKIPCDECFNHADKESLAVGSEMLVFGRELMDFAIWKYSLISCNWVK

SEQ ID NO: 111803 - protein, 50 aa, Glycine max
  Coding DNA Sequence Number=SeqID_20118
MWSGVFFIGTRWVACLWWSWWRLRWCIKVDEIKVIKRFAPFAWQSRKKRS

SEQ ID NO: 111804 - protein, 209 aa, Glycine max
  Coding DNA Sequence Number=SeqID_20119
  Gene Ontology: Cellular component=anchored to membrane
  Homolog annotation: Hit_ID=Q2V5Z9; Match level="QueryCoverage=49%, HitCoverage=41%, E-value=3e-23, Identity=54%"; Hit description =Putative uncharacterized protein
  Pfam annotation: Domain name=Fasciclin; Domain location=73-188; Score= 35.1; E_value=2.6e-07; Accession=PF02469.13; Description=Fasciclin domain
  Subcellular localization annotation: CTP_CleavageSite=26; ConfidenceScore=5.40e-01
MKQATLFSFSLFLLLSSTTMAISPAPAAAPKTPPTPKATAPSPKPLVPTLPQSPDSPDSVPDDITRILKKAKMFSVLIRLLKTTEIMNNINSQLITAKSGGITILAPDDSAFSNLKAGFLNSLNEGQKIELVQFHILPEFVSSSNFDSLSNPVQTVAGKDPARLPLNGECIRLQLWLQQLLQRLLKLPSKTLLRMIKKKQTKITINPGQ

SEQ ID NO: 111805 - protein, 24 aa, Glycine max
  Coding DNA Sequence Number=SeqID_20120
MREASRLQAVNRKLIAVNKLLMTS

SEQ ID NO: 111806 - protein, 766 aa, Glycine max
  Coding DNA Sequence Number=SeqID_20121
  Gene Ontology: Mol. function=protein dimerization activity; Cellular component=nucleus; Biological process=regulation of transcription, DNA-dependent
  Homolog annotation: Hit_ID=Q2HSV9; Match level="QueryCoverage=100%, HitCoverage=100%, E-value=0.0, Identity=68%"; Hit description =Transcriptional factor B3; Auxin response factor; Aux/IAA_ARF _dimerisation
  Pfam annotation: Domain name=AUX_IAA; Domain location=551-730; Score=- 103.6; E_value=0.048; Accession=PF02309.7; Description=AUXIAA family
  Pfam annotation: Domain name=Auxin_resp; Domain location=267-350; Score=165.2; E_value=1.7e-46; Accession=PF06507.4; Description=Auxin response factor
  Pfam annotation: Domain name=B3; Domain location=165-245; Score=43.4; E_value=7.8e-10; Accession=PF02362.12; Description=B3 DNA binding domain
  Pfam module annotation: Pfam domain module=AUX_IAA::Auxin_resp::B3; Domain location=551-730::267-350::165-245
MEIDLNHEVTEAEKNAFCDRECEKGAGAGAGITCWSSSTCSSSSAACVSSSYLELWHACAGPLTSLLKKGNVVVYFPQGHLEQVASFSPFTPLEIPTYDLQPQIFCRVVNVQLLANKENDEVYTQVTLLPQPELEGMYSEGKELEELGAEEDGDERSPTKSTPHMFCKTLTASDTSTHGGFSVPRRAAEDCFPPLDYKQQRPSQELVAKDLHGVEWKFRHIYRGTRKTRGENGELRLGIRRAVRPRNDLPESVIGSQNCYSNVLSSVANAISTKSKFHVFYSPRASHADFVVPYQKYVKSIKNPVSIGTRFKMRFEMDESQERRCSSGTLIATSDLDPYRWAKSKWRCLMVRWDEDIETNHQDRVSPWEIDPSAPLPPLSIQSSPRLKKLRTGLQVASPSHLITARGSGLVGFEESVRSPKVLQGQENAGFVSFYYGCDTVTKPPGFEMSSPSHPNLGSAEVRKVSSSELNSVHPFSYAGFVETNRFPRVLQGQEICSLKSLTGKVDLNLGAWGMPNLSCTTFNLHQATKPNFQPSLFPYGDIHQAGQASLFCSKSTTFQRENVPFNKPSTQAGIIVNEVGRSDLPNEHKLQDNISSAANMGVSNDNNVQGKVNACKLFGFSLSGETTAQNLQNSAKRSCTKVHKQGSLVGRAIDLSRLSGYNDLLSELERLFSMEGLLKDPDKGWRILYTDSENDIMVVGDDPWHEFCDVVSKIHIYTQEEVEKMTIGMISDDTHSCLEEAPVIMEASKSSSVGQPDYSPTAVRV

SEQ ID NO: 111807 - protein, 429 aa, Glycine max
  Coding DNA Sequence Number=SeqID_20122
  Gene Ontology: Mol. function=nucleic acid binding; Cellular component= cytosol; Biological process=regulation of mRNA stability
  Homolog annotation: Hit_ID=A7NZS1; Match level="QueryCoverage=99%, HitCoverage=92%, E-value=1e-153, Identity=64%"; Hit description =Chromosome chr6 scaffold_3, whole genome shotgun sequence
  Pfam annotation: Domain name=RRM_1; Domain location=12-83; Score =59.1; E_value=1.5e-14; Accession=PF00076.13; Description=RNA recognition motif. (a.k.a. RRM, RB
  Pfam annotation: Domain name=RRM_1; Domain location=216-281; Score =72.5; E_value=1.4e-18; Accession=PF00076.13; Description=RNA recognition motif. (a.k.a. RRM, RB
  Pfam annotation: Domain name=RRM_1; Domain location=99-171; Score =71.9; E_value=2.2e-18; Accession=PF00076.13; Description=RNA recognition motif. (a.k.a. RRM, RB
  Pfam module annotation: Pfam domain module=RRM_1::RRM_1::RRM_1; Domain location=12-83::216-281::99-171
MVATAIEEVRTLWIGDLQYWVDESYLSQCFAHSGEVVSIKIIRNKLTGQPEGYGFVEFVSHASAEAFLRTFNGAQMPGTDQTFRLNWASFGDSGPDHSIFVGDLAPDVTDFILQETFRAHYPSVKGSKVVTDPATGRSKGYGFVKFADEAQRNRAMTEMNGVYCSTRPMRISAATPKKNASFQHQYAPPKAMYQFPAYTAPVSTVAPENDVNNTTVCIGNLDLNVTEEELKQAFVQFGDIVLVKIYAGKGYGYVQFGTRASAEDAIQRMQGKVIGQQVIQISWGSTLTARQWFGCLVVERCLEDKSRLYLTIMRLMPMKDVPGGWGAQMDPSQWSAYYGYGQGYESYAYGATHDPSLYAYGAYAGYAQYPQNVEGAQDMSAVSMPMEELYDPLAMPDVDKLNAAYLSIHGSSILGRSLWQRTSQSLQQA

SEQ ID NO: 111808 - protein, 68 aa, Glycine max
  Coding DNA Sequence Number=SeqID_20123
MELQRLNQHEENDKKEKGIALKASSSTQEESDIEDSIDLDEDEDLSLFVKIQQIYYNERKSKKTKLQT

SEQ ID NO: 111809 - protein, 164 aa, Glycine max
  Coding DNA Sequence Number=SeqID_20124
  Homolog annotation: Hit_ID=Q51617; Match level="QueryCoverage=25%, HitCoverage=59%, E-value=1e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPVMVEDGNDGFDNYNGGYNGGYDVDNDNHDGDGSIVIF

SEQ ID NO: 111810 - protein, 63 aa, Glycine max
  Coding DNA Sequence Number=SeqID_20125
MKRIINSNNHKFSPESTNKFDDDKGDDKKLKGQSKNEFKMFKKESRTIQDSRGKVEEHFKIQD

SEQ ID NO: 111811 - protein, 191 aa, Glycine max
  Coding DNA Sequence Number=SeqID_20126
MEALKEQMATMMEAMMSMKKIMEANAVTIAATSAIAKVNPMAPFGLNQINHPTSDMVDKDLGSTSGPHYVQIQNKHAFMPYGLPSNYTPPNVAYTPSEDVNNSTPIPIESQQPQTDHADVSQTMGETHEISHHNLADFALASDMPLKGKQLVVYPCKTLWRALSITQKHNSCIPQQVKTLMLWQKWESWII

SEQ ID NO: 111812 - protein, 148 aa, Glycine max
  Coding DNA Sequence Number=SeqID_20127
MTRGNPSDLQPFDPEIDRTFHRLVRHHLVPFEHPKHSVIGDFEHYSFEHSENMAQPPPCKRTLREMATPDFTYESLCIQYPDEDVPYVLAGPRPSKKIFQALDNSVERAYMNTGRDLRNYVLVAITTRFMSSFSSNIFMMDLATWREV

SEQ ID NO: 111813 - protein, 89 aa, Glycine max
  Coding DNA Sequence Number=SeqID_20128
  Subcellular localization annotation: CTP_CleavageSite=76; ConfidenceScore=5.23e-01
MACLGGTTGVYMVFYFLLFFKTTSYSDATFKNWDSASIYTGGLRIGRSSASSLTDSLRSVVRLRRAVSAHSKAVIRLSTESGDNAGKNM

SEQ ID NO: 111814 - protein, 98 aa, Glycine max
  Coding DNA Sequence Number=SeqID_20129
HAPAFVDELRDSGGGGGASIARCQPSPGCCGVSPCACSGGAILLDESPINMGPDDLVGGDRHSIELTKARNQSWKPQDPVGLLRGEIGIVVTGQNVAK

SEQ ID NO: 111815 - protein, 162 aa, Glycine max
  Coding DNA Sequence Number=SeqID_20130
  Homolog annotation: Hit_ID=A6BLN7; Match level="QueryCoverage=65%, HitCoverage=20%, E-value=1e-08, Identity=34%"; Hit description =Putative transposase
MAPFTCACGKYNKEAMLRYRLEVMINQGDENTKFLLWDRECSELIGQSADAVNKLKIEDGDVDLNASPQALDKLLGYELAFKIKVQPKFRNYAILKCSADSSLINVVMDMLVDAETSSKMDIPVSDSNHSVQHESQSLSVTAGHDPLLGLPLTPTSGIHFRL

SEQ ID NO: 111816 - protein, 87 aa, Glycine max
  Coding DNA Sequence Number=SeqID_20131
  Homolog annotation: Hit_ID=A6FJQ2; Match level="QueryCoverage=43%, HitCoverage=84%, E-value=3e-11, Identity=92%"; Hit description=50S ribosomal protein L5
MPGADKPVRARQRVLAGVGAWLNYAASEQIMRKEKIPHQAPFAIQAAQLLGRAIGAGLFAITPAGERGMCCKAIKLGNARVFPVTTL

SEQ ID NO: 111817 - protein, 122 aa, Glycine max
  Coding DNA Sequence Number=SeqID_20132
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=A7Y7P3; Match level="QueryCoverage=78%, HitCoverage=62%, E-value=8e-39, Identity=71%"; Hit description =Putative ATP synthase CFi alpha subunit
  Pfam annotation: Domain name=ATP-synt_ab_C; Domain location=31-115; Score=60.2; E_value=7.1e-15; Accession=PF00306.18; Description=ATP synthase alphabeta chain, C terminal domain
VSAYIPTKVSSITDGQIFLSADLFNAGIRPAINVELEAFAQFASDLDKATQNQLARGQRLRELLKQSQSAPLTVEEQIITIYTGTNGYLDSLEIGQTFTGEAEVLLKEAIQEQMELFLLQEQ

SEQ ID NO: 111818 - protein, 74 aa, Glycine max
  Coding DNA Sequence Number=SeqID_20133
MGIAPTKTPSGPEEVQQGPGVSSSGIVPARHLVDPKKANSVLELPALNTGLYQFKGVPVAPSRVIRPPTNRVFI

SEQ ID NO: 111819 - protein, 111 aa, Glycine max
  Coding DNA Sequence Number=SeqID_20134
MGKVEEVQKKVKADMEAMKEKMATMMEAMMSMKKIMEVNAVTIAATSTVAKVNPTSPFDINQMNHPTSDMVGKDLGSTDGPHDVQIQKQARFPTIWLASQLYATQCGVHSQ

SEQ ID NO: 111820 - protein, 55 aa, Glycine max
  Coding DNA Sequence Number=SeqID_20135
MALHKGRSIMIAGEDVLKATSLICPWALRVESIASWQLPPRTQCILPFSAGPVSP

SEQ ID NO: 111821 - protein, 81 aa, Glycine max
  Coding DNA Sequence Number=SeqID_20136
MLSLDVSQKTEMKVYSAGDSSWRNLKGCPVLWTLPKVGEVVHPPLPINFLLESLFGGLESENTFSRSFTQFCKDLTTSSSH

SEQ ID NO: 111822 - protein, 126 aa, Glycine max
  Coding DNA Sequence Number=SeqID_20137
SLDEDDSVDGISDTDDEVTDIIEPVSIVHPTEGVPGIQNLFWNDALHYNNINWSHLDEEDICGLDMPTTFNVGQELYAGMDFDSKDAVKNALKQYVMKVHQSFKLNYKHDQRRSINKNFFDSRKDK

SEQ ID NO: 111823 - protein, 163 aa, Glycine max
  Coding DNA Sequence Number=SeqID_20138
MDPGVGPLFYSNPWVLRMQCKECEIDNNYLHFTQFQLMHTRSFTNPQFHKIGLTHKKYPQWSRQLSQRALRGRARARLTSALSKGGKMRGVTTNVYLWKTSEKTEGNRSKRIVQVRELYLRLRKVDKSEALAPTYPPSKRKSDLRSSFLGVNQAILFTWKVII

SEQ ID NO: 111824 - protein, 121 aa, Glycine max
  Coding DNA Sequence Number=SeqID_20139
MVSLETEDELEIRIAARLPWWHCRMKLPENAQQLPLADMVKSSEQAAATEPQSRRRRSNSAWEKEEEEEEATRNFVNPNYFGEEEEATLHERDFIDADLSATLDNLRGTELPPIHLTNAVT

SEQ ID NO: 111825 - protein, 161 aa, Glycine max
  Coding DNA Sequence Number=SeqID_20140
MAEEFVACMRHQIMDMVEKFCRRTANYGRKLKDHLSKVGLVENRHVSQPTLRREGDAGLTGASSKGGRRASCHQRLFEKNVGKIRTCGLRTLIVKGLRVIFTHGEAFYGPFCIFYLFVVDKGVSLTPTYSSIAMRKSDLPSSFIRIERWLSCFDLFPQDRF

SEQ ID NO: 111826 - protein, 200 aa, Glycine max
  Coding DNA Sequence Number=SeqID_20141
MSTLKEQMDSMMEGMLGMKRLMESNAATATAASTAAEADPTLPITAHHPIPNIMGREGSTLGHVSNPHPGYNRGAYPYGLPPNYTPPAMHEDVGHVTPLILEGEPPRHPDGVHENPRERAQGDVDSYSPFPAEGSVPNALPQPNITGEPPNHPMQPMFLSMEGPPPTAEGKEKLDLIKERLRAVEGFGNYPFTNMTDLCL

SEQ ID NO: 111827 - protein, 105 aa, Glycine max
  Coding DNA Sequence Number=SeqID_20142
  Gene Ontology: Mol. function=oxidoreductase activity; Cellular component=cytoplasm; Biological process=antibiotic biosynthetic process
  Homolog annotation: Hit_ID=Q2NWC6; Match level="QueryCoverage=80%, HitCoverage=81%, E-value=3e-28, Identity=67%"; Hit description =Putative uncharacterized protein
  Pfam annotation: Domain name=ABM; Domain location=13-84; Score=51.9; E_value=2.2e-12; Accession=PF03992.7; Description=Antibiotic biosynthesis monooxygenase
GSVMLTVVAEICVKPGRRQEVLEAINKLIPVVLEEEGCHQYDALVDHQAQVPWKQNSPDSIFMLEQWESLRHLEQHQQMPHMDAHRATIKDDVVDVKILVLEPTA

SEQ ID NO: 111828 - protein, 176 aa, Glycine max
  Coding DNA Sequence Number=SeqID_20143
  Homolog annotation: Hit_ID=A1FU53; Match level="QueryCoverage=100%, HitCoverage=64%, E-value=4e-96, Identity=99%"; Hit description =Putative uncharacterized protein precursor
MGGGYTLADGKLTVSAMASTMMACTDKALMALDEAVSSRLQGELKAEQDADGKLTLTTAKGDVLVFNPEPTAETRYGGAGETVFLEVAAKTEKCSHPLIPDYQCLQVREVKFDDKGLKQGEPGKFENFYGNIEGYTHEDGVRNVVRVKRYEVKNPPADAPSQAYVLDMVVESAIEK

SEQ ID NO: 111829 - protein, 68 aa, Glycine max
  Coding DNA Sequence Number=SeqID_20144
VKKRLSQEVLTVTVELSSSSAYFGKIALEAARGTTCALKPRFCKLREISELESECEMLRRRGGIPLLV

SEQ ID NO: 111830 - protein, 35 aa, Glycine max
  Coding DNA Sequence Number=SeqID_20145
MNRSWIQAPRISDEYEKGVEDFLKFEQQHAPTVGG

SEQ ID NO: 111831 - protein, 170 aa, Glycine max
  Coding DNA Sequence Number=SeqID_20146
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARLALEKEELIKALTSESSECSRMKAVCVLGALPLPRSLTRCARSFGCGERYQLTQRRSFAPSWAVCTNPPFSPNAAPYPVTIVLSPT

SEQ ID NO: 111832 - protein, 76 aa, Glycine max
  Coding DNA Sequence Number=SeqID_20147
MAAEWRGKRERRRLFKEKMSLEEAHHHRRPWIIAWRKKEMNEGRGREEHKILCSKRALKSEPTNPRSIPRFSTKCA

SEQ ID NO: 111833 - protein, 320 aa, Glycine max
  Coding DNA Sequence Number=SeqID_20148
  Gene Ontology: Mol. function=motor activity; Cellular component=cell projection
  Homolog annotation: Hit_ID=UPI00016621D1; Match level="QueryCoverage =86%, HitCoverage=41%, E-value=4e-22, Identity=33%"; Hit description =UPI00016621D1 related cluster
GLHALAFRGLHALTFRGLHVLAFRGLHALAFRGIHALAFKGLHALTFRGLHAITFRGLHVLAIRGSYALAIRGLRTLAFRGLHVLTFRGLHGLTFRGLHVLAFRGLHALAFQGLHVLTFRGLHALTFRGIHVFTFRGLHVLTFRGLHTLAFRGLHVLTLRGLHTLAFRGLHVLAFSGLHVLAFTGLHAFTLRGLHALAFRGLHILAFRGLHILTFRRLDALAFRGLHALTFRGLHILTFRGLHALAFRGLHALAFKGRHVRDFRGLHALAFRGLCVLTFIPGPPPDLEGGPIVRAQPEGGYCAATMHTGARFHPAIARRR

SEQ ID NO: 111834 - protein, 182 aa, Glycine max
  Coding DNA Sequence Number=SeqID_20149
  Gene Ontology: Mol. function=heat shock protein binding; Biological process=protein folding
  Homolog annotation: Hit_ID=O82368; Match level="QueryCoverage=74%, HitCoverage=43%, E-value=9e-29, Identity=46%"; Hit description =Uncharacterized protein At2g29880
MGDSQENNKGKSRDKDNYVSWTMEDTNELLHLLVDAMNRGLRDANESLSKQNVERIILPQLNAKTKFPKTYSHYLSRMKWFRNQYNMMSTLMRNNYGFGWDPIGKTFTAHEDVWKDYLKSHPSHNKLRGKSMVDYEYLKIVVGGGVSSGNNSISVDPDDTDTTTFEPENRTVGIEEFPYDPN

SEQ ID NO: 111835 - protein, 81 aa, Glycine max
  Coding DNA Sequence Number=SeqID_20150
GEWRIALGNHFAWLKTHWWRMHERQSIHGTPNKSGEWRIALGNHFAPGSRLIGGGCMNHESIHGTPNKSGDWRIALGDHSA

SEQ ID NO: 111836 - protein, 148 aa, Glycine max
  Coding DNA Sequence Number=SeqID_20151
MLWLQEFDLEICDRSGVQNLVTDHLSRIEHAFEDSSIRDDFLDDYLYILYNISDSFPTPWLLGDAFQTMRLTRSCNSVILPHQVAILAYRGQLARCLTVVSIGPPSSRMHGEYVALVSLVKDQAAHFHGDSKCLNNPCCYVRCLMSGV

SEQ ID NO: 111837 - protein, 101 aa, Glycine max
  Coding DNA Sequence Number=SeqID_20152
  Homolog annotation: Hit_ID=Q51617; Match level="QueryCoverage=40%, HitCoverage=59%, E-value=1e-14, Identity=95%"; Hit description =Putative uncharacterized protein
MTVKTSDTCSSRRRSQLVCKRMPGADKPVRARQRVLAGVGAGLTMRHREQDCTESAPYAAAQLLGRAIGAGLFAITPAGERGMCCKAIKLGNARVFPVTTL

SEQ ID NO: 111838 - protein, 80 aa, Glycine max
  Coding DNA Sequence Number=SeqID_20153
VVYKSKGERKDIELVEEEEPQIGADCSSATSNKSEICKKEPRNAAQKHKPKRVESVNVDAEAFGDHWKVHIDLCILKLKH

SEQ ID NO: 111839 - protein, 286 aa, Glycine max
  Coding DNA Sequence Number=SeqID_20154
LTVKEFEEILGCPLGGRKPYLFSRFYPSTTRVAKVVKISAQELDLANGLSFIDILALLIFGGVLFPNMEGLVDLAVIDAFLAFHHGKESPVVAILAMYDTFDRGGEKSGARIVFCALALYVWLVSHLFLQEGRKNRDSIFIRRMSKCSLDGTRGCINYNPVLAIRQLGYPMRGVPSDESITPFIARGFSDHNARDRELRGSSNGIIGGYHKWLRVRTQGLDWLPNLNTVRDDEVKASEESDEVQALKAELERARVVEEKFKSIAIKGSNSELKLRRGERNHHGSKA

SEQ ID NO: 111840 - protein, 37 aa, Glycine max
  Coding DNA Sequence Number=SeqID_20155
LALVQPVLVWAQEKQPLWVPPMEVEHQARLLAQGNAL

SEQ ID NO: 111841 - protein, 114 aa, Glycine max
  Coding DNA Sequence Number=SeqID_20156
DTARRSRTTERSESVSEEAEERPIRKPPLPAPSDSSITSGSLRFLQFFSSNCSDRVLKRQSDKEGIEASTRTVLIPRVKAVLGFCGKGKGYDAKGISLSSNMISKFPTVRMLEI

SEQ ID NO: 111842 - protein, 185 aa, Glycine max
  Coding DNA Sequence Number=SeqID_20157
  Homolog annotation: Hit_ID=Q8GEG1; Match level="QueryCoverage=50%, HitCoverage=68%, E-value=7e-41, Identity=86%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGSGPLTSITKIDAQVRGGETRQDYKDTRRFPLEAPSCALLFRPCRLPDTCPPFSLREAWRFLIAHAVGISVRCTSFAPSLGCVHEPPVQADRCALSGNYRLESNP

SEQ ID NO: 111843 - protein, 56 aa, Glycine max
  Coding DNA Sequence Number=SeqID_20158
MTKARQKGVRKGKRGRSLPPSSPRQARLLPLEGIVFWWNFLEGPSGPDCYLHTPVY

SEQ ID NO: 111844 - protein, 70 aa, Glycine max
  Coding DNA Sequence Number=SeqID_20159
  Homolog annotation: Hit_ID=A5BPN8; Match level="QueryCoverage=50%, HitCoverage=3%, E-value=1e-07, Identity=74%"; Hit description =Putative uncharacterized protein
MKKECPKYAAWHVKKDKFLTLVCSEVNLDFVPKDTWVACGADYQVMMKDSSLWVMARRLQWKLLELLDYS

SEQ ID NO: 111845 - protein, 189 aa, Glycine max
  Coding DNA Sequence Number=SeqID_20160
  Pfam annotation: Domain name=Transposase_23; Domain location=108-173; Score=-17.1; E_value=0.088; Accession=PF03017.5; Description =TNP1ENSPM transposase
MTAAIERLEHPGHVRATGVGVTMKQYFGSAPRTSRTSSSMAPEELEQLTQQIKDHLEESITKKMQSQFPSQMQSQGLALPPEPEVGPYVTRVSTKESCVDPSGNNPDTGDSDKCGLYIEENSPHLVSLGRVYERSTTVHSIPLLHDQVKVGVEEVKDVDAPIPIPTNEGAVGPAKPGDRPIIRSMIPYI

SEQ ID NO: 111846 - protein, 58 aa, Glycine max
  Coding DNA Sequence Number=SeqID_20161
MKMSRKFSKNFSSKFEEFNIHLGSTFQPAIQSPKLKFTIDTIIRKPKSSRKGSQPKTL

SEQ ID NO: 111847 - protein, 388 aa, Glycine max
  Coding DNA Sequence Number=SeqID_20162
  Homolog annotation: Hit_ID=A5B5G7; Match level="QueryCoverage=55%, HitCoverage=15%, E-value=6e-10, Identity=25%"; Hit description =Putative uncharacterized protein
  Subcellular localization annotation: CTP_CleavageSite=47; ConfidenceScore=5.07e-01
MEVELSVPCYAKPKGHFGKAELSAPCCAKPKPFSVLKIMASKKRKSSASSSTQARYDRSRFHSQEAWERYTDIIVPRKLLPERNVVVYYTEFDDFKEELERRKWDEELTNFDEGSIDVAIVKEFYANLYDPEDNSLKQVRVRGHLIKFDEDTLNTFLKTQVILEEGENLCAYSRFSLLRPDPQELAAKLCIPGKGFELNADGLPLKILRKNMTTLAQTWSILSFSNLVPTSHTSNVTLDRAKLIYGIIMKMDMNVGYLISHQISITAQHDPSRLGFPALITTLCKARGVTSDSRSLESLSPVINFAYIKKNYWNLDDPTVAFRGPKKTRGKRSEAPTTLVALEIVAPSSSTPPVPFSSTSSTQIPLPTPSSFGPSDFLFTPEMLHSML

SEQ ID NO: 111848 - protein, 100 aa, Glycine max
  Coding DNA Sequence Number=SeqID_20163
MPLKRVRHVNFTTPHFQGFFKGSVKHPITTPKSQEILREAQTKKEKDIEVKVTSKKLRKKGLGASFSTDPLGWILNIPLRLKRSSLCGGSATSNGGHRWL

SEQ ID NO: 111849 - protein, 165 aa, Glycine max
  Coding DNA Sequence Number=SeqID_20164
  Gene Ontology: Mol. function=helicase activity; Biological process =viral genome replication
  Homolog annotation: Hit_ID=Q9LX60; Match level="QueryCoverage=84%, HitCoverage=9%, E-value=1e-32, Identity=46%"; Hit description =Putative uncharacterized protein F4M19_60
YIVPYNPRLLRKYQAHINIEWCNQSTSIKYLFKYINKGYDRVTVILIDEDNDQTQNGGTHNDEIKEYLDCRYICPCESTWRIFGFPIHGRKPAVERLHFHLPGQHSVLYEDHDDIDDVLSKPSISDSKRKDVGTFGRKATPPGRLLWVPPITGELFYFENDAYCL

SEQ ID NO: 111850 - protein, 125 aa, Glycine max
  Coding DNA Sequence Number=SeqID_20165
MVRTRGLGRALGASKGRGINEDAHQVDVPRRRRPTASACRQRVCLREDVTERPEDVPQSHEDVPHVSDATPEMTGAADAVHTEGMATDGSLGSLAADEGFPGGPRDPSILTGFAEHVTHSIWSGQ

SEQ ID NO: 111851 - protein, 408 aa, Glycine max
  Coding DNA Sequence Number=SeqID_20166
  Homolog annotation: Hit_ID=Q2HW90; Match level="QueryCoverage=82%, HitCoverage=60%, E-value=7e-25, Identity=29%"; Hit description =Putative uncharacterized protein
MASQEKWGPFADILALLIFGLVLFPNIDGLVDLAAIDAFLAYHHSKESPVVAILADLFDTFDRRCEKNSARIVCCLPALCVWLTSHLFRQDTRHPCPLQSYRSCAEKGRVVWDQHLAVIGGSTIHWFPRWKEGKEGVLFSCGDYPNVPLVGTRGCINYNPALAIRQLGYPMRGAPTEESLTPFLVRDLGAQSLKVIQRIHKAWRSPLRKDKELRGIRNGVIGDWLSKLKVIDEENFEAPEEDEEVRALNLELGKARLAKEKFKSAATHIRKECTELQEENAATARALEQETKRACKEEYGREKFRGALWGSNNELKLRREERDRSRVHGMILKEELVACARSKRSLAQHLEATEQSMLAIIGKYKEELNQSMAHEQKLVEDFAQVYAKKEARGRVIDALHQEATMWMD

SEQ ID NO: 111852 - protein, 186 aa, Glycine max
  Coding DNA Sequence Number=SeqID_20167
  Gene Ontology: Mol. function=motor activity; Cellular component=cell projection
  Homolog annotation: Hit_ID=UPI00016621D1; Match level="QueryCoverage =96%, HitCoverage=40%, E-value=3e-13, Identity=29%"; Hit description =UPI00016621D1 related cluster
MHALAFRKLHALTFKGLCILAIKGLHPFAFRGLHALAFRGLHVLASRGLHILAFRGLDVIAFTKLHVIAFRGLHAFAFRGPHVLAPRGLHVLAFRGLHALAFIGLHVLTFRGLHALASRGLHVLAFRGLHVLTFRGLHTLAFRGPHVLASRGLHILASKGLHVLAFKGLHVLAFRGLHVLAFRGLH

SEQ ID NO: 111853 - protein, 157 aa, Glycine max
  Coding DNA Sequence Number=SeqID_20168
  Gene Ontology: Mol. function=metallopeptidase activity
  Homolog annotation: Hit_ID=A6T6B3; Match level="QueryCoverage=100%, HitCoverage=100%, E-value=6e-64, Identity=78%"; Hit description =Putative metalloprotease KPN78578_06730
  Pfam annotation: Domain name=UPF0054; Domain location=8-145; Score =207.1; E_value=4.2e-59; Accession=PF02130.8; Description =Uncharacterized protein family UPF0054
MSQVILDLQLACEDTSGLPDEALFQRWVEAVIPQFQEESELTIRLVDVAESHELNLTYRGKDKPTNVLSFPFEAPPGIEMPLLGDLIICRQVVEQEAKEQEKPLEAHWAHMVVHGSLHLLGYDHIEDDEAEEMEGLETEIMLALGYEDPYIAEKIAE

SEQ ID NO: 111854 - protein, 266 aa, Glycine max
  Coding DNA Sequence Number=SeqID_20169
MVLAEGESLPAYSKYCRMPTDIREIEVALCIPNRGFILNAEGHLGKILRKDLTTLAQVWSVLSYSNLAPTSHKSDLAVDRARLIFGLVTQLDMNVRALIFGQITSIAKSNSSRLGFPALITALCRTKGVASDNLVFERLSPVINLAYIRKNCWNPDDPTIIIRGARRPRARPAEAPSTSTTPHLASTSAAPPPACIAAAPSTLPPADFQRFEAMLQSIHQGQIILLQSLQLVAPPDSIPTVEQFNEWVAWPGTQPPHRDDEDPAAL

SEQ ID NO: 111855 - protein, 70 aa, Glycine max
  Coding DNA Sequence Number=SeqID_20170
MVSETEQEAPYQNDEFVGLQKVLEVDPDIINESVVDVDGGEEEIDVDLLKRLDLVEPDKDECILSENEIK

SEQ ID NO: 111856 - protein, 70 aa, Glycine max
  Coding DNA Sequence Number=SeqID_20171
MANVSLLRKIKWDEVTLPERWVMDKATLSVPRPTPTIEQIKQDNSGKVEITFNRRNSFSSRIEVSRSEYE

SEQ ID NO: 111857 - protein, 162 aa, Glycine max
  Coding DNA Sequence Number=SeqID_20172
MSVLELYIEKDVTGGSMFHSANSLTSCGNNLSNNEAQSARNVSNLHGDEDDDDDYLVSNSYVEGSLDEDDSVDSISDIDDEVTEMIQSVRIVHLAEGVEGIQNSFWNDALHYNNVNWNHPDEDDICSLAMPSSFNVGQELYVDMEFDSKDAIKNVVKQYVMK

SEQ ID NO: 111858 - protein, 103 aa, Glycine max
  Coding DNA Sequence Number=SeqID_20173
MDFEICPIMQKIAVKFVQQNFCSCAENVCALLVMGKLGGVDGDPVLRGTRIRATWEYMSSVEGGQLGMSGTWRYVAGVRRPWGRQVGCYCPKPSLTNPDPTWA

SEQ ID NO: 111859 - protein, 576 aa, Glycine max
  Coding DNA Sequence Number=SeqID_20174
  Gene Ontology: Mol. function=transcription repressor activity; Cellular component=intracellular; Biological process=negative regulation of transcription, DNA-dependent
  Homolog annotation: Hit_ID=Q7WGH9; Match level="QueryCoverage=46%, HitCoverage=80%, E-value=1e-114, Identity=80%"; Hit description=Heat- inducible transcription repressor hrcA
  Pfam annotation: Domain name=GntR; Domain location=309-370; Score =7.1; E_value=0.013; Accession=PF00392.12; Description=Bacterial regulatory proteins, gntR fam
  Pfam annotation: Domain name=HTH_11; Domain location=316-377; Score =11.4; E_value=0.014; Accession=PF08279.3; Description=HTH domain
  Pfam annotation: Domain name=HTH_5; Domain location=310-362; Score =13.5; E_value=0.017; Accession=PF01022.11; Description=Bacterial regulatory protein, arsR family
  Pfam annotation: Domain name=HTH_DeoR; Domain location=318-373; Score= -0.5; E_value=0.072; Accession=PF08220.3; Description=DeoR-like helix- turn-helix domain
  Pfam annotation: Domain name=HrcA; Domain location=408-576; Score =13.1; E_value=1.8e-07; Accession=PF01628.12; Description=HrcA protein C terminal domain
  Pfam module annotation: Pfam domain module=GntR::HTH_11::HTH_5::HTH _DeoR::HrcA; Domain location=309-370::316-377::310-362::318-373::408 -576
VPVQLAAQGGKEAVAFRMHEADGVGRALHHDAVAGLQVGPGLHVEMHAGPDFDAAHGGERHVQHAAVGNDDGTVGQGLRRHRHQHHGVHAGVQDRAVGRQRIGGRAGGRGDDQAVGALRVHEGAVEFDAHLDHAAAPGAVQHHVVQGRGRVHLLVAAPRAAFEQHALFDLEVALQHARQRAVRVLHGNVGDETQVAVVDADHRHAVGREVARGAQHRAVAAHDHRQRRILADLFVSGDRVFREAGVAGRAGVLVSADQRDGRKVHGGEANQKNEIGPESGLLADYMGPHIGLRDKNRLNWKRFPKIPAMDDRARALLKALIERYIADGQPVGSRTLSKVFDLSPATIRNVMADLEELGLIHSPHTSAGRIPTPRGYRMFVDSLLAVQSYQLEPHNMGDMLAAAEPTRAVNAAAALLSNLTQFAGVVLTPKRAQVFRQIEFIRLSDKRVLLIIVTPDGDVQNRILFVQREYAEAELLEAGNFFNVHFAGKSFDAVRRTLSTELAQLREDISRLMQAAVEASAEAAEDGDAVVISGERKLLDVTDIASDMDRLRKMFSLFEKKTDLLQLLDVSSRAQG

SEQ ID NO: 111860 - protein, 114 aa, Glycine max
  Coding DNA Sequence Number=SeqID_20175
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=66%, HitCoverage=74%, E-value=6e-34, Identity=90%"; Hit description=LacZ protein
MSRRGGSKQQPDSRHPAPPSAGDPLESTCRHASLALAVVLQRRDWENPGVTQLNRLAAHPPFASWRNSEEARTDRPSQQLRSLNGEWRLMRYFSPYASVRYFTPHMVHSQYNLL

SEQ ID NO: 111861 - protein, 95 aa, Glycine max
  Coding DNA Sequence Number=SeqID_20176
  Gene Ontology: Mol. function=arsenite transmembrane transporter activity; Cellular component=integral to membrane; Biological process=response to arsenic
  Homolog annotation: Hit_ID=Q8GGH6; Match level="QueryCoverage=100%, HitCoverage=22%, E-value=8e-45, Identity=95%"; Hit description =Arsenic-efflux pump
  Pfam annotation: Domain name=ArsB; Domain location=1-91; Score= -209.7; E_value=0.019; Accession=PF02040.6; Description=Arsenical pump membrane protein
MNNMPTVLIGALSIDGSTATGLIKDAMIYANVIGCDLGPKITPIGSLATLLWLHVLAQKNMTITWGDYFRTGIIMTLPVLFVTLAALALRLSFTL

SEQ ID NO: 111862 - protein, 184 aa, Glycine max
  Coding DNA Sequence Number=SeqID_20177
  Subcellular localization annotation: CTP_CleavageSite=62; ConfidenceScore=5.69e-01
MFASSPFSTFILSPMNLLPSVVHVSSTFESGARRIDCLALFANSQFSTFIRCPMNSLPSAVQASSTNESRGLRIDCLALFPSSPFSTFIRSPINLLSSVVHVSSIFKSGAPRIDCLALFANSPFSTFIGSPMNSLPRAVRVSSTFESGAPRLDCLALFANSQFSTFIHSPMNSLPSGVHASSTN

SEQ ID NO: 111863 - protein, 220 aa, Glycine max
  Coding DNA Sequence Number=SeqID_20178
  Homolog annotation: Hit_ID=Q5QJQ3; Match level="QueryCoverage=43%, HitCoverage=75%, E-value=3e-51, Identity=97%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPMVAGLVLNSEYVEGRIRMGFRPKALCLGVGGSAPLTSITKIDAQVRGGETRQDYKDTRRFPLEAPSCALLFRPCRLPDTCPPFSLREAWRFLIAHAVGISVRCRSFAPSWAVCTNPPFSPSGAPYP

SEQ ID NO: 111864 - protein, 206 aa, Glycine max
  Coding DNA Sequence Number=SeqID_20179
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=A7Q336; Match level="QueryCoverage=100%, HitCoverage=13%, E-value=5e-30, Identity=37%"; Hit description =Chromosome chr12 scaffold_47, whole genome shotgun sequence
MGLSVLEPEISFSSLSNSLVSWAETTWAMNMTCFAEDKFDILKHNNLNSAKEGRGVLVIQIGVNEQVMYMHWSGAASTILDNCALYYDIIGEFHATENQKIKFGQVIQEMGDASLKLIAFAYRQTDGEQLQQEELIGLKCTNSLESIKSALENDDIMEVKAIASGLRLEHGIVLEGRKVKDLNEEAIRRSGSAHVMANLHPEDKLL

SEQ ID NO: 111865 - protein, 117 aa, Glycine max
  Coding DNA Sequence Number=SeqID_20180
  Homolog annotation: Hit_ID=A5BZP6; Match level="QueryCoverage=76%, HitCoverage=11%, E-value=3e-07, Identity=33%"; Hit description =Putative uncharacterized protein
MSKYGGWNALIHGRNSTAFSNWWKDLKSIFQQQHTNRLSNNLCWKLGNGAKIRFWKDKWREDDLTLQEKYPTLYQVSYQQDFSISLMGILVDNKWEWRMQWRRNFFDHEIDGSSLYG

SEQ ID NO: 111866 - protein, 121 aa, Glycine max
  Coding DNA Sequence Number=SeqID_20181
  Gene Ontology: Mol. function=phosphoprotein phosphatase activity
  Homolog annotation: Hit_ID=A7PHV0; Match level="QueryCoverage=80%, HitCoverage=31%, E-value=1e-12, Identity=40%"; Hit description =Chromosome chr13 scaffold_17, whole genome shotgun sequence
MTVTYNNCKERCVVPPITKLNQLEERCTTLAPKRTPPVIENKPLRHRWLRRGNQHIGNDDLIVFRRKLDIMKRHEFQWEPYTTTVMSALPPICLIGSVAWCAVVPLICFHVVEWHQSDRVL

SEQ ID NO: 111867 - protein, 204 aa, Glycine max
  Coding DNA Sequence Number=SeqID_20182
  Homolog annotation: Hit_ID=A5BPQ8; Match level="QueryCoverage=50%, HitCoverage=8%, E-value=1e-09, Identity=34%"; Hit description =Putative uncharacterized protein
MLTRRTLDQPRPIVTVDAAIGQGLGPHKERFHSYLGVVAREKVPIVHNNWKDVPDTLKELVWNDILAKFDIPKALHAKKKDQHKEDPSVKYGFDAQIWEEFAATRKTPNWQGIRKKMQEIKKNNDCPHFLSRGGYDLLEKKLLDEKIKKRQHDALMTENPALIEDPPSPIKRHVKWKMARTNRYGKMTSEAARQIADKIGSLTM

SEQ ID NO: 111868 - protein, 202 aa, Glycine max
  Coding DNA Sequence Number=SeqID_20183
MSGHRVRHRGSCSFTSALDFYLALYSNSSILGQDVRTLYPTSWILQLQFFICHFILPCTLCSPISFLDITLDIMYRLEVMINHGDESTKFLLWDRECSELIGQSANAVNKLKIEDGDVDLTASPQALDKLLGYELAFKIKVQPKFRNSAVLKCSTDSSLINVVMDMLADAETSSKINIPAFDSNHSTQHEFVSFDHDPHLLI

SEQ ID NO: 111869 - protein, 173 aa, Glycine max
  Coding DNA Sequence Number=SeqID_20184
MAFLGEAASQTIVNSWLAFIFPNGVVIHNECGVYFQSSTPVFHESNNIHFQCMQLKHDMDVKTMLMCNDQFSCVGPIELLCTIGRTPDAILNLLQCPSIPTHDAVLYYNGRWNMPRQNNFMGYTFTGINPQKFDIPKGCTIDELKDLIKQVAPKGNPPHGIHESQLVRRLFYR

SEQ ID NO: 111870 - protein, 103 aa, Glycine max
  Coding DNA Sequence Number=SeqID_20185
MQFQQEIRASIQSLTNQMGQMDTQLNQAQSHNYDKLPSQTVQNPKNVSAITLRSGNQIQVPPPVAAPVSEPVKLHSTPEKEDEIVAQKRKLPIKKISCRWTFI

SEQ ID NO: 111871 - protein, 119 aa, Glycine max
  Coding DNA Sequence Number=SeqID_20186
LITGLCQSFRVPVTPSKVIRPPITRAFIEKYYTPRQAQGDAPQAADAPPPPHQADPVGSFGMERYLQHLVRQQAANHRGQVQIHECLYQLSLNQQSQGFAPFACLTPDQFRAEVTWHGD

SEQ ID NO: 111872 - protein, 125 aa, Glycine max
  Coding DNA Sequence Number=SeqID_20187
  Gene Ontology: Mol. function=helicase activity; Biological process =viral genome replication
  Homolog annotation: Hit_ID=Q9LTU4; Match level="QueryCoverage=99%, HitCoverage=11%, E-value=3e-32, Identity=42%"; Hit description =Helicase-like protein
MDQLYFDGISICSHVGFPNLFITFTCNPNWLEIHRLLTPLNLTAIDRPKIISRIFKLKYEQMLSHLTKNHLLGKVVALEIPSQKDDPELYNLVQNHMIHGPCGILRPASPCMKEGKCSRFYPKKF

SEQ ID NO: 111873 - protein, 295 aa, Glycine max
  Coding DNA Sequence Number=SeqID_20188
  Gene Ontology: Mol. function=sugar:hydrogen symporter activity; Cellular component=integral to membrane; Biological process =carbohydrate transport
  Homolog annotation: Hit_ID=P0AE25; Match level="QueryCoverage=92%, HitCoverage=58%, E-value=1e-117, Identity=81%"; Hit description =Arabinose-proton symporter
  Pfam annotation: Domain name=MFS_1; Domain location=28-290; Score =46.2; E_value=1.1e-10; Accession=PF07690.7; Description=Major Facilitator Superfamily
  Pfam annotation: Domain name=Sugar_tr; Domain location=24-295; Score =102.9; E_value=1e-27; Accession=PF00083.15; Description=Sugar (and other) transporter
  Pfam module annotation: Pfam domain module=MFS_1::Sugar_tr; Domain location=28-290::24-295
MTSINDSTLMPAALRDTRRMNQFVSVAAAVAGLLFGLDIGVIAGALPFITDHFTLSSRLQEWVVSSMMLGAAIGALFNGWLSFRLGRKYSLMVGAVLFVAGSIGSAFATHVEVLLLSRVLLGVPVGIASYTAPLYLSEMASENVRGKMISMYQLMVTLGIVLAFLSDTYFSYSGNWRAMLGVLALPALVLIVLVIFLPNSPRWLAQKGRHVEAEEVLRMLRDTSEKAREELNEIRESLKLKQGGWALFKINRNVRRAVFLGMLLQAMQQFTGMTSSCTTRHAFSKWPGSPPRNSR

SEQ ID NO: 111874 - protein, 221 aa, Glycine max
  Coding DNA Sequence Number=SeqID_20189
  Homolog annotation: Hit_ID=A6FJQ2; Match level="QueryCoverage=17%, HitCoverage=84%, E-value=6e-11, Identity=92%"; Hit description=50S ribosomal protein L5
MRKEKIPHQAPFAIQAAQLLGRAIGAGLFAITPAGERGMCCKAIKLGNARVFPVTTLHLHIMVRTRGLGRALGRVSGRGLGKEDRDDSDDAPQRRRPTAFACRQRVLITVADAEPVVPAAKADVAVTEADVVADEPMVEVDVHDTGANTAAYTGAQATVDEPKGFLGGLTDPSVLTKYVEHVAASVWTGEESPKLKLSSHGRKVHNLGRHIPAIEGLVART

SEQ ID NO: 111875 - protein, 288 aa, Glycine max
  Coding DNA Sequence Number=SeqID_20190
  Subcellular localization annotation: CTP_CleavageSite=25; ConfidenceScore=5.14e-01
HRASPSCGWGQDRRNGSGRRVLPVPETAGRPASCCLLLPARRRSPLATSWRRRVDGRASPPVRYAAGGSGRERQNKAGNRPPSARDRAWRGAPTPALHEPIGRTAAGRPLRCTAGSAFSSGSAQRSAHLSQDFPASLFLTRSLVVAIKGAFRAEVTRACQLSEGQYQQRDEQQIQQKIATRKQETFESVIGAWPQNEARGRGAQDLLAATGEAITFQRRYAVRQCQQQLQRSKAGAAIAEIVAKSQQAYGGALALLDGFEQVQQLIAVFPPNAKRGFDDGDKQRNDGR

SEQ ID NO: 111876 - protein, 20 aa, Glycine max
  Coding DNA Sequence Number=SeqID_20191
MLGSALSAPVALSLNYSLKR

SEQ ID NO: 111877 - protein, 102 aa, Glycine max
  Coding DNA Sequence Number=SeqID_20192
  Homolog annotation: Hit_ID=A5AV22; Match level="QueryCoverage=57%, HitCoverage=5%, E-value=3e-08, Identity=53%"; Hit description =Putative uncharacterized protein
MYLLNRVPSQEFLKTPAHGQHRTPSTRHLRRLGLPGRNKNLLPQERKLDARTISGYFIGLSRKDPKGVSCSLSIMTSYIIVVRNLSEWRLENICMNQPMGFH

SEQ ID NO: 111878 - protein, 55 aa, Glycine max
  Coding DNA Sequence Number=SeqID_20193
MTEVSKNLITQSRLTTIIKTMDNHEHANHCDTAQARIKNKGIRQHKVNDQAQNID

SEQ ID NO: 111879 - protein, 139 aa, Glycine max
  Coding DNA Sequence Number=SeqID_20194
  Subcellular localization annotation: CTP_CleavageSite=39; ConfidenceScore=5.21e-01
MDYYLITCHQSYMMTRVMSLPPSLKGSLLDSRTRFTRIVESMPKETLIPTPRSSSRDRHPTHFLSPTSWENLETPQHSQYFCFGDYPFVDMTDLCLVPDVIIPPDIQDSLAGEAVIWYTNQEASCIRTWKDLVTAFLRQ

SEQ ID NO: 111880 - protein, 40 aa, Glycine max
  Coding DNA Sequence Number=SeqID_20195
MSWSLEDKLIRKALESVVFHLLAKPICWLSEHPLSAALLG

SEQ ID NO: 111881 - protein, 164 aa, Glycine max
  Coding DNA Sequence Number=SeqID_20196
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTVAPYP

SEQ ID NO: 111882 - protein, 113 aa, Glycine max
  Coding DNA Sequence Number=SeqID_20197
  Homolog annotation: Hit_ID=A6FJQ2; Match level="QueryCoverage=33%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGVMSTVGTLQMFLLVSHILCSIPPSFADKTTTN

SEQ ID NO: 111883 - protein, 160 aa, Glycine max
  Coding DNA Sequence Number=SeqID_20198
TTLLANRGLHAFTLRGLHVLANVGLHALTFRGLHVLTNRGLHALTFRGLHILAFRGLHILTLRGLHVLALRDYTGLHALTSRGLHVLVLRGLHALTFRGSFLLTVPGPPPDIGGGPTMRAQPEREAITQLLCIPGQDFTRAAAKRRVRIMRTNMTTLTQI

SEQ ID NO: 111884 - protein, 79 aa, Glycine max
  Coding DNA Sequence Number=SeqID_20199
ENNEELYERIERLENRERHEEERRGGNGGDPRPNRIEGVKLNIPPFKGKSDPKAYLEERARNEEPLVETWVEMKRIMRK

SEQ ID NO: 111885 - protein, 226 aa, Glycine max
  Coding DNA Sequence Number=SeqID_20200
  Gene Ontology: Mol. function=phosphotransferase activity, alcohol group as acceptor; Cellular component=cytoplasm; Biological process =carbohydrate metabolic process
  Homolog annotation: Hit_ID=A8APT1; Match level="QueryCoverage=96%, HitCoverage=45%, E-value=1e-113, Identity=95%"; Hit description =Bifunctional protein hldE [Includes: D-beta-D-heptose 7-phosphate kinase (EC 2.7.1.-) ...
  Homolog annotation: Hit description=(D-beta-D-heptose 7 -phosphotransferase); D-beta-D- heptose 1-phosphate adenosyltransferas e (EC 2.7.7.-)]
  Pfam annotation: Domain name=CTP_transf_2; Domain location=128-226; Score=31.9; E_value=1.3e-06; Accession=PF01467.17; Description =Cytidylyltransferase
MKIIADFELSALLVTRSEQGMTLLQPGKAPLHMPTQAQEVYDVTGAGDTVIGVLAATLAAGNSLEEACYFANAAAGVVVGKLGTSTVSPIELENAVRGRADTGFGVMSEDELKVAVAAARKRGEKVVMTNGVFDILHAGHVSYLANARKLGDRLIVAVNSDASTKRLKGETRPVNPLEQRMIVLGALEAVDWVVSFEEDTPQRLIAGILPDLLVKGGDYYQTGGCL

SEQ ID NO: 111886 - protein, 142 aa, Glycine max
  Coding DNA Sequence Number=SeqID_20201
  Gene Ontology: Mol. function=helicase activity; Biological process =viral genome replication
  Homolog annotation: Hit_ID=Q2A9I1; Match level="QueryCoverage=100%, HitCoverage=10%, E-value=3e-21, Identity=40%"; Hit description =Putative uncharacterized protein
MGFLQDDKEFIEAIKEAKDWGSTHYIRKLFVLLLLTATMNKPEQVWAQTRHWMADDIVYNYKKSSTSPALQLDDMTLQNLVLLEIEQLLQANQRSLTDYPSMSYPEDVNFPTYLDNSLILAELNYNNQELRSEFEHLFSHMT

SEQ ID NO: 111887 - protein, 82 aa, Glycine max
  Coding DNA Sequence Number=SeqID_20202
  Homolog annotation: Hit_ID=Q51617; Match level="QueryCoverage=71%, HitCoverage=92%, E-value=8e-16, Identity=71%"; Hit description =Putative uncharacterized protein
  Subcellular localization annotation: CTP_CleavageSite=66; ConfidenceScore=5.81e-01
MLCKKAVSSFGPPIVVRSVSRGPFVSRVSVMTVKTSDTCSSRRRSQLVCKRMPGADKPVRARQRVLAGVGAGLTMRHQSRLY

SEQ ID NO: 111888 - protein, 174 aa, Glycine max
  Coding DNA Sequence Number=SeqID_20203
  Subcellular localization annotation: CTP_CleavageSite=80; ConfidenceScore=5.08e-01
MTTVTQMWMTFWLSNVLPSDHNSDLPLPKVVSWCMPPTWHPLDPNKSNRALGFPALITGLCQSFGVPVTLSKVIRPPITRAFIEKYCMPRQAQDDAPQDADAPSPPHQANPGGSLGMESYLQHLVRQQAANHWGQVQIHECLYRFNLSHQGQGFAPFACPTPEQFRAEVTWPGD

SEQ ID NO: 111889 - protein, 264 aa, Glycine max
  Coding DNA Sequence Number=SeqID_20204
LHVLTIRGLHALTSRGLHVLALRGLHALTLGTSYPHRQRTTRPRLERTTRPHHQRAARPYRQRATRPHLERTTRPHHQRAAQGHALTLRGLHVLTIRGLHALTSRGLHVLALRVLHALTLGTSYPHHQRAARPHLQRTTRPRLQRDYMFPIFKEGHALTFRGLHVLAIIGLHSLAFERLHVLNFRGLHALAFRGLCVLTFRASSFLLTVPGPAPDIGGGPTVRAQPEREAITQLLCIPGQDFIRAAVKRRVRIMRTNMTTLTQI

SEQ ID NO: 111890 - protein, 131 aa, Glycine max
  Coding DNA Sequence Number=SeqID_20205
  Homolog annotation: Hit_ID=Q2HW90; Match level="QueryCoverage=93%, HitCoverage=25%, E-value=2e-11, Identity=36%"; Hit description =Putative uncharacterized protein
MASQEEWVPFADIVALLIFGVVLFATWTEGKEGVPFSCGDYPNIPLIGTRGCINYNPALAIRQLGYPMRGAPTEESLSPFLVRDFSVQSFKIVHRVHKAWESPLRKDKKLRGIRNGIIDGYHEWIRVIHEG

SEQ ID NO: 111891 - protein, 70 aa, Glycine max
  Coding DNA Sequence Number=SeqID_20206
MVVEWRRRRGERRHHFKEKMSQEQAHHRKSWIRAWSLLIQDQVHDSSLSVLRCHEACKVGRTCTKCDYMM

SEQ ID NO: 111892 - protein, 140 aa, Glycine max
  Coding DNA Sequence Number=SeqID_20207
MTRRLLAGSIGLLKAASFMISLCVSCFQDLQTLHRSFLIGAAVIASFGYQKEHDGSWVKKGAQPNDGEGHLQGGEDSSLLQKILDRFDGLQTFVGERFDALELQVDMRFDEMDSRITKVEEDVSYIRTSFDLPPPPPPSS

SEQ ID NO: 111893 - protein, 223 aa, Glycine max
  Coding DNA Sequence Number=SeqID_20208
  Homolog annotation: Hit_ID=A8XZZ5; Match level="QueryCoverage=83%, HitCoverage=57%, E-value=2e-09, Identity=21%"; Hit description =Putative uncharacterized protein
  Subcellular localization annotation: CTP_CleavageSite=83; ConfidenceScore=5.13e-01
MTGPLDESISYFLIRVDPWRATCPRLQRVARLHLQRATCPRLQKAARPRLQRATRPRLQRTTRPHLQMTTRPRLKRDYTSSPSEEYTSSPSEGLQVLTFKGVQVSCLQRTTCPHLQRTTRPHLQRTTCPRLQRTTHPHLQRTTRPPLQRATRPHLQRTTPLRLQRVTRPRLQRTTRPRLHRTTRPHLQGATRPHLQRTTHPRLQRTTRPHLQRTTRPRLQRTT

SEQ ID NO: 111894 - protein, 364 aa, Glycine max
  Coding DNA Sequence Number=SeqID_20209
  Gene Ontology: Mol. function=transferase activity, transferring phosphorus-containing groups; Cellular component=integral to membrane; Biological process=two-component signal transduction system (phosphorelay)
  Homolog annotation: Hit_ID=A8GJZ6; Match level="QueryCoverage=100%, HitCoverage=46%, E-value=1e-165, Identity=81%"; Hit description =Multi-sensor hybrid histidine kinase precursor
  Pfam annotation: Domain name=HisKA; Domain location=268-333; Score =75.1; E_value=2.3e-19; Accession=PF00512.16; Description=His Kinase A (phosphoacceptor) domain
  Pfam annotation: Domain name=PAS; Domain location=141-252; Score =88.7; E_value=1.8e-23; Accession=PF00989.15; Description=PAS domain
  Pfam annotation: Domain name=PAS_3; Domain location=163-255; Score =1.2; E_value=0.076; Accession=PF08447.2; Description=PAS fold
  Pfam annotation: Domain name=PAS_4; Domain location=147-257; Score =60.3; E_value=6.4e-15; Accession=PF08448.1; Description=PAS fold
  Pfam module annotation: Pfam domain module=HisKA::PAS::PAS_3::PAS_4; Domain location=268-333::141-252::163-255::147-257
MVKLGLVRFSLLLASALVVLAMVVQMAVTMVLRGHVESIDVVRSVFFGLLITPWAVYFLSVVVDQLEESRQRLSKLVDKLEEMRTRDLELNQQMKETISQLNQEISDRIKAEQAREQVMDKLREEMTRREQAQIELEQQSSFLRSFLDASPDLVFYRNIDKQFSGCNRAMELLTGLSEKQLIGLTPRDIYDEDAATKVLETDEKVFRHNVSLTYEQWLQYPDGRKACFEIRKVPYYDRVGKRSGLMGFGRDITERKRYQDALENASREKTTFISTISHELRTPLNGIVGLSRILLDTDLNQEQLKYLKTIHVSAITLGNIFNDVIEVDKIERRKVQLDNQPLDFTGFLADLENLSGLLAQPKGL

SEQ ID NO: 111895 - protein, 602 aa, Glycine max
  Coding DNA Sequence Number=SeqID_20210
  Gene Ontology: Mol. function=siderophore-iron transmembrane transporter activity; Cellular component=integral to membrane; Biological process=siderophore transport
  Homolog annotation: Hit_ID=A6TGW9; Match level="QueryCoverage=100%, HitCoverage=79%, E-value=0.0, Identity=70%"; Hit description=Outer membrane porin, receptor for ferric enterobactin and colicins B and D
  Pfam annotation: Domain name=TonB_dep_Rec; Domain location=320-602; Score=113.4; E_value=7e-31; Accession=PF00593.15; Description=TonB dependent receptor
MIDHIDVIRGPAAVRYGNGAAGGVVNIITKKYSDQQWHGSWNTYFNAPEHKSEGATKRTNFSLEGPLGDDFNFRLYGGLAKTQADAYDINEGHAAARTGSYAGSYPAGREGSVNKDINALLSWAFAPMQTLELQAGYSRQGNLYAGDTQNTNTNALVKSLYGDETNRLYRQNISLKWTGAWDNGISTSSWARYEKTRNTRINEGLAGGTEGIFSNSGFNTIQLDDVLLHSEISLPFELGVNQTATLGTEWNQQRMKDPSSTTQAASNGAVPGIASTGRSPYAQAEIFSLFAEDNMELTDSTMLTPALRFDHHSIVGNNWSPSLNLSQGLGDDFTLKMGIGRAYKAPSLYQTNPNYLLYSNGQGCAASTGACYLQGNPNLKAENSINKEVGLEWKHEGYQAGLTWFRNDYRNKIEAGYAPSGKASNGTTDIYRWENVPKAVVEGLEGTVNVPFSDSVMWNNNFTYMLQSKNKETGDRLSIIPEYTLNSTLSWQATQDLSLQTTLTWYGTQTPKKYDYKGQPVTGSATDKVSPYSIVGLSGTYDINKYASVTLGIDNLFDKRHFREGNAQTTGNATTGAYLYGAGANTYNESGRTYYMSLNTHF

SEQ ID NO: 111896 - protein, 208 aa, Glycine max
  Coding DNA Sequence Number=SeqID_20211
  Gene Ontology: Mol. function=transcription regulator activity; Cellular component=intracellular; Biological process=regulation of transcription termination
  Homolog annotation: Hit_ID=P37430; Match level="QueryCoverage=100%, HitCoverage=41%, E-value=3e-94, Identity=83%"; Hit description =Transcription elongation protein nusA
MAPADVASIVVDEDNHTMDIAVEAGNLAQAIGRNGQNVRLASQLSGWELNVMTVDDLQAKHQAEAHAAIDMFTKHLDIDEEFATVLVEEGFSSLEELAYVPINELLEIDGLDEETIEALRERAKNALTTLALAKEESLGNQEPAEDLLNLEGLDRALAYRLASKGVCTLEDLAEQGVDDLTDIEGLDDEKAGALIMAARNICWFGDDA

SEQ ID NO: 111897 - protein, 323 aa, Glycine max
  Coding DNA Sequence Number=SeqID_20212
  Gene Ontology: Mol. function=tRNA-pseudouridine synthase activity; Cellular component=ribonucleoprotein complex; Biological process =tRNA pseudouridine synthesis
  Homolog annotation: Hit_ID=A8G909; Match level="QueryCoverage=65%, HitCoverage=67%, E-value=1e-67, Identity=61%"; Hit description=tRNA pseudouridine synthase B
  Pfam annotation: Domain name=Ribosomal_S15; Domain location=213-286; Score=61.1; E_value=3.7e-15; Accession=PF00312.13; Description =Ribosomal protein S15
  Pfam annotation: Domain name=TruB-C_2; Domain location=152-209; Score= 91.6; E_value=2.4e-24; Accession=PF09157.2; Description=Pseudouridine synthase II TruB, C-termi
  Pfam annotation: Domain name=TruB_N; Domain location=1-80; Score =39.4; E_value=4.7e-09; Accession=PF01509.9; Description=TruB family pseudouridylate synthase (N terminal domain)
  Pfam module annotation: Pfam domain module=Ribosomal_S15::TruB-C _2::TruB_N; Domain location=213-286::152-209::1-80
MTFSQAELDVALESFRGETLQLPTMFSALKYQGRKLYEYAREGITVPREARPITVFELQFIRWQGDELELEIHVSKGTYIRTIIDDLGEKLGCGAHVIMLRRLQVARYPIARMMTLEQLQALAAQVNAAETPDYAPLDALLLPMDSPAEDFPAVNLPTPIAAWFKQGMPVQAENAPASGLVRVTEGEQQKFIGMAEIADDGRVAPRRLIVDVEAKAEIVAKYGRGANDSGSTEVQVALLTAQINHLQGHFSEHKKDHHSRRGLLRMPDRKPGSASLSLKNLINDVAHAQSGPNSCIVAESDLCLQRFARLMRGFTAGAVKGCH

SEQ ID NO: 111898 - protein, 535 aa, Glycine max
  Coding DNA Sequence Number=SeqID_20213
  Gene Ontology: Mol. function=ATP-dependent helicase activity; Cellular component=cytoplasm; Biological process=regulation of transcription, DNA-dependent
  Homolog annotation: Hit_ID=P0A9P7; Match level="QueryCoverage=100%, HitCoverage=85%, E-value=0.0, Identity=79%"; Hit description=Cold -shock DEAD box protein A
  Pfam annotation: Domain name=DEAD; Domain location=30-197; Score =263.8; E_value=3.6e-76; Accession=PF00270.20; Description=DEADDEAH box helicase
  Pfam annotation: Domain name=DbpA; Domain location=474-535; Score =79.3; E_value=1.3e-20; Accession=PF03880.6; Description=DbpA RNA binding domain
  Pfam annotation: Domain name=Helicase_C; Domain location=263-339; Score=122.0; E_value=1.8e-33; Accession=PF00271.22; Description =Helicase conserved C-terminal domain
  Pfam module annotation: Pfam domain module=DEAD::DbpA::Helicase_C; Domain location=30-197::474-535::263-339
MTDIQTTFADLGLNADILESLNGMGYVKPSPIQAECIPHLLAGRDVLGMAQTGSGKTAAFSLPLLNNVDPSVRAPQILVLAPTRELAVQVAEAMTEFSKHMRGINVVALYGGQRYDVQLRALRQGPQIVVGTPGRLLDHLKRGTLDLSSLRGLVLDEADEMLRMGFIEDVETIMAQIPEGHQTALFSATMPEAIRRITKRFMKDPQEVRIQSSITTRPDISQSYWTAYGRKSDALVRFLEAEDFDAAIIFVRTKNATLEVAETLERNGYNSAALNGDMNQALREQTLERLKDGRLDILIATDVAARGLDVERISLVVNYDIPMDAESYVHRIGRTGRAGRAGRALLFVENRERRLLRNIERTMKLTIPEVELPNAELLSQRRLAQFAAKVQQQLESSDLDQYRALLAKMQPEEELDMETLAAALLKMAQGERPLILPPDAPRPQRREFRDRDERGGDRPRRDSRDSREGGDRPRRERRDVGEMQLYRIEVGRDDGVEVRHIVGAIANEGDISSRYIGNIKLFGTHSTIELPKGMP

SEQ ID NO: 111899 - protein, 213 aa, Glycine max
  Coding DNA Sequence Number=SeqID_20214
  Gene Ontology: Mol. function=3-oxoacyl-[acyl-carrier-protein] reductase activity; Cellular component=cytoplasm; Biological process= metabolic process
  Homolog annotation: Hit_ID=A6EA44; Match level="QueryCoverage=78%, HitCoverage=66%, E-value=4e-31, Identity=43%"; Hit description=Short- chain dehydrogenase/reductase SDR
  Pfam annotation: Domain name=KR; Domain location=53-204; Score=-46.1; E_value=0.00012; Accession=PF08659.1; Description=KR domain
  Pfam annotation: Domain name=adh_short; Domain location=50-212; Score= 92.2; E_value=1.6e-24; Accession=PF00106.16; Description=short chain dehydrogenase
  Pfam module annotation: Pfam domain module=KR::adh_short; Domain location=53-204::50-212
MRLRLVPAPQICRIVQKACRIALPHKAATAHALLTRNLRWRDTMQALEGKIALVTGASKGIGAAIAMTFAAAGARVVVNYRQDEAGAADVVTDICALGSDAIAVQADISREADVQRLFASSIAQFGAPDIVVNNAGMFHHGDFASLSVSDMQQQLNVNLLGTLLVCQQAAQHFPARGGCIINLSALNSQRSLPGSVLWSATKGAIDTLTQGLA

SEQ ID NO: 111900 - protein, 192 aa, Glycine max
  Coding DNA Sequence Number=SeqID_20215
ACPRCGRCGACAAAQQGEQHADAQHNPVIPRKGVRIDRAGMHQRRQAQHNRQIEDIGANQVADGDIVFAFQRAGQHRGQFRQTGTDSNQRQSHHQFANAEVIRKHCGVVDHHARRHRQNNQRHRQPEKRHRVAAFVARQLRQLFTRQGVIIIALGPPGDADRHQQITQRQQQQCHAIQPAELVIKQHDAAEQ

SEQ ID NO: 111901 - protein, 606 aa, Glycine max
  Coding DNA Sequence Number=SeqID_20216
  Gene Ontology: Mol. function=nucleotide binding; Cellular component =intracellular; Biological process=small GTPase mediated signal transduction
  Homolog annotation: Hit_ID=P42641; Match level="QueryCoverage=58%, HitCoverage=93%, E-value=1e-148, Identity=73%"; Hit description =Uncharacterized GTP-binding protein yhbZ
  Pfam annotation: Domain name=GTP1_OBG; Domain location=3-158; Score =361.5; E_value=1.4e-105; Accession=PF01018.13; Description=GTP1OBG family
  Pfam annotation: Domain name=MMR_HSR1; Domain location=160-286; Score= 114.1; E_value=4.2e-31; Accession=PF01926.14; Description=GTPase of unknown function
  Pfam module annotation: Pfam domain module=GTP1_OBG::MMR_HSR1; Domain location=3-158::160-286
MKFVDEATILVVAGDGGNGCVSFRREKYIPKGGPDGGDGGDGGDVYLLADENLNTLIDYRFEKSFRAERGQNGQSRDCTGKRGKDIIVKVPVGTRVIDQGTGETLGDMTRHEQKLMVAKGGWHGLGNTRFKSSVNRTPRQKTMGTPGEKRDLQLELMLLADVGMLGLPNAGKSTFIRAVSAAKPKVADYPFTTLVPSLGVVRMDSEKSFVVADIPGLIEGAAEGAGLGIRFLKHLERCRGLLHLIDIAPIDESDPVENARIILGELEKYSDKLYQKPRWLAESRAKAIAEALGWDEKYYLISAASRDGVNELCWDVMSFIIANPKEAEEEAKQPEKVAFMWDDYHREALENAQEVEEDEDWDDDWDEDDDEGRRAPARTIIPSPRGREHQAAPSFPLPVGEGRVRASGRSGTKPTPAPPPSAANYSTTDRDHCVSQSASSDCAPPDAADDKHRAPRRCSPPDDGWRSPQCPPRFYLLPRSGNRQWSPSTPPAPPTRRRAADQTAAACGCLPAWWPPDNRHRWRKHDAQMRHQRVIAQLIQRGDIHRTFPDCHASGSQRWRHRPPQYPAAPRGWQDPEARNRCCSRSSCGGRSYAAGSPVCTDPGNR

SEQ ID NO: 111902 - protein, 214 aa, Glycine max
  Coding DNA Sequence Number=SeqID_20217
  Gene Ontology: Mol. function=iron ion transmembrane transporter activity; Biological process=high-affinity iron ion transport
  Homolog annotation: Hit_ID=A8GHD0; Match level="QueryCoverage=95%, HitCoverage=64%, E-value=3e-73, Identity=68%"; Hit description =Periplasmic binding protein precursor
  Pfam annotation: Domain name=Peripla_BP_2; Domain location=38-214; Score=0.9; E_value=9.8e-05; Accession=PF01497.9; Description =Periplasmic binding protein
  Subcellular localization annotation: CTP_CleavageSite=60; ConfidenceScore=5.44e-01
MAVLLFIFQSLSGTARADQGWPRSVQGATGTVTLHQAPQRIVSTSVTLTGSLLAIGAPVIASGATAPKSRLADDQGFFRQWGEVAKQRHVKRLYIGEPSAEAIAAQAPDLIIVSATGNDSALKLVSQLSAIAPTLVVNYDDKSWQDVVTLLGQATGHEAQAAQRVKEFDDREAALKQAITLPPQPVSAMVWNGDGRAVNLWTAASAQGKLLQQL

SEQ ID NO: 111903 - protein, 301 aa, Glycine max
  Coding DNA Sequence Number=SeqID_20218
  Gene Ontology: Mol. function=transporter activity; Cellular component= integral to membrane; Biological process=iron ion transport
  Homolog annotation: Hit_ID=A7MKZ5; Match level="QueryCoverage=22%, HitCoverage=21%, E-value=1e-11, Identity=55%"; Hit description =Putative uncharacterized protein
  Pfam annotation: Domain name=FecCD; Domain location=13-284; Score= -127.2; E_value=8e-06; Accession=PF01032.9; Description=FecCD transport family
MRQIRALAGSGILLLLLMALSLMLGAKSIPLSDVYHALTASCSSAECIIVRDARLPRTLAGLLAGVALGLAGALMQSLTRNPLAEPGILGVNAGAVADAGLQRRAAGGAADDGDWRDGRRARQSGASDAGGRGAGGGAGGLNLRPVAAQSGHLRSPALLAKRLAGYPRFQRVAHPEPGGAGRCGAGAGAGAIAEQPEHGRRYGGGAGHARGAHSTAGPAGDCLTERRGDRRRRTDRFYRPDDAAFCPLAGGQRSPLAAAGDGADHPGAAAGGGYSGADDGGRRTACLNSDRHSRRADADFA

SEQ ID NO: 111904 - protein, 511 aa, Glycine max
  Coding DNA Sequence Number=SeqID_20219
  Gene Ontology: Mol. function=hydrolase activity, acting on acid anhydrides, catalyzing transmembrane movement of substances; Cellular component=proton-transporting two-sector ATPase complex; Biological process=siderophore transport
  Homolog annotation: Hit_ID=A6T631; Match level="QueryCoverage=81%, HitCoverage=56%, E-value=0.0, Identity=77%"; Hit description=Outer membrane porin, receptor for ferric enterobactin and colicins B and D
  Pfam annotation: Domain name=Plug; Domain location=101-221; Score =105.4; E_value=1.8e-28; Accession=PF07715.6; Description=TonB -dependent Receptor Plug Domain
MSTHVPSGTRCERLRDKDRDLLTGSPVTPLWRRTGLPGMKKMNHYSRLTFAILIELGLSASLLSGSAWAAETSSKTTSSNASSSDASAMDGGTLMVTAQQQTLQAPGVSTITADEIKKHPPARDVSEIIRTMPGVNLTGNSTSGQRGNNRQIDIRGMGPENTLIMVDGMPITSRNSVRLGWRGERDTRGDTNWVPPEMIDHIDVIRGPAAVRYGNGAAGGVVNIITKKYSDQQWHGSWNTYFNAPEHKSEGATKRTNFSLEGPLGDDFNFRLYGGLAKTQADAYDINEGHAAARTGSYAGSYPAGREGSVNKDINALLSWAFAPMQTLELQAGYSRQGNLYAGDTQNTNTNALVKSLYGDETNRLYRQNISLKWTGAWDNGISTSSWARYEKTRNTRINEGLAGGTEGIFSNNGFNTIQLDDVLLHSEISLPFELGVNQTATLGTEWNQQRMKDPSSTTQAASNGAVPGIASTGRSPYAQAEIFSLFAEDNMELTDSTMLTPALRFDHHSI

SEQ ID NO: 111905 - protein, 16 aa, Glycine max
  Coding DNA Sequence Number=SeqID_20220
EIKNYEKYGSPPRRHK

SEQ ID NO: 111906 - protein, 303 aa, Glycine max
  Coding DNA Sequence Number=SeqID_20221
  Gene Ontology: Mol. function=chitin binding; Cellular component =extracellular region; Biological process=chitin metabolic process
  Homolog annotation: Hit_ID=UPI00006A17C9; Match level="QueryCoverage =67%, HitCoverage=99%, E-value=2e-26, Identity=29%"; Hit description =UPI00006A17C9 related cluster
MASPMTCRGASEPDDTQRLTSSSAPLSSRDGESDDMRGDGESNDMRGYLMVIRTFCHPETASPMTCGGASEPFDTLTLTSSSAPLSFRDGESDDIRGTCIPLKARACGPLMASTCSPLKMRMCSPLKVKTCNPLKVKACSPLKATTCTPLKARVCSLLKARTCSPLKGSACSPTKARARSPLKARTCSPLKVRASSPVKARVCSLLKVSTYSHLKVRTCSPLKAGTCSPLKVRACSPLKGRACSPKKARAWSPRKARMCSTPKVRASSPVKARSCRLLKVRTCSPLKERTCSPLKAGTCSPLK

SEQ ID NO: 111907 - protein, 113 aa, Glycine max
  Coding DNA Sequence Number=SeqID_20222
MSVCVAQLIADALYLFAGMPPTRHPLNLDKSNRALGQSGFQAQGDAPQAAHAPPPPHQADPAGSLGMEWYLQHLVRQQAANHRGQVQIHECLYQLSLSQQGQGFVPFVCPTPD

SEQ ID NO: 111908 - protein, 113 aa, Glycine max
  Coding DNA Sequence Number=SeqID_20223
VAWPGAQPSFVRDNVSSTAQKPQQQKPELETDQSSEATVPGAFEVLEGRLEMRSDEAAYPEPVPVPADPSSLVVDPSFPTPEAALPSTPIIISDDPTVQAPGLAPTPPATPEL

SEQ ID NO: 111909 - protein, 34 aa, Glycine max
  Coding DNA Sequence Number=SeqID_20224
MNLGHIACCVWTDERERERSLNNTKRNWRRAHDR

SEQ ID NO: 111910 - protein, 79 aa, Glycine max
  Coding DNA Sequence Number=SeqID_20225
  Subcellular localization annotation: CTP_CleavageSite=21; ConfidenceScore=5.04e-01
MTKSSKIHPKNNSSKSKNNPRVQVENQEEFKTQEKSLESRVKIQGSRSQESRSRFNTQDSRIKRRLNQDKYEKFFSKTE

SEQ ID NO: 111911 - protein, 133 aa, Glycine max
  Coding DNA Sequence Number=SeqID_20226
MKEGIGHILDLTPIGEKMKESLNINLSYFHGKDNVEAYLDWEIRVEQKLKRKSTLKSYGSHSYPNNDQGHITSQCPTKKTMIMRSQDIYSSQDEATTSPSSSENEEAKGEESSEEIYPQEEGQPLMVQEEYKD

SEQ ID NO: 111912 - protein, 78 aa, Glycine max
  Coding DNA Sequence Number=SeqID_20227
  Gene Ontology: Mol. function=aspartic-type endopeptidase activity; Biological process=DNA integration
  Homolog annotation: Hit_ID=A5AT67; Match level="QueryCoverage=85%, HitCoverage=6%, E-value=1e-10, Identity=55%"; Hit description =Putative uncharacterized protein
PSGSNDPKKQQATSHVCEDRHWFKEFRPIDDDSIVKMGNVATEPILGLDCVNLVFTSGKSLYLDNVLFVPGIRKNLLS

SEQ ID NO: 111913 - protein, 110 aa, Glycine max
  Coding DNA Sequence Number=SeqID_20228
MAPKKLSTNRYRRDAATEGTSAAPEFDSHYFKSAEHQQRFEAIKGWSFDRERHVQLRDDEYTDFQEEIARRHWTSLVTPVTKFDPDIVLEFYSNAWPTEEGVRDMRSWVR

SEQ ID NO: 111914 - protein, 122 aa, Glycine max
  Coding DNA Sequence Number=SeqID_20229
MQGAKRKLLQTVGERWRQFKSDLTRKFALAADQDGVEEAVCDKYGISKEKWAQFCQTRRDPSWEDVRIKAQAIRKQNTAPHVLSRGGYDYLEQKLLAEKTKKKLQEAVQSGSVDDVIDPPFP

SEQ ID NO: 111915 - protein, 140 aa, Glycine max
  Coding DNA Sequence Number=SeqID_20230
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTRMPFIETSVKDPLWD

SEQ ID NO: 111916 - protein, 198 aa, Glycine max
  Coding DNA Sequence Number=SeqID_20231
  Gene Ontology: Mol. function=structural molecule activity; Cellular component=cytoplasm; Biological process=keratinization
  Homolog annotation: Hit_ID=Q28658; Match level="QueryCoverage=40%, HitCoverage=56%, E-value=3e-09, Identity=36%"; Hit description=Small proline-rich protein 3
MVANLRIYLLLEDAPVSLASLARERACCDSSLRRTTRPHLRMNTRPHFQRATRPCLQRTTRPRLQRAARAHLQRTTRPRLQRAARPRLRWTTRPHLQRTTRANLQRATRPRLQRTIEGYTPLPSEDYTSSPSEGCTCSPSEDITLSPSEGYTPLPSEDYTLSPSEGYTPSPLEGYTANEYTSSPSEGCTTSPSTDYTS

SEQ ID NO: 111917 - protein, 122 aa, Glycine max
  Coding DNA Sequence Number=SeqID_20232
  Gene Ontology: Mol. function=aspartic-type endopeptidase activity; Biological process=DNA integration
  Homolog annotation: Hit_ID=A5BKB9; Match level="QueryCoverage=90%, HitCoverage=10%, E-value=1e-21, Identity=46%"; Hit description =Putative uncharacterized protein
MRLKNQGSHSVHYGFLTIHTISPNEKFVFIGNRVKAPVEVVETYRLKLDTGHHLDLLETLYAPSISRNLVSLSKLDVTRYSFNFDNRCFSLFKHNHLIGIGVLCDILTLHHNPDTKCSLMNE

SEQ ID NO: 111918 - protein, 100 aa, Glycine max
  Coding DNA Sequence Number=SeqID_20233
  Homolog annotation: Hit_ID=UPI0000ECBAF8; Match level="QueryCoverage =41%, HitCoverage=48%, E-value=1e-16, Identity=100%"; Hit description= UPI0000ECBAF8 related cluster
  Subcellular localization annotation: CTP_CleavageSite=20; ConfidenceScore=5.01e-01
KRKSAQYANRLSPRVGRFINAAGTTADNNFTQETAMTMITNSSSVPEGMQAWHWPSFYNVVTGKTLALPNLIALQHIPLSPAGVIAKRPAPIALPNSCAA

SEQ ID NO: 111919 - protein, 88 aa, Glycine max
  Coding DNA Sequence Number=SeqID_20234
MLNPTQFQAKEEKVKAADDSLSEVDPLSEMHPLSKASSLLSGWETLEEDKLEICMPSTQPARPARSLFLLALSVPTLAKQKFTNSRLA

SEQ ID NO: 111920 - protein, 689 aa, Glycine max
  Coding DNA Sequence Number=SeqID_20235
MHEHIGQRLARQWTAVGQRIRNVLLLAAATAEHGFQVRHIGIDVRRQHRDLARLQRRVEARILQQAAQLVVQHLQLAQPGMAGVHLQAGVVTAQAFAQLARGQCAAVEQIALQAMQQAVGQAAFVQGRPGVLLRIGIGGDLAGRMHHLVTAEHRHEVAAGRTPGFQQAVLAGRFTEGIGRAAAQALGQRLQVAPVRLNRGGHVEVQLAHPGLGGHHPQHVGRDVERRKRRHARRQALRQRLAGAFEAVQVLLDAAGAIVVAPGDGAPQDCLRIGRIGPGRPAQQPVTPPGLVLLEHRGQLAGQRPRLQSIIAGKIRLQRAHRWLRQQRRIAQRLVQLPVQAGGVQIVLLTADVGLQRARHELARGQEFEVGSNAELGRQCRLQPTPHRHLRDQHHFRRQQRLARYRRTHVARQQRGQHVQGVGMVEAEIAAWVTHHAQCAGRQAVFNGQPIAGTDCSGLPGDCPGLREALPCNNTGPSSLLMFSRRAHVAVVKEFYANLYTTEEQAPKQAREIEARLCIPRKGFVLNAEGQPWKLLRKDLKTLAKTWSVFPYSNLAPTSHTSDLDMDRGRLVYGLVTNRDMNIRALILGQIYSIAQSNSSRLRFPALMTALCRARGVTSHSLTYESLSLAINLAYIKKNCWNVDDLTVNFRGVRKARVRPTHVPSSTLPAPSTSATPTPAPPGSSTKDS

SEQ ID NO: 111921 - protein, 165 aa, Glycine max
  Coding DNA Sequence Number=SeqID_20236
MSRESRPLRVWRIRKIERVWLCRETCMSVYACHTLVHMVPVDRPDATPITIDHHRFQSSFRAQNFMLFSPSPFIHLLLLPSSYPWPPMVESIDEEDPRPTSSNGAYINRYYYIPWGFMSHWKLEWFEDISFYLGMEVPYDAQECNVTLMRFDAKVNVLSWRFELV

SEQ ID NO: 111922 - protein, 136 aa, Glycine max
  Coding DNA Sequence Number=SeqID_20237
MALFTGKTHISPLKKCLVPSTQLCPPPSLIHLEKFRRAVQQKEPLTDDQRFPLAFVNSNRLPESCFFESVSTKPIQRKTIIVQSPAWMSSSTTTTMDSSNAATSHQDATALAYTWQPTIISSINRGFTSNNLAKPP

SEQ ID NO: 111923 - protein, 332 aa, Glycine max
  Coding DNA Sequence Number=SeqID_20238
  Gene Ontology: Mol. function=mannitol-1-phosphate 5-dehydrogenase activity; Biological process=metabolic process
  Homolog annotation: Hit_ID=A7ZTE9; Match level="QueryCoverage=68%, HitCoverage=59%, E-value=1e-116, Identity=92%"; Hit description =Mannitol-1-phosphate 5-dehydrogenase
  Pfam annotation: Domain name=Mannitol_dh_C; Domain location=1-226; Score=381.3; E_value=1.6e-111; Accession=PF08125.4; Description =Mannitol dehydrogenase C-terminal domai
  Pfam annotation: Domain name=MtlR; Domain location=213-332; Score =159.7; E_value=7.8e-45; Accession=PF05068.3; Description=Mannitol repressor
  Pfam module annotation: Pfam domain module=Mannitol_dh_C::MtlR; Domain location=1-226::213-332
HVGFVDSAVDRIVPPSESATNDPLEVTVETFSEWIVDKTQFKGALPTIPGMELTDNLMAFVERKLFTLNTGHAITAYLGKLAGHQTIRDAILDEKIRAVVKGAMEESGAVLIKRYGFDADKHAAYIQKILGRFENPYLKDDVERVGRQPLRKLSAGDRLIKPLLGTLEYGLPHANLVKGIAAAMHYRSEQDPQAQELAQLIDDQGAQAALAQISGLDANSDVVAEAATMEQTQAFENRVLERLNAGKTVRSFLITAVELLTEAVNLLVLQVFRKDDYAVKYAVEPLLDGDGPLGDLSVRLKLIYGLGVINRQEYEDAELLMALREELNHDGN

SEQ ID NO: 111924 - protein, 117 aa, Glycine max
  Coding DNA Sequence Number=SeqID_20239
MEKGQGRSCLAQRLLNFDSPGQQAGGVLILCDNTTERVALLGGQLCDNTTEKAALSFNMLWSQRPYEIVMSFTRSKPGPRAVRKIGRNLSGTTHPTLPPIGGRPFYSRPKRNCSDLE

SEQ ID NO: 111925 - protein, 58 aa, Glycine max
  Coding DNA Sequence Number=SeqID_20240
MKILQKKSNQMMNFQKNGKLQKIIPLTTLLVISQKGNPQQNGVVERKNRSSWKSARSH

SEQ ID NO: 111926 - protein, 214 aa, Glycine max
  Coding DNA Sequence Number=SeqID_20241
  Homolog annotation: Hit_ID=A7PX73; Match level="QueryCoverage=72%, HitCoverage=61%, E-value=1e-45, Identity=64%"; Hit description =Chromosome chr12 scaffold_36, whole genome shotgun sequence
MERWEGSTKYKSNRVTWKMSFLAGRLAGKEAAYFFQESKQAVGKLAQKNPLPKTNNNNLNFHEGYDHADVLPEVLRHSLPSKVFRNDEATSFSFSASKWVLHSDPKTQSSVSPDALNPLRAYLSLPQVTFGPKRWQLPEAANTVSASTANESRLDRYATHVNPEKLKAAGEGLAHDNGLWKTEGVVKAHHNLRSSCDPSIECDTLFNFDKICQS

SEQ ID NO: 111927 - protein, 412 aa, Glycine max
  Coding DNA Sequence Number=SeqID_20242
  Homolog annotation: Hit_ID=Q2HW90; Match level="QueryCoverage=69%, HitCoverage=66%, E-value=2e-26, Identity=28%"; Hit description =Putative uncharacterized protein
MEPLQMQAFRKTYGKILDLTIAEVFIEAIASLTQYYDQPLRSFTFRDFQLVPTIEEFEEILGCPLGGRKPYLFSGCLPSLSRIATVVKDSARDGLVDLAAIGAFLAYHHSKESPVVAVLADLFDTFDRRCEKSSARIICCLPALCVWLGSHLFQQNTRHPCPLQSHRSCAEKRGIDWDQLLAGIGGRTISWFPRWKEGKEGVLFSCGGYPNIPLIGTRGCINYNPALAIRQLGYPMRGAPMKESMSPFLVRDFGTQNFKAIQRIHKAWETPLRKDQELRGIRNGIIGGYHEWLKVHIRGLDWLAKLKVVSEDSFEAPEEDEEVQALINELGKAKLAKEKFKLAATHIRKECAELQEENATTARALEQETKRARKEEYGRNKFRGALWSSNSELKLRREERDQSRAHSMVLKE

SEQ ID NO: 111928 - protein, 96 aa, Glycine max
  Coding DNA Sequence Number=SeqID_20243
MAKFDPDIVLEFYANAWPMEEGVRDMRSWVRGQWIPFDADAISQFLGYPLVLEEGQECEYGQRRNREASANHAHQHDHPDPDMDDVAPQQHPAQRS

SEQ ID NO: 111929 - protein, 118 aa, Glycine max
  Coding DNA Sequence Number=SeqID_20244
  Pfam annotation: Domain name=zf-CCHC; Domain location=51-68; Score =26.3; E_value=0.00011; Accession=PF00098.14; Description=Zinc knuckle
  Pfam annotation: Domain name=zf-CCHC; Domain location=71-88; Score =2.2; E_value=0.71; Accession=PF00098.14; Description=Zinc knuckle
  Pfam module annotation: Pfam domain module=zf-CCHC::zf-CCHC; Domain location=51-68::71-88
MKNKKNRPQHRGKPYSTLSKEYGNRSNNQRTVAIGLVGGSGSKPTNFSTHVTCYKCGKLRHISSNCAEKDMTYFNYRQKEHIKRDCPYPKKEQNGGGLNDYWRLATYFHCLVVWCCLE

SEQ ID NO: 111930 - protein, 276 aa, Glycine max
  Coding DNA Sequence Number=SeqID_20245
DWLAKLKVVSEQNFEAPEEDEEVQALKSELGKAKLAKEKFKLAATHVRKECAGLREENAITARALERETKRARKEEYGRNKFRGALWGSNNELKLRREERDQSRAHSMVLKEELVACSRSKRSLSQRLCETETNMLAIIAKYQEELGLATAHEHRIADEYAQVYAEKEARGRVIDSLHQEATMWMDRFALTLNGSQELPRLLAKAKAMADTYSAPEEIHGLLGYWKHTITKRAARDPYRTRSKSRTMGDQEETQEQDESRHVGSERTNGLHDGGGC

SEQ ID NO: 111931 - protein, 59 aa, Glycine max
  Coding DNA Sequence Number=SeqID_20246
VEGRSPEYEEPQDLRSNPFQALASHLKEVSLAIRELLKEVFSKKLLKEVFSRKLLKEAT

SEQ ID NO: 111932 - protein, 213 aa, Glycine max
  Coding DNA Sequence Number=SeqID_20247
  Homolog annotation: Hit_ID=UPI0000ECBAF8; Match level="QueryCoverage =19%, HitCoverage=48%, E-value=3e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLLYSTTMIFKKQRIPFDEEDPRPTSSTWSYINRPAGMQAWHWPSFYNVVTGKTLALPNLIALQHIPLSPAGVIAKRPAPIALPNSCAA

SEQ ID NO: 111933 - protein, 25 aa, Glycine max
  Coding DNA Sequence Number=SeqID_20248
MTWLDFVECPKVQDEQMENLEMDLM

SEQ ID NO: 111934 - protein, 129 aa, Glycine max
  Coding DNA Sequence Number=SeqID_20249
MVLNQIMMKDNYQLKGTLLSFNVFWTGMMDSKPMLVRGLMLWNNRWTCDSMQWTQGSQKLKKMIVIIKKGEIVEAMSSKVILMMPKNQELNKVFKQRFKNQVSRFKTQESRFKNNQDSRLKNQEKTQSR

SEQ ID NO: 111935 - protein, 252 aa, Glycine max
  Coding DNA Sequence Number=SeqID_20250
  Gene Ontology: Mol. function=protein binding; Cellular component =mitochondrion; Biological process=defense response to fungus
  Homolog annotation: Hit_ID=Q1SWI6; Match level="QueryCoverage=86%, HitCoverage=92%, E-value=9e-42, Identity=45%"; Hit description =Leucine-rich repeat, plant specific
  Pfam annotation: Domain name=LRRNT_2; Domain location=27-67; Score =49.5; E_value=1.2e-11; Accession=PF08263.3; Description=Leucine rich repeat N-terminal domain
  Pfam annotation: Domain name=LRR_1; Domain location=126-151; Score =7.0; E_value=15; Accession=PF00560.24; Description=Leucine Rich Repeat
  Pfam annotation: Domain name=LRR_1; Domain location=153-175; Score =16.2; E_value=0.12; Accession=PF00560.24; Description=Leucine Rich Repeat
  Pfam annotation: Domain name=LRR_1; Domain location=177-202; Score =11.9; E_value=1.9; Accession=PF00560.24; Description=Leucine Rich Repeat
  Pfam annotation: Domain name=LRR_1; Domain location=204-226; Score =13.8; E_value=0.66; Accession=PF00560.24; Description=Leucine Rich Repeat
  Pfam module annotation: Pfam domain module=LRRNT_2::LRR_1::LRR_1::LRR_ 1::LRR_1; Domain location=27-67::126-151::153-175::177-202::204-226
MNSSSIYILVFVQLWLLSLPCRESVCIPSERETLLKFKNNLIDPSNRLWSWNHNNTNCCHWYGVLCHNVTSHVLQLHLNTSDSVFEYDYDGHYLFDNKAFKAFDEEAYRRWSFGGEISPCLADLKHLNYLDLSANYFLGEGMSIPSFLGTMTSLTHLNLSHTGFNGKIPPQIGNLSKLRYLDLSGNYLLGGGMSIPSFLGTMTSLTHLDLSGTGFMGKIPSQIWNLSNLVYLGLGGDSDVEPLFAENVEWLS

SEQ ID NO: 111936 - protein, 110 aa, Glycine max
  Coding DNA Sequence Number=SeqID_20251
  Homolog annotation: Hit_ID=Q7PDL8; Match level="QueryCoverage=55%, HitCoverage=8%, E-value=1e-07, Identity=40%"; Hit description =ERYTHROCYTE MEMBRANE PROTEIN PFEMP3
  Subcellular localization annotation: CTP_CleavageSite=64; ConfidenceScore=5.74e-01
MCSPLKARTCSPLKARACSPLKVRACSPLKARTCSPLKVRACSPLKARTCSPLKARTCSPLKVRMMTKSPKNDFKIESTSSRSSLISSFMRRNQEDSRIKKSLISRFKRR

SEQ ID NO: 111937 - protein, 100 aa, Glycine max
  Coding DNA Sequence Number=SeqID_20252
MPNHNLADFEPCLGYATEGQAVGGIPLQNTLESPQYHPQPHPSHSTAIKNPHAMAEVGKLDHLEERLRAIEGGKDYAFANLEELFLVLEHGHSQVQGARL

SEQ ID NO: 111938 - protein, 154 aa, Glycine max
  Coding DNA Sequence Number=SeqID_20253
  Homolog annotation: Hit_ID=Q5QJQ3; Match level="QueryCoverage=20%, HitCoverage=24%, E-value=7e-11, Identity=96%"; Hit description =Putative uncharacterized protein
DAGSRQARQGASAGVGGCRGWLNYAASEQIVLRVHHMRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPNAAPYPVTIVLSPT

SEQ ID NO: 111939 - protein, 108 aa, Glycine max
  Coding DNA Sequence Number=SeqID_20254
MHRRPQTHRHHLIRLVQLGHLAWSGIYSTWFASRRPTTGGSLSQQSQGFAPFACPNLDHFRAEVAWPRDWPEAQVGEAPVEAPGDAEEARTDEEMIDLLGFLGGSGAM

SEQ ID NO: 111940 - protein, 145 aa, Glycine max
  Coding DNA Sequence Number=SeqID_20255
MSEIEEVQEQMKADMVAMKEQMTTMIEAIMSMRKMMEVNMDIVVATSTTTEVDPTHPSGLNQVNPPVSDMVGLGGKALGSTGGPHFVQVQNRHSFPPYGLPPNYTAPNVAHAPDENVNNSTPILIESQQPQSGQAQVPQPMGGDT

SEQ ID NO: 111941 - protein, 146 aa, Glycine max
  Coding DNA Sequence Number=SeqID_20256
TEAQPSLRQTITQAEGETTRTPWEYPFRDSFLSYFSSTCESEQMLKRRMPNVKMKGCTSIDKWQRRSPQTQSPQCGCSHGSTGQFDTKTISGRRRKKKNDRVQVRWLCNFISLIYNDNNIGFLKITDVNINYVTSVFLKPMLTSTR

SEQ ID NO: 111942 - protein, 110 aa, Glycine max
  Coding DNA Sequence Number=SeqID_20257
MQNSGVTLRAESQHFTSVHDDNPCVAFILYFGFIEEIWELNYVKFIVCVFKLVLHGKTIGVNVEDDDSYIDTYVSPLYIQMSPNVVREEEAEDIHANHNNHDEGELINIV

SEQ ID NO: 111943 - protein, 75 aa, Glycine max
  Coding DNA Sequence Number=SeqID_20258
HPVDPKKSNRVLGLPALITSLCQFYGVSVNPNKLIRPRINRAFIKKYCPPSRRKARHHNNLGMAGSGQQTHRHHH

SEQ ID NO: 111944 - protein, 115 aa, Glycine max
  Coding DNA Sequence Number=SeqID_20259
MDCPLYIRAGSGICVDVGGITVVEEGTGAVEEEGAGVSGGAEVVGTSDLLPLAFLGPLNVTVGSSRFQQFFLIYVKLMVGLKFSRDLESDWTPLALHRAVIQAGNPSLDVSCCAI

SEQ ID NO: 111945 - protein, 134 aa, Glycine max
  Coding DNA Sequence Number=SeqID_20260
SRYITGLNRTSVYKVIVISICSELAILNFERLDILPDSIGHPSKKLLSFEFPTSFRFQFGASRYITGLNRTPCIKLLSIQFARAPDQNFERLDILRDSITDIRVKSYCRLNLIPASVFNLEHLDILHDLHRTSE

SEQ ID NO: 111946 - protein, 123 aa, Glycine max
  Coding DNA Sequence Number=SeqID_20261
MANIMMKINKKQRKCSTLFMLLTRSFVVRWKDELEPTWHLLHSSGNMHFVTYSQDLVSSTLLVGWTELREFYGLTGNHQFLTQPLKVLLTEYKVTCNRCAEYHVLIDESYKIHPSEVGRDYRV

SEQ ID NO: 111947 - protein, 179 aa, Glycine max
  Coding DNA Sequence Number=SeqID_20262
MERSMIDAASGGALGDMTPAEARNLIVKMASNSQQFSAINDAIVIRGVHEVATNSTASSETKKLEGKLDALVNLVTQLALNQKSVPVARVCGLCSSTDHHTDLCPSMQQPGAIEQLKAYAANIYNRPPQPQQQNQPQQNNYDLSSNRYNPGWRITLILDGLALSNNNSSLLLPSKMLLA

SEQ ID NO: 111948 - protein, 122 aa, Glycine max
  Coding DNA Sequence Number=SeqID_20263
MLDIISKYQEELSLATAHKHRVADEYAQVYAEKEARGRVIDSLHHEATMWMDRFAFTLNGNQELPGLLAKAKAMADTYSTPEEIHRLLSYCQHRIDLMAHMIRNRQEVCIVAQILTSYKLSE

SEQ ID NO: 111949 - protein, 119 aa, Glycine max
  Coding DNA Sequence Number=SeqID_20264
MTLLLSNIPPDDHNADLPPVEVSVGLCHRDIGIAPTRHPVDLEKSNRTLGFPALVSGLFHSYRVPVPLTRSCHRDIGIVPTRHPTDPEEPNRAQGFPALVTSLCQSYRVPVPPNKVTPS

SEQ ID NO: 111950 - protein, 130 aa, Glycine max
  Coding DNA Sequence Number=SeqID_20265
  Homolog annotation: Hit_ID=A6FJQ2; Match level="QueryCoverage=29%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTCKTTASAKLACLQVDSRGSPMARNHGRQSERLSGVPSSNS

SEQ ID NO: 111951 - protein, 54 aa, Glycine max
  Coding DNA Sequence Number=SeqID_20266
MAYGHVPDRWVWKHEPNGLYSTRTVYKLLQGKPGSQRYMGSQDRRGITDGRLGG

SEQ ID NO: 111952 - protein, 89 aa, Glycine max
  Coding DNA Sequence Number=SeqID_20267
EAEETQVRQVAAATPERSLEATLEPSAQGEDTPSPQPVANPFIPLLEMPEDSTTSVLAMDTSPPATLVLHLTNEEDVQTQDTQDQSQEF

SEQ ID NO: 111953 - protein, 40 aa, Glycine max
  Coding DNA Sequence Number=SeqID_20268
MALWRGSTKSYLKELGDKLEPRALKCILIGYPQGVKGYKL

SEQ ID NO: 111954 - protein, 125 aa, Glycine max
  Coding DNA Sequence Number=SeqID_20269
  Homolog annotation: Hit_ID=A6FJQ2; Match level="QueryCoverage=30%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVDSRGSPNVRGKGDKDDEVQVGVKVPLEGMGNVQDGGIDRVHIEVLMYYVEGPVKNFENLIAISLLPNHERVSGI

SEQ ID NO: 111955 - protein, 197 aa, Glycine max
  Coding DNA Sequence Number=SeqID_20270
  Homolog annotation: Hit_ID=Q2HW90; Match level="QueryCoverage=91%, HitCoverage=36%, E-value=2e-19, Identity=34%"; Hit description =Putative uncharacterized protein
MGTNQTGKRFYQVKVKGLDVTSIKELGRLMRPLQMQAFRKTYGKILDLTIAEVSIEAIASLTQYYDQPLRCFTFGDFQLVSTIEEFEEILGCPLGWRKPYLFSGFLPSLSRIATVVKDSARGLDRVKQTRNGIAGLPRKYLEDKARDMANQEEWVPFMDVLELLIFGVVLFPNVDGLVDLAAIDAFLAYHHSKESPV

SEQ ID NO: 111956 - protein, 196 aa, Glycine max
  Coding DNA Sequence Number=SeqID_20271
MLTSLERLQMTTLVSACQSDLGSLNNEVRITVRCLRMLPDSQRKRCARITIGCLRMPPDSRVRTTKRGVVNKSEAFAPTYPLSVMRNSDLRSSCKSGADNRKVSPHDSGLSGHDSKSCAWITIGCLRMPPDSQCVSSSTVSDSSFLGDPTVPSFEGKDGNSHPGSRFMVSWDFGSRLVEWLDMMYVRVSVWPAVQG

SEQ ID NO: 111957 - protein, 42 aa, Glycine max
  Coding DNA Sequence Number=SeqID_20272
MNLLPSAVHASSTNESGAPRIYCLALFMCPPLSSAEPPKKKE

SEQ ID NO: 111958 - protein, 71 aa, Glycine max
  Coding DNA Sequence Number=SeqID_20273
MASYGGELLLDSLLLEVASPIIFLPSRFRCHNLQEANDSIDEEDPRPTSSKWRYIMWYQEHLPLGSIIFQS

SEQ ID NO: 111959 - protein, 297 aa, Glycine max
  Coding DNA Sequence Number=SeqID_20274
  Gene Ontology: Mol. function=hydrolase activity, acting on carbon -nitrogen (but not peptide) bonds; Cellular component=cytoplasm; Biological process=cytosine metabolic process
  Homolog annotation: Hit_ID=A4WFG7; Match level="QueryCoverage=99%, HitCoverage=68%, E-value=1e-156, Identity=90%"; Hit description=N -isopropylammelide isopropylaminohydrolase
  Pfam annotation: Domain name=Amidohydro_3; Domain location=1-243; Score=109.4; E_value=1.1e-29; Accession=PF07969.2; Description =Amidohydrolase family
MLEVKQEVAPWVTLQIVAFPQEGILSYPNGAALLEEALQLGADVVGAIPHFEFTREYGVQSLHIAFELAKKYDRPLDIHCDEIDDEQSRFVETVATLAYEAGIGARVTASHTTAMHSYNGAYTSRLFRLLKMSGINFVANPLVNIHLQGRFDDYPKRRGITRVKELQAAGINVCFGHDDVFDPWYPLGTGNMLQVLHMGLHVCQMMGYPQIDSGLNLITHNSARTFGLSDYGIETGNPANLIILPAESGFEAVRCQVPVRWSIRQGRIIATTQLAQTWIQMDNGGEEVSFARNTPSA

SEQ ID NO: 111960 - protein, 223 aa, Glycine max
  Coding DNA Sequence Number=SeqID_20275
  Gene Ontology: Mol. function=siderophore-iron transmembrane transporter activity; Cellular component=cell outer membrane; Biological process=siderophore transport
  Homolog annotation: Hit_ID=A0TV10; Match level="QueryCoverage=71%, HitCoverage=22%, E-value=1e-44, Identity=55%"; Hit description=TonB -dependent siderophore receptor precursor
  Pfam annotation: Domain name=Plug; Domain location=83-182; Score =75.0; E_value=2.5e-19; Accession=PF07715.6; Description=TonB -dependent Receptor Plug Domain
MTPVALPPVAFVPRRLPAFRLTLAAALLAQAGLPVLARAADEVPQLSPVRVTGAAEKLSDPGQTEGSQSYTAHTVTIGKTGANVRDIPNSVSVVTRQRMDDQNMVTVEDALRQTTGVSAMTYGDGTAYFTARGYETDVQFDGVPANGALQYLPQFDLALYDRVEVLRGPAGLLQGFGSPAGTVILVRKRPQDAFSLTGAVMAGSWNNYRTELDATGPITADGR

SEQ ID NO: 111961 - protein, 270 aa, Glycine max
  Coding DNA Sequence Number=SeqID_20276
  Homolog annotation: Hit_ID=Q0ZCD6; Match level="QueryCoverage=71%, HitCoverage=23%, E-value=3e-08, Identity=24%"; Hit description =Integrase
MTGFLRFFRRFPQINVGGDSAHFPPLENAPVSLASLARKRACCDTMNQKFALVARQSGVNEQPEAYAANTYNRPPQQQNQQQQNNYDLSSNRYNPGWRNHLNLRWASPPQQQQPVPLFQNVAGPSKPYVPPPIQQQQQQQSQQRQQATEAPPQPSLEELVRQMTIQNMKFQQETRASIQSLTNQMGQMATQLNQAQSQNSNKLPSQTVQNSKNGSAITLWSGNQIQVPPPVAAPAPEPVKLHSTPEKEDEIVSQKRKLPNKNFRAGGPSS

SEQ ID NO: 111962 - protein, 80 aa, Glycine max
  Coding DNA Sequence Number=SeqID_20277
AHVQTHDCLYQLSLSLQSQGFASFPCPTPDQFRAEVAWPGDWPEALAGEAPAEALDDADEARMDEEMTDLLDFLRGSGAT

SEQ ID NO: 111963 - protein, 70 aa, Glycine max
  Coding DNA Sequence Number=SeqID_20278
MQMPYTRYPICPQFKRCLWNCLTRNPVQQIHGSFQGIHPQRYSKFLRHPLPKKSRVVSRHNHNVNNHQQW

SEQ ID NO: 111964 - protein, 84 aa, Glycine max
  Coding DNA Sequence Number=SeqID_20279
  Subcellular localization annotation: CTP_CleavageSite=63; ConfidenceScore=5.07e-01
MDIFNRVHDIFVKVKLEVIRTSTVLNVFDSRRSSVVTRSVFCPNFLQDGYFHTSTFLEEPFCKSMSLVQPHNPRNEENARIMHE

SEQ ID NO: 111965 - protein, 88 aa, Glycine max
  Coding DNA Sequence Number=SeqID_20280
MMKDYENGEEQSRYIDSNFSKHMACIKVVVIIKKGENVNHEDFDDVKNIKPWIMVVIIKKGENVNHASFDDVKKNLLDIGENVDHALP

SEQ ID NO: 111966 - protein, 114 aa, Glycine max
  Coding DNA Sequence Number=SeqID_20281
INQPSLRFTSGIAGALLELTELFPDYSVIAQKAHDDPSFQKLSDVVEKDFNQNSPYSYLPLDRLIDRMHALEHNLEETRSALSAMQDELVTIRRNLPKEILKRRVRKIRTFLRF

SEQ ID NO: 111967 - protein, 123 aa, Glycine max
  Coding DNA Sequence Number=SeqID_20282
QARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPHFQKHGAY

SEQ ID NO: 111968 - protein, 294 aa, Glycine max
  Coding DNA Sequence Number=SeqID_20283
  Homolog annotation: Hit_ID=Q6WAY4; Match level="QueryCoverage=77%, HitCoverage=62%, E-value=3e-14, Identity=35%"; Hit description =Putative uncharacterized protein
MGTNQNGKRFYQVKIKGLDVTSLKELGRLMGPLQRQAFRKVYGNILDLTTTEVFTEAIVSLAQYYDQPLRCFTFEDFQIVLTVEEFGEILGCPLGERKPYLFSGFLPSLSKIAAVVGDSAKELDHMKQTRNGVVGLSRKYLEGKARDMANQEEWVPFADILALLIFAEGKEGVLFSCGDYPNVPLIGTRGCINYNPALAIRQLGYPMRGAPMEESLSPFLAWESPLRKDKELRGIRNGIIGGYHEWIRVHTRGLDWLSKLKITNEENFEAPEEDEEVQALKSELGKARLAKEKF

SEQ ID NO: 111969 - protein, 54 aa, Glycine max
  Coding DNA Sequence Number=SeqID_20284
MLMKNLIGHLGVHDKTNHTLVSQVTLTRMLQPCGIGTGLKEHSNQVYLPPRPRL

SEQ ID NO: 111970 - protein, 76 aa, Glycine max
  Coding DNA Sequence Number=SeqID_20285
MTKVNQEPFLGQNLGVEESNFDSLGRIDGEPVLRETRIWATWEYVSSVGGGQQGMMGLCAHCGCGKLVMHHRPTAT

SEQ ID NO: 111971 - protein, 113 aa, Glycine max
  Coding DNA Sequence Number=SeqID_20286
  Homolog annotation: Hit_ID=Q51614; Match level="QueryCoverage=48%, HitCoverage=98%, E-value=3e-08, Identity=65%"; Hit description =Putative uncharacterized protein
MEKRQQRGLFTVPGLLLAFCSHVLSALSLILWITVLPPLSELIPLAAAERPSAASHWHDRFPDWKAGSERNAINFIMARKLNSIMDITAQKENWKADKIVAQIKNVDLGKGIL

SEQ ID NO: 111972 - protein, 155 aa, Glycine max
  Coding DNA Sequence Number=SeqID_20287
  Homolog annotation: Hit_ID=Q2HW90; Match level="QueryCoverage=38%, HitCoverage=12%, E-value=8e-08, Identity=43%"; Hit description =Putative uncharacterized protein
MGQLQRQAFRKAYGKIWDLARVKVSMEPIASLSQYYDQPLRCFTFEDFQLVPTMKEFEEILGCPLGGKEAISFLWVLSLHDKSCQGVLFPNMEGLVDLAAINTFLAFHHGEESPVVAILAMYDTFDRGCEKSGARIVCCALALYVWLVSHPFLQE

SEQ ID NO: 111973 - protein, 167 aa, Glycine max
  Coding DNA Sequence Number=SeqID_20288
ARVLASQGEWAPFMDILALLIFGVVLFPNVDGLVDRVAIDVFLAFYDRKESLVVAILADLYDTFDRRCEKNNAREGRTEILISFGKYPNVPLMGTRGFNSTNAGVLQRVHKALEMSQRKDKELRGSSNKPVGDYRRWLKAYAQDLDWLPSLRTTKGVEVETPEEDEE

SEQ ID NO: 111974 - protein, 50 aa, Glycine max
  Coding DNA Sequence Number=SeqID_20289
MLSILLMYIDAILPRKGPVTRAMRKRLQEDWARAARKGPRVLMNLRGSIM

SEQ ID NO: 111975 - protein, 127 aa, Glycine max
  Coding DNA Sequence Number=SeqID_20290
DAGSRQARQGASAGVGGCRGWLNYAASEQIVLRVHHMRAIGAGLFAITPAGERGMCCKAIKLGNARVFPVTTLIPIVFPTVTSVGKGVNMKSLLLPRKGFVLLQLLIRINLACLLGCRLQNLAQQKG

SEQ ID NO: 111976 - protein, 139 aa, Glycine max
  Coding DNA Sequence Number=SeqID_20291
MTLLLSNILLIDHNSDLPLLKCMAPTRHPLDPDKSNRALGFPALITGLCQSFGVPVAPTKVIRPPITRAFIEKYCTQRQAQGNAPQAAGAPPPPHQAGPAGSFDMEQYLRHLVRQQAANHRAHVQTHDCLYQMSLSMQS

SEQ ID NO: 111977 - protein, 63 aa, Glycine max
  Coding DNA Sequence Number=SeqID_20292
MVVEGFLSGKFMMQAPLELVGLGSSSSMDSFASWKINGSRMEKEEREETPLQGEDESRRSSPP

SEQ ID NO: 111978 - protein, 166 aa, Glycine max
  Coding DNA Sequence Number=SeqID_20293
  Homolog annotation: Hit_ID=Q84VH5; Match level="QueryCoverage=75%, HitCoverage=18%, E-value=5e-47, Identity=79%"; Hit description =Envelope-like protein
MDKKIRSIVSNILKNASVPDADEDVPTSSTPNVSVPDAEKDVPTSSTPNAEVLSSSSKERSTEEDDQATEETPAPRAPEPAPGDLIDLEEVESDEEPIANKLAPGIAERLQSRKGKTPIKRQHLIRLTPYANVDDEICVSTAVAWKENGNRDAFCKALDLNQALKN

SEQ ID NO: 111979 - protein, 88 aa, Glycine max
  Coding DNA Sequence Number=SeqID_20294
MATMAEEEKDEKIVDGDNQQLVTEQASKPEDNFCELEEIEDEEDDQENENTISKNENEINDEKKKEKEKEKEKEEEKEKENNEKIEKK

SEQ ID NO: 111980 - protein, 87 aa, Glycine max
  Coding DNA Sequence Number=SeqID_20295
  Homolog annotation: Hit_ID=A6FJQ2; Match level="QueryCoverage=43%, HitCoverage=84%, E-value=3e-11, Identity=92%"; Hit description=50S ribosomal protein L5
MPGADKPRQGASAGVGGCRGWLNYAASEQIMRKEKIPHQAPFAIQAAQLLGRAIGAGLFAITPAGERGMCCKAIKLGNARVFPVTTL

SEQ ID NO: 111981 - protein, 276 aa, Glycine max
  Coding DNA Sequence Number=SeqID_20296
  Homolog annotation: Hit_ID=A5AZ88; Match level="QueryCoverage=65%, HitCoverage=21%, E-value=4e-08, Identity=26%"; Hit description =Putative uncharacterized protein
MFIDGLRPQTKQLLDALAGEKIKLKTPEEAIELIENMSASDHAILCDRVHQPKKKSLLELSSHDTLLTQNKLLSKLQVVPSVVRLMKHANGPYNQQGQWRSHLGNQFNKDQGGPSNRPIQQGPNIFQRTTKLEETLTQFMQLTMSNHKSTESALKNLEIQVGQLAKQIEKNPKEECKAVMTRSKRFVEAEDEESVVPKKKAVEKKGSDEKKDDAIGESNQEKEKQIMVKKKEFNDQEKEKEVEKEKENKKLKKMKKIRMTRGVEVNKLERRKEKKL

SEQ ID NO: 111982 - protein, 91 aa, Glycine max
  Coding DNA Sequence Number=SeqID_20297
MVGGTWGVMNFKGEVIQPVAEQTNSVEVNGKFYPNPFKYNEKEKLSAEGQEIFALDYDNEKVPFEKWLKREIGKAQKYQEEHPDNPNKISK

SEQ ID NO: 111983 - protein, 111 aa, Glycine max
  Coding DNA Sequence Number=SeqID_20298
MVWAPSQQSFESLPCITERFIRPLGKTLLSFKRLAKILLKHKHLDNEGKLELLHMMSNVMSKNKIGLHNAQGKMKCQMKNCSCRIHDVGYNVQDILPENTGVAIQCKIKVK

SEQ ID NO: 111984 - protein, 194 aa, Glycine max
  Coding DNA Sequence Number=SeqID_20299
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTNIPFAEAIAQMPNRPAGMQAWHWPSFYNVVTGKTLALPNLIALQHIPLSPAGVIAKRPAPIALPNSCAA

SEQ ID NO: 111985 - protein, 135 aa, Glycine max
  Coding DNA Sequence Number=SeqID_20300
GASHSPFKAAQLLGRAIGAGLFAITPAGERGMCCKAIKLGNARIRSEPEDAGGGRGQPGCDVCSALSHHRAAERAARHPGRRADGGDIKLIDTVDLEGGPAECILAYYVGTDEGVSEVLSCGRRKKAAPVRQQNM

SEQ ID NO: 111986 - protein, 391 aa, Glycine max
  Coding DNA Sequence Number=SeqID_20301
  Subcellular localization annotation: CTP_CleavageSite=29; ConfidenceScore=5.25e-01
ACRRRSRRNAVRRPRPCSPAARCGGWFPSAAGRPARIAGRRAFRPSARPPGPAPTTGSWPGAARRASGSSGARCRDRHRAGGRRRGRRTTGARSGRNPAVRTACASRSGCPAAADAASGTGPPTGWPRPCARPAPGCRGIPPAGPDRRCAGRFSRSSRTGARPRPAARRSGGRRAARPATAFPCGAGCFRAGCARDGCPAAFRCGAGAGRRPARRRLADLLGQFALLVAFVRGGFFGAWHRRCPPCPCRPCGILAEGLRRTNWRCAASVVSNPAASICRGQAANPARSAGSPAGDGSVRLPVLPRVFDSAAARTGRHPPAARVLRRPGRHLRACRAGQQVRVRRMSGALGAQLAVRCQPFRGRSSRRCHQVLGWASRRAGGRTRQGRRRAA

SEQ ID NO: 111987 - protein, 112 aa, Glycine max
  Coding DNA Sequence Number=SeqID_20302
MVKVGTSYVPINVSFSPKVGPGLPGINRDTQDLFILRSDLPSTAVPPVQLLTGWCVTAKAPPDISAGKCSGRVPFAIQAAQLLGRAIGAGLFAITPAGERGMCCKAIKLGNA

SEQ ID NO: 111988 - protein, 157 aa, Glycine max
  Coding DNA Sequence Number=SeqID_20303
MIDQGRLEVGSEGKEEQHICMQSTEGSSVAKPKPLVIYFTKSAASQKLGHPLVAKPVPFPYQNSHAVPWRYTPPREKEEEATDVSSLSAKVTNITGLSGVTRSGRVFAPPNLPVQPADVKGKRKSGWEGTRWAKAPPRFRNKENSGQKGPPGRKKDG

SEQ ID NO: 111989 - protein, 150 aa, Glycine max
  Coding DNA Sequence Number=SeqID_20304
  Homolog annotation: Hit_ID=UPI00006A2D9E; Match level="QueryCoverage =82%, HitCoverage=87%, E-value=1e-09, Identity=15%"; Hit description =UPI00006A2D9E related cluster
TFTLRGLHALAIRGLHTLTFRGLHVLPFRGLHTLAFRGLHVLTFRGLHALAFRELRILTFRGLHTLPFKGRHVLNFRGLHALAFRELHTLAFKGLDVLTFRGLHVLAFKGLRILTFNRLCHTLISSGDYYLMTCNLWVAALRYFASFVAQ

SEQ ID NO: 111990 - protein, 216 aa, Glycine max
  Coding DNA Sequence Number=SeqID_20305
  Homolog annotation: Hit_ID=Q6WAY6; Match level="QueryCoverage=39%, HitCoverage=15%, E-value=1e-09, Identity=40%"; Hit description =Putative uncharacterized protein
MGTRGCINYNPVLAIRQLGYPMRGAPLEEELAPIIARSFNSTNAEALQKVCKAWEMVQKKDKELRGSNNEPIDGYRRWLKAHMQGLDWLSSLRITKGVEVEALVEDEEVQALRAELEKAQTIKEKFKSAALKIRKENAKLRDVNIAATKALEQKDQKAMLWMDRFALTLNGSQELPQLLAKAKAMADAYSAPEEIHRLLSYCQHMIDLMAHIIRNH

SEQ ID NO: 111991 - protein, 63 aa, Glycine max
  Coding DNA Sequence Number=SeqID_20306
MGVKHFEVVKRRSHVDKQWSPNEIRESSPIEGITLEAKGSQRNLPFLTCMMACKELLNLHFLI

SEQ ID NO: 111992 - protein, 68 aa, Glycine max
  Coding DNA Sequence Number=SeqID_20307
  Gene Ontology: Biological process=transposition, DNA-mediated
  Homolog annotation: Hit_ID=Q1J7G7; Match level="QueryCoverage=42%, HitCoverage=41%, E-value=8e-10, Identity=100%"; Hit description =Transposase
MVKVGTLRADHVSFSPKVGQGFPWLLFLSAVPPVQLLTGWCVTAKAPPDISAGKCSGHAARNHHTRRA

SEQ ID NO: 111993 - protein, 210 aa, Glycine max
  Coding DNA Sequence Number=SeqID_20308
  Homolog annotation: Hit_ID=Q2HW90; Match level="QueryCoverage=91%, HitCoverage=38%, E-value=1e-19, Identity=34%"; Hit description =Putative uncharacterized protein
MGTNQIGKRFYQVKIKGLGVTSLKELERLMGPLQMQAFRKAYGIILDLTIVEVFTEAVVSLTQYYDHPLRCFTFGDFQIVPTVEEFEEILGCPLGGRKPYLFSGFLPSLSKIAVVVRDSARELDRVKQTQNGVVGLLQKYMEGKARDMANQEECVPFTDVLALLIFGVVLFPNVDGLVDLAAIDAFLTYHHSKESPVVAILANLFDTFDR

SEQ ID NO: 111994 - protein, 67 aa, Glycine max
  Coding DNA Sequence Number=SeqID_20309
SRNFMDYATIPSSASGVLRNFTDCAIMFPFDSRHVTELHGLLNDECQVPRSGQTKVACHQTMIPGRN

SEQ ID NO: 111995 - protein, 150 aa, Glycine max
  Coding DNA Sequence Number=SeqID_20310
MPISPCRCTGIAPTRRPVGPKKSNRALGFLALVTGLCQSYRVLVPPESHPQRHPVDPEKSNRALGFPALGSRLQDTQWTRRSPTGSWSCQALITGLYQFYGVPVTSSKGIRPLLIKLSSRSTASPGRRRAKYHNSLGMAGSGQQMHRHHL

SEQ ID NO: 111996 - protein, 62 aa, Glycine max
  Coding DNA Sequence Number=SeqID_20311
MGGAVTLLDVPGGGNRVGDLDTYCLVFLSESVVSTCLDYFLGDDIMLHLRVEVRCMHHTEHD

SEQ ID NO: 111997 - protein, 1103 aa, Glycine max
  Coding DNA Sequence Number=SeqID_20312
  Gene Ontology: Mol. function=phosphoinositide binding; Biological process=intracellular signaling cascade
  Homolog annotation: Hit_ID=A7P7B1; Match level="QueryCoverage=99%, HitCoverage=93%, E-value=0.0, Identity=51%"; Hit description =Chromosome chr9 scaffold_7, whole genome shotgun sequence
  Pfam annotation: Domain name=Nexin_C; Domain location=893-1032; Score= 74.8; E_value=2.9e-19; Accession=PF08628.3; Description=Sorting nexin C terminal
  Pfam annotation: Domain name=PX; Domain location=593-732; Score=51.4; E_value=3.2e-12; Accession=PF00787.15; Description=PX domain
  Pfam annotation: Domain name=PXA; Domain location=41-197; Score= -20.2; E_value=0.0028; Accession=PF02194.6; Description=PXA domain
  Pfam module annotation: Pfam domain module=Nexin_C::PX::PXA; Domain location=893-1032::593-732::41-197
MKRKAAAYNNKAGSTNVQSSKKPVENPKVIAKFEWRTKVNSPVVEDAIDNFTRHLISEWVTDLWYSRLTPDKEGPEEDLINLICSHLELFRAAHSKIEKRHTGSLTIESRDMELKNVLAAENKLHPALFSAEAEHKVLQHLMTGLMHVTFKSEDLQCSFFRYTVRELLACAVIRPVLNLANPRFINERIESVVVNKTKVNKGVAAAQEASHTKADEIQISSDDFFKSSDPSVTGVELVQLRNGQSKNAESSAENNGRDNITKDPLLSIDARPSRTWNSMPANSLTNDNLGLQRHRSGGEWGDILDVISHRKTQALAPEHFENMWTKGKNYKKKDGENQSNEHVSQHSQVGKLSMVDHMKEISGPNERDTNSKLMLPPKGRHINSGHNSQFSVENTSIHADKNGSTSVTSYKDDKSVTSYKDDEHSHIYGQMSDSASSTSYSSEDNESSTVTGLDSPVTKVWDGKSNRNQAVSYVHHPLENFDNHSAKKRNKSHSRYPRLSRAQSGSKRSWPGGQKIQTWQEVERTSFLSGDGQDILNSSKSHINSEESSDDADMESLGRLYSGAAASSSAYSISKSESCSLSVGPLKNSSAVDSFYKLRCEVLGANIVKSGSKTFAVYSISVTDVNHNSWSIKRRFRHFEELHRRLKEFAEYNLHLPPKHFLSTGLDVPVIQERCELLDKYLKRKKLSAFGTVIEPRSPILCYQQDRYWILKLMQLPTVSESIEVWDFLSVDSQTYIFSNSFSIMETLSVGLNSKPFEKTKNTSNLSAPASDPVSFWRENCSAESKEAVLGARNNVVANGMRSKVNSTPLSLPKKSTHEPRKSFDNSSSNTNILARKSVPSPKTVKGRNNSDEVSEVHHDTSDAFPTEWVPPNLSVPILDLVDVIFQVQDGGWIRRKAFWVAKQILQLGMGDAFDDWLIEKIQLLRKGSVVASGVQRVEQILWPDGIFITKHPNRRPPPPTSPSQNSPHGNQPTQVSSPRLDDEQQQEADRRAKFVYELMIDHAPPAIVGLVGRKEYEQCARDLYFFLQTLCSSKTHFRHSLCLSIIWSCKYFLLTSLQSSVILKQLVFDILELLLTSAFPELDNVFKQLHEEKHKFGEFRTE

SEQ ID NO: 111998 - protein, 175 aa, Glycine max
  Coding DNA Sequence Number=SeqID_20313
  Pfam annotation: Domain name=TMA7; Domain location=113-175; Score =93.4; E_value=7.3e-25; Accession=PF09072.1; Description=Translation machinery associated TMA7
MATVSGYIPVGVLTFEILGVIRMSSNYGRIMLWSSGYMSLEYAINGVVPVKTDVYGSGEGKVALCCVVSCAVPLFLVFVFRPNPSSASQPCRPSKTKILWFAIYLIDFFFPSLGLLGGKAKPLKKPKSDKKDYDEIDVANIQKKKEEEKALKELKAKAQQKGSFGGSGLKKSGKK

SEQ ID NO: 111999 - protein, 273 aa, Glycine max
  Coding DNA Sequence Number=SeqID_20314
  Gene Ontology: Mol. function=P-P-bond-hydrolysis-driven protein transmembrane transporter activity; Cellular component=chloroplast inner membrane; Biological process=intracellular protein transport
  Homolog annotation: Hit_ID=A7NT70; Match level="QueryCoverage=97%, HitCoverage=99%, E-value=7e-99, Identity=66%"; Hit description =Chromosome chr18 scaffold_1, whole genome shotgun sequence
  Pfam annotation: Domain name=Tic20; Domain location=141-273; Score =340.1; E_value=4e-99; Accession=PF09685.1; Description=Chloroplast import component protein (
  Subcellular localization annotation: CTP_CleavageSite=61; ConfidenceScore=5.47e-01
MIQNGCIVSQGCAPLNSRSRNHGIPSTSAFRCASLMPPKVAVSNIRSFWGHNLECKPLLPRGMTLTNTFAVSSLRVREGQNHLFRALPLLPRLRKSNMAPRASKDVPTSFRYPPMTKKPQWWWRSLACLPYLMPLHETWMYAETAYNLHPFLECFEFYTYPFLMAIGSLPSWFLMAYFFVAYLGIVRRKEWPHFFRFHVVMGMLLEIALQVIGTVSRWMPLSLYWGKLGMHFWTAVSFGYLFTVLESIRCALAGMYADIPFICDAAYIQIPYD

SEQ ID NO: 112000 - protein, 1724 aa, Glycine max
  Coding DNA Sequence Number=SeqID_20315
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P24095; Match level="QueryCoverage=99%, HitCoverage=100%, E-value=0.0, Identity=90%"; Hit description=Seed lipoxygenase
  Pfam annotation: Domain name=Lipoxygenase; Domain location=1038-1708; Score=1670.2; E_value=0; Accession=PF00305.10; Description =Lipoxygenase
  Pfam annotation: Domain name=Lipoxygenase; Domain location=183-843; Score=1648.3; E_value=0; Accession=PF00305.10; Description =Lipoxygenase
  Pfam annotation: Domain name=PLAT; Domain location=68-171; Score =143.3; E_value=6.6e-40; Accession=PF01477.14; Description=PLATLH2 domain
  Pfam annotation: Domain name=PLAT; Domain location=923-1026; Score =140.7; E_value=4.2e-39; Accession=PF01477.14; Description=PLATLH2 domain
  Pfam module annotation: Pfam domain module=Lipoxygenase::Lipoxygenase: :PLAT::PLAT; Domain location=1038-1708::183-843::68-171::923-1026
MTGGMFGRKGQKIKGTVVLMPKNVLDFNAITSVGKGSAKDTATDFLGKGLDALGHAVDALTAFAGHSISLQLISATQTDGSGKGKVGNEAYLEKHLPTLPTLGARQEAFDINFEWDASFGIPGAFYIKNFMTDEFFLVSVKLEDIPNHGTINFVCNSWVYNFKSYKKNRIFFVNDTYLPSATPGPLVKYRQEELEVLRGDGTGKRRDFDRIYDYDIYNDLGNPDGGDPRPIIGGSSNYPYPRRVRTGREKTRKDPNSEKPGEIYVPRDENFGHLKSSDFLTYGIKSLSQNVIPLFKSIIFDLRVTSSEFDSFDEVRGLFEGGIKLPTNILSQISPLPVLKEIFRTDGENTLQFPPPHVIRVSKSGWMTDDEFAREMIAGVNPNVIRRLQEFPPKSTLDPATYGDQTSTITKQQLEINLGGVTVEEAISAHRLFILDYHDAFFPYLTKINSLPIAKAYATRTILFLKDDGSLKPLAIELSKPATVSKVVLPATEGVESTIWLLAKAHVIVNDSGYHQLISHWLNTHAVMEPFAIATNRHLSVLHPIYKLLYPHYKDTININGLARQSLINAGGIIEQTFLPGKYSIEMSSVVYKNWVFTDQALPADLVKRGLAVEDPSAPHGLRLVIEDYPYAVDGLEIWDAIKTWVHEYVSVYYPTNAAIQQDTELQAWWKEVVEKGHGDLKDKPWWPKLQTVEDLIQSCSIIIWTASALHAAVNFGQYPYGGYIVNRPTLARRFIPEEGTKEYDEMVKDPQKAYLRTITPKFETLIDISVIEILSRHASDEVYLGQRDNPNWTTDSKALEAFKKFGNKLAEIEGKITQRNNDPSLKSRHGPVQLPYTLLHRSSEEGMSFKGIPNTKMFGIFDKGQKIKGTVVLMPKNVLDFNAITSIGKGGVIDTATGILGQGVSLVGGVIDTATSFLGRNISMQLISATQTDGSGNGKVGKEVYLEKHLPTLPTLGARQDAFSIFFEWDASFGIPGAFYIKNFMTDEFFLVSVKLEDIPNHGTIEFVCNSWVYNFRSYKKNRIFFVNDTYLPSATPAPLLKYRKEELEVLRGDGTGKRKDFDRIYDYDVYNDLGNPDGGDPRPILGGSSIYPYPRRVRTGRERTRTAVTDPNSEKPGEVYVPRDENFGHLKSSDFLTYGIKSLSHDVIPLFKSAIFQLRVTSSEFESFEDVRSLYEGGIKLPTDILSQISPLPALKEIFRTDGENVLQFPPPHVAKVSKSGWMTDEEFAREVIAGVNPNVIRRLQEFPPKSTLDPTLYGDQTSTITKEQLEINMGGVTVEEALSTQRLFILDYQDAFIPYLTRINSLPTAKAYATRTILFLKDDGTLKPLAIELSKPHPDGDNLGPESIVVLPATEGVDSTIWLLAKAHVIVNDSGYHQLVSHWLNTHAVMEPFAIATNRHLSVLHPIYKLLYPHYRDTININGLARQSLINADGIIEKSFLPGKYSIEMSSSVYKNWVFTDQALPADLVKRGLAIEDPSAPHGLRLVIEDYPYAVDGLEIWDAIKTWVHEYVSLYYPTDAAVQQDTELQAWWKEAVEKGHGDLKEKPWWPKMQTTEDLIQSCSIIVWTASALHAAVNFGQYPYGGLILNRPTLARRFIPAEGTPEYDEMVKNPQKAYLRTITPKFETLIDLSVIEILSRHASDEIYLGERETPNWTTDKKALEAFKRFGSKLTGIEGKINARNSDPSLRNRTGPVQLPYTLLHRSSEEGLTFKGIPNSISI

SEQ ID NO: 112001 - protein, 302 aa, Glycine max
  Coding DNA Sequence Number=SeqID_20316
  Gene Ontology: Mol. function=DNA binding; Cellular component =nucleosome; Biological process=regulation of transcription
  Homolog annotation: Hit_ID=Q0PJJ3; Match level="QueryCoverage=100%, HitCoverage=100%, E-value=1e-106, Identity=70%"; Hit description=MYB transcription factor MYB107
  Pfam annotation: Domain name=Linker_histone; Domain location=119-186; Score=24.7; E_value=2.7e-06; Accession=PF00538.10; Description=linker histone H1 and H5 family
  Pfam annotation: Domain name=Myb_DNA-binding; Domain location=5-57; Score=31.3; E_value=3.6e-06; Accession=PF00249.22; Description=Myb -like DNA-binding domain
  Pfam module annotation: Pfam domain module=Linker_histone::Myb_DNA -binding; Domain location=119-186::5-57
MGNQKQKWTQDEEDALIAGVEKHGPGKWKNILKDPQFAPFLTSRSNIDLKDKWRNLSVSNGAQGSKEKSRVPKPKAFSAPPATTATTATPQNASPAPQSASSDAAVAPDASQNDQDAKNPPRYNALIFEALSALKDSNGSDMNAIIKFMEQKNHQVNQNFKRALSTRLRRLVSQGKLEKLRVSLGTMVKLLSYDLKVPNGYKVKKEASSGTKSPSPKAKDVRPPQPQRQSPASLFMTNDTLKEAADTAAYRVADAESKSYLAAEAVKEAEKISLLVEHSDSMLQLAKDIYEQCSRGEIILLA

SEQ ID NO: 112002 - protein, 117 aa, Glycine max
  Coding DNA Sequence Number=SeqID_20317
MADSTMTDNEVAEAARKKEYVKMKETGGVKRTHLTESSYTDIQSPFSKISSQQPLPAPPCHSTCLSQLMDLKPVVHPMQKAQNNTLGTGSKNCHSKPRQSLCNARNWSPKIQVANPG

SEQ ID NO: 112003 - protein, 134 aa, Glycine max
  Coding DNA Sequence Number=SeqID_20318
MGPYQAHFIICIIEAPYQQHDAVFRQEDDNVLPDDEKNVHSPSTALAVTLQFRRQPPPPPSSSSPTRGEDLRALGARGFSLNLNPMPFMNLSFGGGEMEEATHIGVGTGAGSDQGCYGGVAGKKEKILFFNNNK

SEQ ID NO: 112004 - protein, 121 aa, Glycine max
  Coding DNA Sequence Number=SeqID_20319
  Gene Ontology: Mol. function=structural constituent of ribosome; Cellular component=ribonucleoprotein complex; Biological process =translation
  Homolog annotation: Hit_ID=Q6ZZ86; Match level="QueryCoverage=51%, HitCoverage=49%, E-value=1e-23, Identity=78%"; Hit description=50S ribosomal protein L34
  Subcellular localization annotation: CTP_CleavageSite=37; ConfidenceScore=5.36e-01
MASLRSGASSLLNRLSKSLLLHSNKNPNPQSQLLLPSLSRLPGAISPQNDAEFPHTQGFLYPCGLPSLRFFLPHGEAPSSDDPMLLFPKRTYQPSVIRRKRNHGFFARLIPYLFWLYAHLS

SEQ ID NO: 112005 - protein, 318 aa, Glycine max
  Coding DNA Sequence Number=SeqID_20320
  Gene Ontology: Mol. function=unfolded protein binding; Cellular component=mitochondrion; Biological process=cellular protein metabolic process
  Homolog annotation: Hit_ID=A7P6R8; Match level="QueryCoverage=87%, HitCoverage=51%, E-value=1e-110, Identity=75%"; Hit description =Chromosome chr9 scaffold_7, whole genome shotgun sequence
  Pfam annotation: Domain name=Cpn60_TCP1; Domain location=1-300; Score= -60.4; E_value=6.6e-13; Accession=PF00118.15; Description=TCP-1cpn60 chaperonin family
MVNFNICRRILVTTSEVSIVVFRSVYLVHACFFLFACLFKVCAVKAPGFGDNRRASLDDLAILTGGEVITDERGLALDKVQPEMLGTAKKVTITIDDTIILHGGGDKKVIEERCEQLRTAMEKSSATFDKEKAQERLSKLSGGVAVFKMQPNLQVGGASEAEVGERKDRVTDALNATRAAVEEGIVPGGGVALLYATKVLDNLQTQNEDEKRGVQIIQNALKAPTITIASNAGFDGALVHSKLLEQDDHNLGFDAAKGVYADMVKAGIIDPLKVVRTALVDAASVSLLLTTTEAAVVDNSHDKNKPPSRVPDMDDLDL

SEQ ID NO: 112006 - protein, 88 aa, Glycine max
  Coding DNA Sequence Number=SeqID_20321
MYTQNKANERQPLIGGEEAASSESECFFWTREIPWLQLVQSIANSSCVYFYGSGTFYLLLKIYIRGVLISFKAKNQAEILLNLNFFIC

SEQ ID NO: 112007 - protein, 838 aa, Glycine max
  Coding DNA Sequence Number=SeqID_20322
  Gene Ontology: Mol. function=hydrolase activity, acting on glycosyl bonds; Cellular component=beta-galactosidase complex; Biological process=carbohydrate metabolic process
  Homolog annotation: Hit_ID=A2Q448; Match level="QueryCoverage=100%, HitCoverage=100%, E-value=0.0, Identity=85%"; Hit description=Beta -galactosidase
  Pfam annotation: Domain name=Gal_Lectin; Domain location=760-837; Score=172.4; E_value=1.1e-48; Accession=PF02140.9; Description =Galactose binding lectin domain
  Pfam annotation: Domain name=Glyco_hydro_35; Domain location=31-337; Score=649.3; E_value=3.3e-192; Accession=PF01301.10; Description =Glycosyl hydrolases family 35
  Pfam annotation: Domain name=Glyco_hydro_42; Domain location=53-394; Score=-236.8; E_value=0.0082; Accession=PF02449.6; Description=Beta -galactosidase
  Pfam module annotation: Pfam domain module=Gal_Lectin::Glyco_hydro _35::Glyco_hydro_42; Domain location=760-837::31-337::53-394
MWNVPLLLVVVVFACSLIGHASASVSYDHKAITINGQRRILLSGSIHYPRSTPEMWPDLIQKAKEGGLDVIQTYVFWNGHEPSPGKYYFGGNYDLVRFIKLVQQAGLYVNLRIGPYVCAEWNFGGFPVWLKYIPGISFRTDNGPFKFQMEKFTKKIVDMMKAERLFESQGGPIILSQIENEYGPMEYEIGAPGRAYTQWAAHMAVGLGTGVPWIMCKQEDAPDPIINTCNGFYCDYFSPNKAYKPKMWTEAWTGWFTEFGGAVPHRPAEDLAFSIARFIQKGGSFVNYYMYHGGTNFGRTAGGPFIATSYDYDAPLDEYGLPRQPKWGHLKDLHRAIKLCEPALVSGDPTVQQLGNYEEAHVFRSKSGACAAFLANYNPQSYATVAFGNQRYNLPPWSISILPNCKHTVYNTARVGSQSTTMKMTRVPIHGGLSWKAFNEETTTTDDSSFTVTGLLEQINATRDLSDYLWYSTDVVINSNEGFLRNGKNPVLTVLSAGHALHVFINNQLSGTAYGSLEAPKLTFSESVRLRAGVNKISLLSVAVGLPNVGPHFERWNAGVLGPITLSGLNEGRRDLTWQKWSYKVGLKGEALNLHSLSGSSSVEWLQGFLVSRRQPLTWYKTTFDAPAGVAPLALDMGSMGKGQVWINGQSLGRYWPAYKASGSCGYCNYAGTYNEKKCGSNCGQASQRWYHVPHSWLKPTGNLLVVFEELGGDPNGIFLVRRDIDSVCADIYEWQPNLVSYDMQASGKVRSPVRPKAHLSCGPGQKISSIKFASFGTPVGSCGNYREGSCHAHKSYDAFQKNCVGQSWCTVTVSPEIFGGDPCPSVMKKLSVEAICT

SEQ ID NO: 112008 - protein, 649 aa, Glycine max
  Coding DNA Sequence Number=SeqID_20323
  Gene Ontology: Mol. function=phospholipase D activity; Cellular component=cytoplasm; Biological process=phosphatidylcholine metabolic process
  Homolog annotation: Hit_ID=A2Q468; Match level="QueryCoverage=100%, HitCoverage=85%, E-value=0.0, Identity=76%"; Hit description =Phospholipase D/Transphosphatidylase; C2 calcium/lipid-binding region, CaLB
  Pfam annotation: Domain name=PLDc; Domain location=186-223; Score =26.0; E_value=0.00014; Accession=PF00614.13; Description =Phospholipase D. Active site motif
  Pfam annotation: Domain name=PLDc; Domain location=494-521; Score =29.0; E_value=1.8e-05; Accession=PF00614.13; Description =Phospholipase D. Active site motif
  Pfam module annotation: Pfam domain module=PLDc::PLDc; Domain location=186-223::494-521
MDNGKPNPKLKLKFQLWFKPAELEPSWAKMLSNDWEFQGLREATFPLRSNCQVKLYHDAHHSSAFQPPFDLCGAPKKLWEDVYKAIEGAKYLVYIAGWSFNPMMVLVRDPLTEIPRARGIKLGELLKKKAEEGVAVRVMLWDDETSLPFVMNKGELNNQDEEAFAYFNHTKVICRKCPRSHHMFPTLFAHHQKTITVDTKAPKSVGDRELMSFLGGLDLCDGRYDSEQHSLFQTLIRESHCYDFYQTSIEGASLNKGGPRKPWHDAHACVTGEAAWDVLTNFEQRWTKQCDPSFLVPSSTLANLMPRTSSSTPTERNWKVQVYRSIDHVSVGELSTKLNVERSIHEAYVEAIRRAERFIYIENQCFIGGCHWWKKDRHSGCTNLIPIEIALKVVSKIKAKERFSVYIVIPMWPEGEPESEPVQDILHWTRETMAMMYRLIGDAIQESGEPAHPRDYLNFFCLANREQKGQGEYLPLDSPQPETQYWNAQKNRRFMVYVHSNFMIVDDLYILIGSANVNQRSMDGQRDTEIAIGCYQSQDGDDNNQMNLDDIQAYRMSLWYEHTVSVDELFLEPERLECVERMRSIGDEMWEIYSSEEIVDMEGVHLVTYPVRVTQEGYVKDLTDGVHFPDTNSLVKGKRSKILPPIFTT

SEQ ID NO: 112009 - protein, 48 aa, Glycine max
  Coding DNA Sequence Number=SeqID_20324
  Gene Ontology: Mol. function=phospholipase D activity; Cellular component=cytoplasm; Biological process=phosphatidylcholine metabolic process
  Homolog annotation: Hit_ID=A2Q468; Match level="QueryCoverage=89%, HitCoverage=5%, E-value=9e-14, Identity=79%"; Hit description =Phospholipase D/Transphosphatidylase; C2 calcium/lipid-binding region, CaLB
MEETPKLLHGTIEATIFNASPYSPLFPFNCICANGNPAYVTIKIDSQK

SEQ ID NO: 112010 - protein, 74 aa, Glycine max
  Coding DNA Sequence Number=SeqID_20325
MATGIGSAEIADGTMFAMELGILSEKAFNKRSRVLRLIGSSSEMLPERSRCALEEQFARDASRFINGMTSVEEQ

SEQ ID NO: 112011 - protein, 416 aa, Glycine max
  Coding DNA Sequence Number=SeqID_20326
  Gene Ontology: Mol. function=ATPase activity, coupled to transmembrane movement of substances; Cellular component=integral to membrane; Biological process=transport
  Homolog annotation: Hit_ID=A7P6T5; Match level="QueryCoverage=100%, HitCoverage=39%, E-value=1e-148, Identity=59%"; Hit description =Chromosome chr9 scaffold_7, whole genome shotgun sequence
  Pfam annotation: Domain name=ABC_membrane; Domain location=54-321; Score=-40.5; E_value=0.073; Accession=PF00664.14; Description=ABC transporter transmembrane region
MEGGKITQSGNYDNLLTSGTAFEKLVSAHEEAITELEQSNEIKTHTEESQDFYVAKNESEEEISTEGQLEAQLTQEEEKEKGDVVWKTFWDYISFSKVSFMLCWIILAQSAFVALQTASMFWLALAIEVPKLTSATLIGVDSLISFASVAFASADLSILNFDIPYSITFVVSVAIDIVVTIYIMVLVTWPVLIVAIPAMVASKYVQGYYQASSRELMRINGTTKAPVMNFAAETSLGVVTVRAFNMAERFFKNYLKLVDTDATLFFHSNVAMEWLVLRIEALQNLTVITSALLLILVPQGYVTSGLVGLSLSYAFSLTGSQIFWTRWYCNLLNYIISVERIKQFIHLPAEPPAIVQDHRPPSSWPSKGRIDLHALEIRYRPNAPLVLKGITCTFKEGSRVGVVGRTGNGKSTLISA

SEQ ID NO: 112012 - protein, 230 aa, Glycine max
  Coding DNA Sequence Number=SeqID_20327
  Gene Ontology: Mol. function=zinc ion binding; Cellular component =nucleus; Biological process=regulation of transcription
  Homolog annotation: Hit_ID=Q0GLE2; Match level="QueryCoverage=66%, HitCoverage=98%, E-value=7e-56, Identity=69%"; Hit description=Dof10
  Pfam annotation: Domain name=zf-Dof; Domain location=35-97; Score =140.4; E_value=5.2e-39; Accession=PF02701.6; Description=Dof domain, zinc finger
MDGGVTPRVAGDIGHAEVGMQDPTAFQGVKPPQFPEQEQLKCPRCDSNNTKFCYYNNYNLSQPRHFCKNCRRYWTKGGALRNIPVGGGSRKTTKRSSSTLSKRSSAPSSSSAVSDPDPTRICTNPVDQDQRVLNIGGGSFSSLLASSGHFGTLLEGLNPSGSGLKMGEFVEGVSSDPGLNLDSGLNPDLQVQSNENSESFLGLQNGDSSCWNGTHGWSDLAIYTPGPSFQ

SEQ ID NO: 112013 - protein, 582 aa, Glycine max
  Coding DNA Sequence Number=SeqID_20328
  Gene Ontology: Cellular component=integral to membrane; Biological process=meiotic spindle organization and biogenesis
  Homolog annotation: Hit_ID=A7P6V1; Match level="QueryCoverage=99%, HitCoverage=99%, E-value=0.0, Identity=55%"; Hit description =Chromosome chr9 scaffold_7, whole genome shotgun sequence
  Pfam annotation: Domain name=DUF590; Domain location=355-554; Score =251.9; E_value=1.4e-72; Accession=PF04547.3; Description=Protein of unknown function, DUF590
MKKHGNEEHVFEIGVVIPRRVVQEKDESCDCAYVLVKEFEKVGFVVERVIGIADEFIKLAAPLETLGRAAAELQIKKRTLIGICDSLKGGICSACYDSMDLQFEVEEVEAFVKQPDGSVFSWYERFQCYCHLIYGIVNNSKSVKTLKFDGKEIHWEIGENLLLKLESVEIVKQVFPLHDEQKRKKLLRSWALQWWDFTSQPIDEIYSYYGAKFWKRKNSALLARWPISSIVAADQGYKISGRKSSSWQPPMELMKVFETDRAKEKEIFQRHEWLGRLMRFRNDAIIIFSIICLQLPFELAYAHLYEVLDSDIIKFGLTAVYLFAIQYITKIGGKVSVKLIMNENNENTEKRADSLVYKVLENLVENSLPYLKYSYKKYRVRHKKNEKGEAREKFQFTSRVEKEYLKLSYSASIGEELEDGLFDDFLELALQFGMILMFACAFPPAFAFAAVNNLMEIRTDALKLLVILRRPVPRAAATVGAWLNIFQFLILMSICTNCALLAWLYDEEGKWKIEPGLAAILIMEHVLLLTKFGLSRFIPEEPAWVRANRAKHTTQAQDMCSKKLLRTISGGDKTFREGKKLE

SEQ ID NO: 112014 - protein, 188 aa, Glycine max
  Coding DNA Sequence Number=SeqID_20329
  Gene Ontology: Mol. function=inositol oxygenase activity; Cellular component=cytoplasm; Biological process=L-ascorbic acid biosynthetic process
  Homolog annotation: Hit_ID=A7P6Y7; Match level="QueryCoverage=87%, HitCoverage=53%, E-value=7e-84, Identity=87%"; Hit description =Chromosome chr9 scaffold_7, whole genome shotgun sequence
  Pfam annotation: Domain name=DUF706; Domain location=3-188; Score =348.2; E_value=1.4e-101; Accession=PF05153.6; Description=Family of unknown function (DUF706)
MKDRKLLEKLHFLYHKHLPVWLNADLGKVLNLPSFGGLPQWAVVGDTFPVGCRFDESIVHHKYFKENPDYNNPAYNTKYGIYSERCGLNNVMMSWGHDDYMYLVAKENSTTLPSAALFIIRYHSFYALHREGAYKHLLNDEDVENLKWLHIFNKYDLYSKSKVRIDVERVKPYYLSLIEKYFPAKLKW

SEQ ID NO: 112015 - protein, 557 aa, Glycine max
  Coding DNA Sequence Number=SeqID_20330
  Gene Ontology: Mol. function=glucose-6-phosphate dehydrogenase activity; Cellular component=chloroplast; Biological process =carbohydrate metabolic process
  Homolog annotation: Hit_ID=A7Q309; Match level="QueryCoverage=85%, HitCoverage=97%, E-value=0.0, Identity=82%"; Hit description=Glucose- 6-phosphate 1-dehydrogenase
  Pfam annotation: Domain name=G6PD_C; Domain location=288-554; Score =433.5; E_value=3e-127; Accession=PF02781.7; Description=Glucose-6 -phosphate dehydrogenase, C-terminal domain
  Pfam annotation: Domain name=G6PD_N; Domain location=106-285; Score =319.0; E_value=8.5e-93; Accession=PF00479.13; Description=Glucose-6 -phosphate dehydrogenase, NAD bindi
  Pfam module annotation: Pfam domain module=G6PD_C::G6PD_N; Domain location=288-554::106-285
  Subcellular localization annotation: CTP_CleavageSite=62; ConfidenceScore=5.54e-01
MASILCPSLTIVTSYAFSNEPKLVSKFTAVTGNSYSPLWLSCTRPGNPARNHFQLKSSNGLPQNAVSSNDGLAGSSLAKEDGKPQPLEGPFPFPDSEYTGSNLSITVVGASGDLAKKKIFPALFALFYEDWLPENFLVFGFARTKMTDEELRNMISKTLTCRIDKRENCEDKMDQFLKRCFYHSGQYNSEDHFSELDSKLREKEGGKLSNRLFYLSIPPNIFVDVVRCASLKASSKDGWTRVIVEKPFGRDSESSSELTKSLKQYLTEDQIFRIDHYLGKELVENLSVLRFSNLVFEPLWSRNYIRNVQIIFSEDFGTEGRGGYFDHYGIIRDIMQNHLLQILALFAMETPVSLAAEDIRNEKVKVLRSMRPLELENVVVGQYKGHSKGGKSHPAYTDDPTVPKGSLTPTFAAAALFIDNARWDGRNFGTDLDKATNELVLRVQPDEAIYLKINNKVPGLGMRLDRSDLNLLFRARYPREIPDAYERLLLDAIEGERRLFIRSDELDAAWALFTPLLKEIENKKIAPELYPYGSRGPVGAHYLSAKHNVRWGDLGED

SEQ ID NO: 112016 - protein, 53 aa, Glycine max
  Coding DNA Sequence Number=SeqID_20331
MAVQQKEIAIGAGDLQRGNRHWCRRFAGEVLNLSSTVLTLHCVFSIRALDCYS

SEQ ID NO: 112017 - protein, 490 aa, Glycine max
  Coding DNA Sequence Number=SeqID_20332
  Gene Ontology: Mol. function=transcription repressor activity; Biological process=regulation of nitrogen utilization
  Homolog annotation: Hit_ID=A7Q4K0; Match level="QueryCoverage=72%, HitCoverage=67%, E-value=1e-160, Identity=81%"; Hit description =Chromosome chr9 scaffold_49, whole genome shotgun sequence
  Pfam annotation: Domain name=3Beta_HSD; Domain location=134-326; Score=-127.7; E_value=0.023; Accession=PF01073.10; Description=3 -beta hydroxysteroid dehydrogenaseisomerase family
  Pfam annotation: Domain name=CIA30; Domain location=268-432; Score =7.2; E_value=7.5e-07; Accession=PF08547.3; Description=Complex I intermediate-associated pro
  Pfam annotation: Domain name=Epimerase; Domain location=133-348; Score=-52.4; E_value=0.0029; Accession=PF01370.12; Description=NAD dependent epimerasedehydratase family
  Pfam annotation: Domain name=KR; Domain location=131-244; Score= -88.8; E_value=0.034; Accession=PF08659.1; Description=KR domain
  Pfam annotation: Domain name=NmrA; Domain location=133-333; Score= -109.9; E_value=0.066; Accession=PF05368.4; Description=NmrA-like family
  Pfam annotation: Domain name=adh_short; Domain location=131-244; Score=-21.4; E_value=0.00032; Accession=PF00106.16; Description =short chain dehydrogenase
  Pfam module annotation: Pfam domain module=3Beta_HSD::CIA30::Epimerase ::KR::NmrA::adh_short; Domain location=134-326::268-432::133-348::131- 244::133-333::131-244
  Subcellular localization annotation: CTP_CleavageSite=42; ConfidenceScore=5.11e-01
MMNAATAANSSVYSQTQCRPLSSDVRGSIPYLNERKSRLVVRAGGGGRPPKEDGEKQQQQQQQPVSLRLDDVNPVGLGRRSRQLFDEVWRKFSGLGQISGTIRSDDQEALDALLVREGPMCEFAIPGAQNTTVLVVGATSRIGRIVVRKLMLRGYAVKALVRRADQEVVELLPRSVEIVIGDVGDPATVKAAVEGCNKIIYCATARSAITGDLFRVDHRGVSNLTKAFQDHNNKLAQSRAGKSSKSKLLIAKFKSASSLNGWQVRQGTYFQDVVATKYDGGMDAKFEFNENGDAVFSGYVFNRGGYVELSKKLSLPLGYTLDRKFYHAFKHNEFICNDRYEGLVLSVGGNGRSYVLILEAGPSADPSQSRLYFARISTKVGFCRVRVPFSSFRPVKPDDPVLDPFLVHTLKIRFEPRRQRAVGQQHLVEAELQQELQLDPIIYLPAKVFAESVVMQKDEQIPQVLIKLNGKEKLRKRRHGRCTSHSGLFP

SEQ ID NO: 112018 - protein, 443 aa, Glycine max
  Coding DNA Sequence Number=SeqID_20333
  Gene Ontology: Mol. function=vinorine synthase activity; Biological process=alkaloid metabolic process
  Homolog annotation: Hit_ID=Q9LU88; Match level="QueryCoverage=94%, HitCoverage=94%, E-value=3e-76, Identity=38%"; Hit description =Acetyltranferase-like protein
  Pfam annotation: Domain name=Transferase; Domain location=22-434; Score=318.2; E_value=1.5e-92; Accession=PF02458.6; Description =Transferase family
MEHPRETQQQQQQQLASKRMKLEVEVISKEMIKPSSPTQDHLRHYPLSFLDQVSPMVYNPMVLFYSCYGITQTQFTISEKLKKSLSDVLTHFYPLAGRVNGNSTFIDCNDEGIPYLEAKVKCKVVDVIHKPVPGELNHLVPFLLDDITNITFGVQLNVFDCGGIAIGACLSHQIADGLSFFMFLNSWAAFASRGEQAVLPNPQFISAKLFPPKNISGFDPRSGIIKENIICKMFVFDGSVVESLRARYAATSFENEKHPTRVEALSAFIWSRYVAVTGPQRTYAVVHAVNLRPKMEPPLPPDSFGNYYRISLTIPSLNTEEHLVKQARDQIKKIDKDYVRKLQYGNDHLDFLKDSSYRVLLKGELVPFNITSLCRFPLYDADFGWGEPTWVGSPALTFKNLVVFIDTKNGGGIEAYVSLKVEDMTKFEADEELLACVSKARVC

SEQ ID NO: 112019 - protein, 691 aa, Glycine max
  Coding DNA Sequence Number=SeqID_20334
  Gene Ontology: Mol. function=histone acetyltransferase activity; Cellular component=nucleus; Biological process=regulation of transcription, DNA-dependent
  Homolog annotation: Hit_ID=A7Q4K1; Match level="QueryCoverage=85%, HitCoverage=43%, E-value=0.0, Identity=79%"; Hit description =Chromosome chr9 scaffold_49, whole genome shotgun sequence
  Pfam annotation: Domain name=C1_3; Domain location=516-546; Score =10.7; E_value=0.029; Accession=PF07649.3; Description=C1-like domain
  Pfam annotation: Domain name=DUF906; Domain location=66-340; Score =405.5; E_value=8.1e-119; Accession=PF06010.3; Description=Domain of Unknown Function (DUF906)
  Pfam annotation: Domain name=ZZ; Domain location=512-558; Score=29.6; E_value=1.2e-05; Accession=PF00569.8; Description=Zinc finger, ZZ type
  Pfam annotation: Domain name=zf-TAZ; Domain location=574-653; Score =47.4; E_value=5.1e-11; Accession=PF02135.7; Description=TAZ zinc finger
  Pfam module annotation: Pfam domain module=C1_3::DUF906::ZZ::zf-TAZ; Domain location=516-546::66-340::512-558::574-653
MVKARRMEDKNRVLGILPLSNSQGKVADPTNVAKTGSSGWQGRRIFHNLSSAEVNEKMRKGECFTCEEKYNPARVCKNKQFRLMIMEEEDEGETLAYEMQAVFLNLTLRTRETKEKNGETIKKDLEIPGAEALVIRVVSSVDKKLEVKPRFLEIFQEENYPTEFPYKSKVVLLFQRIEGVEVCLFGMYVQEFGSECQFPNQRRVYLSYLDSVKYFRPEVKAVTGEALRTFVYHEILIGYLEYCKKRGFTSCYIWACPPLKGEDYILYCHPEIQKTPKSDKLREWYLAMLRKAAKENIVVDLTNLYDHFFVSTGECRAKVTAARLPYFDGDYWPGAAEDLIYQLRQEEDGRKQNKKGTTKKTITKRALKASGQSDLSANASKDLLLMHKVLLANVALVKVKCPYGKMQMEELKVGGGMRVAGECRCYEAELKREERERHPINQREKHTLYPVEITDVPSDTKDKDDILESEFFDTRQAFLSLCQGNHYQYDTLRRAKHSSMMVLYHLHNPTAPAFVTTCNICYLDIETGQGWRCEVCPEYDVCNACYQKDGGIDHPHKLTNHPSMVDRDAQNKEARQHRVSQLRKMLDLLVHASQCRSAHCQYPNCRKVKGLFRHGMHCKTRASGGCVLCKKMWYLLQLHARACKESECHVPRCRDLKEHLRRLQQQSDSRRRAAVMEMMRQRAAEVANNAG

SEQ ID NO: 112020 - protein, 526 aa, Glycine max
  Coding DNA Sequence Number=SeqID_20335
  Gene Ontology: Mol. function=transporter activity; Cellular component= integral to membrane; Biological process=transport
  Homolog annotation: Hit_ID=A5AGQ9; Match level="QueryCoverage=91%, HitCoverage=97%, E-value=1e-171, Identity=63%"; Hit description =Putative uncharacterized protein
  Pfam annotation: Domain name=MFS_1; Domain location=69-478; Score =110.2; E_value=6.3e-30; Accession=PF07690.7; Description=Major Facilitator Superfamily
  Pfam annotation: Domain name=Sugar_tr; Domain location=60-523; Score =64.8; E_value=3e-16; Accession=PF00083.15; Description=Sugar (and other) transporter
  Pfam module annotation: Pfam domain module=MFS_1::Sugar_tr; Domain location=69-478::60-523
MDSDKEARGVKGSSEEEESGRWEGRGKEGRKDRRKGVKKGTGAEGPSYTVDDALVALGFGNFQILVLAYAGVGWVSEAMEMMILSFVGPAVQTAWNLSAHEESLITSVVFAGMLIGAYSWGIVSDKHGRRKGFLITAIVTALAGFLSAFAPNYILLIALRSLVGLGLGGGPVLSSWFLEFVPAPNRGTWMVVFSAFWTLGTIFEASLAWIVMPKLGWRWLLALSSLPSSFLLLFYKVTPESPRYLCLKGRTADAINVLEKIARVNGRELPSGNLVSDHEIELHKIDNPSEDTRLLSPRTNEVEHPKGTVSNLGGISSLLVLLSPKLARPTLLLWAVFFGNAFSYYGLVLLTTELNGHSKCMPDKLQTEKSQDVKYKSVFIASFAELPGLLLSAAAVDKLGRKLSMSTMFFMCCIFLLPLLFYLPEGLTTSFLFLARICITATFTIVYIYAPEMYPTSVRTTGVGIASSVGRIGGMICPLIAVGLVHGCHQTAAVLLFEIVALLSGICVMFFPIETMGQELRDSVQV

SEQ ID NO: 112021 - protein, 750 aa, Glycine max
  Coding DNA Sequence Number=SeqID_20336
  Gene Ontology: Mol. function=nucleoside-triphosphatase activity; Cellular component=cytoplasm; Biological process=protein catabolic process
  Homolog annotation: Hit_ID=Q9C5U3; Match level="QueryCoverage=59%, HitCoverage=99%, E-value=0.0, Identity=81%"; Hit description=AtSUG1 protein
  Pfam annotation: Domain name=AAA; Domain location=225-413; Score =310.2; E_value=3.8e-90; Accession=PF00004.20; Description=ATPase family associated with various cellular activities (AAA)
  Pfam annotation: Domain name=AAA_2; Domain location=222-354; Score= -26.0; E_value=0.001; Accession=PF07724.5; Description=ATPase family associated with various c
  Pfam annotation: Domain name=AAA_3; Domain location=225-357; Score= -12.7; E_value=0.0083; Accession=PF07726.2; Description=ATPase family associated with various
  Pfam annotation: Domain name=AAA_5; Domain location=225-361; Score =1.7; E_value=0.0021; Accession=PF07728.5; Description=ATPase family associated with various
  Pfam annotation: Domain name=PAP_fibrillin; Domain location=529-744; Score=58.9; E_value=1.8e-14; Accession=PF04755.3; Description=PAP _fibrillin
  Pfam module annotation: Pfam domain module=AAA::AAA_2::AAA_3::AAA _5::PAP_fibrillin; Domain location=225-413::222-354::225-357::225 -361::529-744
MALVGVELKHAAEGVPEANCSAKPTKQGEGLRHYYSLNIHEHQLLLRQKTHNLNRLEAQRNDLNSRVRMLREELQLLQEPGSYVGEVVKVMGKNKVLVKVHPEGKYVVDIDKNIDITKITPSTRVALRNDSYVLHLVLPSKVDPLVNLMKVEKVPDSTYDMIGGLDQQIKEIKEVLCLTFFQCQELDAFIYPCITRVLPFRVHVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKAVCTEAGMFALRERRVHVTQEDFEMAVAKVMKKETEKNMSLRKLWNGVEGESATGTEQLTINKNKNISREDIVMDMVLHSALYPPSLSCSSSTTGTRWPNSRVGVSLSWRSLSLVPCALKAYYDSELENKKHLLLTSVQDTQRGLLTTPDQRSCIEEALVSLEGCNIGSHPINLSNLDGTWRLQYTSASDVLILLQAAATLPFFQVGQIFQKFECRDQSNGGVIRNVVRWSIPNLLEEQEGATLLVSAKFNVVSVRNIYLQFQEITIQDINISEELQALIAPAILPRSFISLQILQFLRTFKAQIPVRDPGRQSVGGLYYLSYLDDNMLLGRAVGGGGVFVFTRAQSLY

SEQ ID NO: 112022 - protein, 686 aa, Glycine max
  Coding DNA Sequence Number=SeqID_20337
  Gene Ontology: Mol. function=protein binding; Cellular component =cytoplasm; Biological process=humoral immune response
  Homolog annotation: Hit_ID=A3BVN4; Match level="QueryCoverage=80%, HitCoverage=73%, E-value=1e-144, Identity=50%"; Hit description =Putative uncharacterized protein
  Pfam annotation: Domain name=YTH; Domain location=470-560; Score =192.2; E_value=1.3e-54; Accession=PF04146.6; Description=YT521-B -like family
MAATQPTQGPDRTTGTNAVIPDGMGSSWSQAFIVCVAEEIPAEPDNLKEQGTAIIGHSRETTSQSGSLGSSGDCPLYPPNVYAPQAQAFYYRGFDNGNGEWDEYSSYVNSEGLDIGSPGVYNENPSLIFHSGYGFNPQMPYGPYSPVTTPLPSVGGDTQLYSPQQFPYTGPPYYHQLVPPSLPYLNSPTPVSQPELTSLVGIDQQVDNMFFGPRAGYPSVGSFGRGNFPVAPGSFGFHESQQGFEGSRSGGIWSDCSKPSERQRSLMPLSPSVSPQPMGSLGSFGPSVGMASHQQQSLYGFGSASNSYGRGYLPNQGSSFGGTSISNLNDRRFASLENSRRQGRPTASLCNCNGTLDILSEQNRGPRASKLKNQISAESNSVDGSKNSGSTAKFQNESLNWSDFATDYKDAKFFVIKSYSEDNVHKSIKYGVWASTPNGNRKLDAAYLQAMEKQDALTLYFCCPVFAANLGSEVNASAQFCGVAEMVGPVNFDKSVDFWQQDKWSGQFPVKWHIIKDVPNSQFRHIVLENNDNKPVTNSRDTQEVKLTQGVEMLTIFKNYETDVSILDDFDFYEDRQKAMQERKARQQSSMVATGLVGENEHRSSANTTGDFMKQMSKSFALVVRLDENNKEVVVADRDSLVSHGHGPIGNVVKPDDGQSVTASSTQTSSVAVVIQFKSMESGVSK

SEQ ID NO: 112023 - protein, 1142 aa, Glycine max
  Coding DNA Sequence Number=SeqID_20338
  Gene Ontology: Mol. function=hydrogen ion transmembrane transporter activity; Cellular component=integral to membrane; Biological process=proton transport
  Homolog annotation: Hit_ID=A7Q493; Match level="QueryCoverage=68%, HitCoverage=92%, E-value=0.0, Identity=80%"; Hit description =Chromosome chr9 scaffold_49, whole genome shotgun sequence
  Pfam annotation: Domain name=H_PPase; Domain location=62-783; Score =1465.4; E_value=0; Accession=PF03030.7; Description=Inorganic H+ pyrophosphatase
  Pfam annotation: Domain name=TPR_1; Domain location=1065-1098; Score =10.2; E_value=0.32; Accession=PF00515.19; Description=Tetratricopepti de repeat
  Pfam annotation: Domain name=TPR_1; Domain location=1099-1132; Score =5.0; E_value=1.3; Accession=PF00515.19; Description=Tetratricopeptide repeat
  Pfam annotation: Domain name=TPR_1; Domain location=951-984; Score =0.2; E_value=5; Accession=PF00515.19; Description=Tetratricopeptide repeat
  Pfam annotation: Domain name=TPR_1; Domain location=985-1018; Score =11.1; E_value=0.25; Accession=PF00515.19; Description=Tetratricopepti de repeat
  Pfam annotation: Domain name=TPR_2; Domain location=1020-1053; Score =8.7; E_value=2.4; Accession=PF07719.8; Description=Tetratricopeptide repeat
  Pfam annotation: Domain name=TPR_2; Domain location=1065-1098; Score =7.9; E_value=3.1; Accession=PF07719.8; Description=Tetratricopeptide repeat
  Pfam annotation: Domain name=TPR_2; Domain location=1099-1132; Score =6.2; E_value=5.1; Accession=PF07719.8; Description=Tetratricopeptide repeat
  Pfam annotation: Domain name=TPR_2; Domain location=951-984; Score =16.5; E_value=0.1; Accession=PF07719.8; Description=Tetratricopeptide repeat
  Pfam annotation: Domain name=TPR_2; Domain location=985-1018; Score =14.1; E_value=0.51; Accession=PF07719.8; Description=Tetratricopeptid e repeat
  Pfam annotation: Domain name=TPR_4; Domain location=1065-1090; Score =4.6; E_value=11; Accession=PF07721.5; Description=Tetratricopeptide repeat
  Pfam annotation: Domain name=TPR_4; Domain location=951-976; Score =14.6; E_value=0.39; Accession=PF07721.5; Description=Tetratricopeptid e repeat
  Pfam module annotation: Pfam domain module=H_PPase::TPR_1::TPR_1::TPR_ 1::TPR_1::TPR_2::TPR_2::TPR_2::TPR_2::TPR_2::TPR_4::TPR_4; Domain location=62-783::1065-1098::1099-1132::951-984::985-1018::1020 -1053::1065-1098::...
  Pfam module annotation: Domain location=1099-1132::951-984::985 -1018::1065-1090::951-976
MDHDLETAALGAYQDKPRTFPNMRTKPYTPLIFRILLGINVRVLFILLLLGLGAIFYVGASTSPIIVFVISVCILSFLVAIYLTKWVLAKDEGPPEMVQISDAIRDGAEGFFRTQYGSISKMAMLLALVILCIYLFRSTTPQQESSGLGRTTSAYITVASFLLGALCSGVAGYVGMWVSVRANVRVSSAARRSAREALQVATRAGGLSAIIVVGMAVIGIAVLYATFYVWLGVDLPGSMKVTDLPLLLVGYGFGASFVALFAQLGGGIYTKAADVGADLVGKVEQGIPEDDPRNPAVIADLVGDNVGDCAARGADLFESIAAEIISAMILGGTMAQRYPSGFILFPLVVHSFDLIVSSAGIFSIRGTRETGIIVPMEDPMTILQKGYSFTIVLAVLAFGLVMSTRWLLYTEQAPSAWFNFALCGLIGIITAYIFVWIAKYYTDYKHEPVRILALSSSTGHGTNIIAGVSLGLESTALPVLVISVSIISAFWLGHTCGLVDETGNPTGGLFGTAVATMGMLSTAAYILTMDMFGPIADNAGGIVEMSQQPESVREITDVLDAVGNTTKATTKGFAIGSAALASFLLFSAYMDEVSAFAHEPFKQVDIAIPEVFVGGLLGSMLIFVFSAWACAAVGRTAQEVVNEVRRQFIERPGIMDYKEKPDYGRCVAIVASASLREMIKPGALAIISPIVVGQPLLGAKVVAALLMFATVSGILMALFLNTAGGAWDNAKKYIETGALGGKGSEAHKAAITGDTVGDPFKDTAGPSIHVLIKMLATITLQGRGFGENTNSNRIKTNKSDKGLVSQQSKGSANKQSRPLSSQAPRLSSQLDGKSRNDFLDVDFEERLKAVRRSALEQKKAEEEKEFGAIDYDAPIPSDNTTIGVGTKIGVGVAVAVFGLVFAFGDFLPSGSVSPTEDSAVVNSKLSEEDKATLQSRLKEFEATLSNSSRDPTALEGAAITLAELGEYARAASLLDDLTKEKPNDADVFRLLGEVKYELKDYEGSVAAYKSSARVSKDIQFEVLRGLSNSLLAAKKPEEAVQLLLAYREHLSSDSNPTDSQKLDPVQVELLLGKAYSDWGHVRDAVAVYDQLISTHPNDFRGYLAKGIILKENKNIGDAERMFIQARFFAPDKAKALVDRYSR

SEQ ID NO: 112024 - protein, 970 aa, Glycine max
  Coding DNA Sequence Number=SeqID_20339
  Gene Ontology: Mol. function=RNA-directed DNA polymerase activity; Cellular component=exocyst; Biological process=exocytosis
  Homolog annotation: Hit_ID=A5BJM0; Match level="QueryCoverage=66%, HitCoverage=95%, E-value=0.0, Identity=52%"; Hit description =Putative uncharacterized protein
  Pfam annotation: Domain name=Exo70; Domain location=41-638; Score =362.5; E_value=6.9e-106; Accession=PF03081.6; Description=Exo70 exocyst complex subunit
MESLEAARKCLTTSLETSSAISSALDESGSRLELLNQRYLSLQASLRPISKQKCSFVNIDHGIDSVLCSAAALLKVSDSVHQLEHSLLTDPSSDLYTYVSDTKKLEEALKLLTDNCRLTVGWLKDVFEFLQDKPITNELYLLNVKKSLRILQELQVKEESARLDGGLLSTAFDKLELEFQRLLIANSMPLPLVSLTSHIGQQASIARQALPLTSSLAGKLHAITERLHANGRLDKCQSIYVEVRGMNARRSLNTLDLSYLEIPTAEFEAVQCMESYIDQWGCHLELVVKQLLETECRLSAIVFEKIGPEAWMGCFAKIAMESGILSFIRFGKIITDRKNDPLKLLNLLSIFKVLNGLRLKFNQLFSVKACKEIRTVTEDLIKKVVNGTSEIFWQLPAQVKLQRPTSPPPDGSIPKLVSFVTDYCNQLLGDDYRPHLTQVLGIHLSWRKEAYEEGIVLCQIYNAIKEVAVNLDTWSKAYEDITLSYLFMMNNHCHFCNLRGTVLGNMMGDSWLRAHEQYKDYYAALYLRTSWGKLLSILVVPRDILSPSSASVTSQDLAKRLNAFNLAFDERYKKQSNWVISDEILRENVCKHLVEGIIPIYRAYVKNYCLSIENDAKVDKHMKYRAQSLENKIRSMFQPKQRKASSIKQADLISKIKQTRRSVLTLLSSDGDDGGDDTHTDTTEMVVASNSSFLLPANASRAERNGGSNELNVSAWDDKPFEMLPSGNKAYLDEQDVVTFLDPPKDLIPFDPSSYNPAAYLWKKIEDIPQERRHRLLRLLKPRLVSIAWQIAGTRFDDPKLVKKSASTLLSSSTNDGIMLECYNCTSSGGGSVLTAFADSFAPLYFTVRELKEVMSTEQPCDLAYEFGDGLHDIKELPLGFPRPVKHPYPFNDQIVVYVRYLGPGVSVGQAWQEGTKLEQVPRLSVESECISVIMGYLELEGEGHCFWQYGPSAVSALKKGPKIARLWQH

SEQ ID NO: 112025 - protein, 340 aa, Glycine max
  Coding DNA Sequence Number=SeqID_20340
  Gene Ontology: Mol. function=nucleic acid binding; Cellular component= nucleus; Biological process=RNA processing
  Homolog annotation: Hit_ID=Q8L5G3; Match level="QueryCoverage=72%, HitCoverage=85%, E-value=9e-84, Identity=68%"; Hit description =Proline rich protein 3
  Pfam annotation: Domain name=RRM_1; Domain location=219-286; Score =32.8; E_value=1.3e-06; Accession=PF00076.13; Description=RNA recognition motif. (a.k.a. RRM, RB
  Pfam annotation: Domain name=RRM_1; Domain location=41-108; Score =6.3; E_value=0.039; Accession=PF00076.13; Description=RNA recognition motif. (a.k.a. RRM, RB
  Pfam module annotation: Pfam domain module=RRM_1::RRM_1; Domain location=219-286::41-108
MAGTGIHPYHQQWAPAAAAPPPPPAAAGGPPPHPGEEVRTIFITGLPEDVKERELQNLLRWLPGFEASQLNFKAEKPMGFALFSAPHQALAAKDILQDMLFDPDTKSVLHTEMAKKNLFVKRGIGAADAGGAFDQSKRLRTAGDYTHSGYTSPSPFHPPPPPVWGPHGYMAPPPPPPPYDPYAGYPVAPVPMPTPAPIPAPSTYVPVQNTKDNPPCNTLFIGNLGENINEEEVRGLFSVQPGFKQMKILRQERHTVCFIEFEDVNSATNVHHNLQGAVIPSSELFKGNPGSYMLSDLYRISKHDKASFHNGRSITAAAISLQVGTSVDYQVKQPFNYMMP

SEQ ID NO: 112026 - protein, 708 aa, Glycine max
  Coding DNA Sequence Number=SeqID_20341
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LU41; Match level="QueryCoverage=97%, HitCoverage=65%, E-value=0.0, Identity=69%"; Hit description=Calcium- transporting ATPase 9, plasma membrane-type (EC 3.6.3.8) (Ca(2+) -ATPase isoform 9)
  Pfam annotation: Domain name=Cation_ATPase_C; Domain location=539 -685; Score=51.4; E_value=3.2e-12; Accession=PF00689.12; Description =Cation transporting ATPase, C-terminus
  Pfam annotation: Domain name=E1-E2_ATPase; Domain location=2-118; Score=-129.2; E_value=0.086; Accession=PF00122.11; Description=E1-E2 ATPase
  Pfam annotation: Domain name=Hydrolase; Domain location=151-431; Score=14.7; E_value=0.0033; Accession=PF00702.17; Description =haloacid dehalogenase-like hydrolase
  Pfam module annotation: Pfam domain module=Cation_ATPase_C::E1-E2 _ATPase::Hydrolase; Domain location=539-685::2-118::151-431
MASISEDTGEETPLQVRLNGVATFIGVVGLTVAVLVLAVLLGRYFSGHTKDIDGNVEFVAGKTSVSNAVDDVIKIFTIAVTIVVVAVPEGLPLAVTLTLAYSMRKMMADKALMTVVEAYVGSTKVYSPDDSSKLHPKALSLINEGIAQNTTGNVFVPKDGGETEVSGSPTEKAILKWAVKLGMDFDVIRSNSTVLHVFPFNSEKKRGGVALKLGDSGVHIHWKGAAEIVLGTCTQYLDSDGQLQSIEEEKGFFKDAIDDMAARSLRCVAIAYRSYELDKVPSSEQDLDQWSLPEHELVLLAIVGIKDPCRPGVKDAVKVCTDAGVKVRMVTGDNLQTAKAIALECGILASIEDAVEPNIIEGKKFRELSEKEREDIAKKITVMGRSSPNDKLLLVQALRKGGEVVAVTGDGTNDAPALHEQQIVAINIEIPTADIGLSMGIQGTEVAKESSDIIILDDNFASVVKVVRWGRSVYANIQKFIQFQLTVNVAALVINVVAAITSGDVPLNAVQLLWVNLIMDTLGALALATEPPTDRLMHRSPVGRRESLITNIMWRNLIVQAVYQIAVLLVLNFCGESILPKQDTKADAFQVKNTLIFNAFVLCQIFNEFNARKPDEMNVFRGVTNNKLFMGIVGVTFILQIIIIEFLGKFTSTVRLDWKLWLASLGIGLVSWPLAIVGKFIPVPKTPLARYFLKPLRRLKRSRSRATQ

SEQ ID NO: 112027 - protein, 67 aa, Glycine max
  Coding DNA Sequence Number=SeqID_20342
MDKILKVGKDEWRERERRGHGIYASNEVMQSYPARALARRLQVDWARDPREGPRVLMSLRVDFEPMG

SEQ ID NO: 112028 - protein, 112 aa, Glycine max
  Coding DNA Sequence Number=SeqID_20343
MLPTFNTRHVRKYMEKNEETTMEEKVMLKINGGLRSTYLKLLCSDYHLMEACLRSFYRVENKGEEVRGGAIHLGISHGRRSFTTKRVPWIRSLKRKLQWRKRMRERERGQKA

SEQ ID NO: 112029 - protein, 107 aa, Glycine max
  Coding DNA Sequence Number=SeqID_20344
MGEEVAAQLAQATWVASSLSNPPSKMFWKDFTDYVTTPIFFPECCETLRITQQCSFSSRNVVKLYGLRNDACFEGSKGSKQGSRTDHKYSRTKLGYDNPKQVAIQAT

SEQ ID NO: 112030 - protein, 77 aa, Glycine max
  Coding DNA Sequence Number=SeqID_20345
  Gene Ontology: Cellular component=chloroplast
  Homolog annotation: Hit_ID=Q49KT9; Match level="QueryCoverage=58%, HitCoverage=39%, E-value=1e-11, Identity=71%"; Hit description =Putative uncharacterized protein ORF113
MGAGHARSRYLNRKEGDAEGRASDWSEVVTSHMDSLMCSSAPDPEMWIIQGTLAWRTSPVEPGLKPNYPQEDRWAIQ

SEQ ID NO: 112031 - protein, 95 aa, Glycine max
  Coding DNA Sequence Number=SeqID_20346
  Homolog annotation: Hit_ID=A0ST23; Match level="QueryCoverage=27%, HitCoverage=53%, E-value=1e-07, Identity=100%"; Hit description =Putative reverse transcriptase
  Subcellular localization annotation: CTP_CleavageSite=38; ConfidenceScore=5.48e-01
MALNLPCKISMVPKAVHIISSLSIPSTSRGGPVPAFVPFSEVGKPVVPAALMNRPTRGERRFAYWALAECILAYYVGTDEGVSEVLHVAGEKRLH

SEQ ID NO: 112032 - protein, 117 aa, Glycine max
  Coding DNA Sequence Number=SeqID_20347
WLCFYQLSLLSATDGVVRNGKSTAWTSALASVAAAQLLGRAIGAGLFAITPAGERGMCCKAIKLGNASVFPRSVYWAYYVGTDEGVSEVLHCGRRKKAAPVRQQNNVIQDIFRFLAH

SEQ ID NO: 112033 - protein, 165 aa, Glycine max
  Coding DNA Sequence Number=SeqID_20348
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
MISWGGRQKRGFAPTYPQLRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSGTATLASADVRRVLLPLRTTPSVAEQEGQLIETEATGAPQKHHHTLNQ

SEQ ID NO: 112034 - protein, 111 aa, Glycine max
  Coding DNA Sequence Number=SeqID_20349
  Gene Ontology: Mol. function=nucleic acid binding; Biological process= DNA integration
  Homolog annotation: Hit_ID=A5AEN5; Match level="QueryCoverage=77%, HitCoverage=6%, E-value=3e-12, Identity=43%"; Hit description =Putative uncharacterized protein
MATVDITGSNSNDLNKPFRFEGYPFKCWQQKMMFSLTMRKVAYVLNTNIPMVLEDAEKEVKDKMIMELALWNENDYLCKNFILNELADDLYDYYSPYKFAKISLAGSGKEI

SEQ ID NO: 112035 - protein, 146 aa, Glycine max
  Coding DNA Sequence Number=SeqID_20350
  Homolog annotation: Hit_ID=A5BK68; Match level="QueryCoverage=100%, HitCoverage=100%, E-value=7e-51, Identity=73%"; Hit description =Putative uncharacterized protein
MAFSDRGSLLQAPPNLYKVLLAATSGLCSGRHSYVLLFAPYLRIQRKESRFRGVGSLISTPPVLIRSGPWSSVSGLPADKISEIDQPAGLSYRHGPTDLFSIGASSSATRFYLTKPRARPRREFALPNSLFDNKAETPDPTFISFE

SEQ ID NO: 112036 - protein, 68 aa, Glycine max
  Coding DNA Sequence Number=SeqID_20351
MVTVFGMSEIGPWALTDPAVQSSDVDQAYRYRRPRGGARCINESANARGEAVCVLGASGVYTGLLCWH

SEQ ID NO: 112037 - protein, 45 aa, Glycine max
  Coding DNA Sequence Number=SeqID_20352
MGDQEEVQEQMRVDMSALKELMASMMDAMLGMRQLMEKNAATAAA

SEQ ID NO: 112038 - protein, 122 aa, Glycine max
  Coding DNA Sequence Number=SeqID_20353
  Homolog annotation: Hit_ID=Q32J13; Match level="QueryCoverage=32%, HitCoverage=35%, E-value=1e-08, Identity=77%"; Hit description=IS1 ORF1
  Pfam annotation: Domain name=Ins_element1; Domain location=54-115; Score=-20.7; E_value=0.014; Accession=PF03811.4; Description =Insertion element protein
APGINRDTRIYLFCEVDLPSPGIYSAQSASGDAAQLTDLVYDGVFEVLQWLLFLSAVPSCSATDGVVRNGKSTAGHQRWQAAQLLGRAIGAGLFAITPAGERGMCCKAIKLGNARVFPVTTL

SEQ ID NO: 112039 - protein, 257 aa, Glycine max
  Coding DNA Sequence Number=SeqID_20354
  Pfam annotation: Domain name=Transposase_23; Domain location=1-70; Score=5.2; E_value=0.00032; Accession=PF03017.5; Description =TNP1ENSPM transposase
MGDSDKCGLYIEANPPRLVALGRVYEGSTIHNIPLLPGQVKVGVEEVKDAQAPVPVPTDEVTLVGQALNTFLAWPTHLVKPLSEHVNWDATMFEVFNPNFLLYIKHEDLSEIAHGSQCLSIFVIQLWIVHLTKTTMRAGNSDVYGLLDAQSIQRSGQLQFDSEKLHQELDAEFKTRCLPWSLLNGGHRKMVFILPKENLVVWFCSLHNRSDNYLKGIINSALKGLDDTPQSKSKAGARWIVVKYFNDVKPLEAKRLK

SEQ ID NO: 112040 - protein, 298 aa, Glycine max
  Coding DNA Sequence Number=SeqID_20355
  Gene Ontology: Mol. function=two-component sensor activity; Cellular component=outer membrane-bounded periplasmic space; Biological process=two-component signal transduction system (phosphorelay)
  Homolog annotation: Hit_ID=A1G2F7; Match level="QueryCoverage=97%, HitCoverage=59%, E-value=1e-91, Identity=53%"; Hit description=EAL precursor
  Pfam annotation: Domain name=EAL; Domain location=30-269; Score =315.6; E_value=9e-92; Accession=PF00563.11; Description=EAL domain
MTEDTIYAVSRRDDLVAIAMEPRSNVAEQRRLSPLAELEIAVRKREFIVHYQPIVELKTGICVGAEALVRWRRPDGTLVRPDLFIPLAEESGLIMPITDQVIDAVIADLRKVLVEDRTLHIAINLCADDIKSGRVLAVIASKLQHTDIRPEQIWLEATERGFIDINAAKVTLAEARQRGHSVAIDDFGTGYSSLQYLQGLPLDALKIDKSFVDTVGKDTATSSVTSHIIGMAKALGLFTVAEGIEAEDQRDYLEGQGVDFGQGWLFAKALPASEFLAYHRHTKQKYGASPEIIKAAGK

SEQ ID NO: 112041 - protein, 149 aa, Glycine max
  Coding DNA Sequence Number=SeqID_20356
MKRWWAMHPQSFADLVFASERIDVGPKRGKFDHPTRTTEKTGANKEGEDEGETHAVTAIPIRPSFPPTQQCLYSANNKPPPYPPPSYPQRPSLNQPQSLSTALPMTKTTFSTNQKTPTKRNFAARKPVEFTPIPVPYADLLPYLLDIQW

SEQ ID NO: 112042 - protein, 47 aa, Glycine max
  Coding DNA Sequence Number=SeqID_20357
MRVGLLPVLLPVILSNKRWWRLHAYSFRGTHPASHASPSNAEGGEVP

SEQ ID NO: 112043 - protein, 131 aa, Glycine max
  Coding DNA Sequence Number=SeqID_20358
NNGGITSLINTQGNRGKYGLGYKPTQADVKRSIAGRKNSGQSSRWRQEGEGSPPCHISRSFISAGLGDKGQASDDESPEGTNTWDPPIDFEQEMNQTEDEGNEDVGLPPELERMVAHEDQEMGLHQEETEL

SEQ ID NO: 112044 - protein, 72 aa, Glycine max
  Coding DNA Sequence Number=SeqID_20359
NKVWKPENFESFWQRNKKKDEKQMFQDFSKVVKEVETGNRLPESKNSACFYTCAKPSFPELSAFRRGIHRVK

SEQ ID NO: 112045 - protein, 335 aa, Glycine max
  Coding DNA Sequence Number=SeqID_20360
  Gene Ontology: Mol. function=motor activity; Cellular component=cell projection
  Homolog annotation: Hit_ID=UPI00016621D1; Match level="QueryCoverage =72%, HitCoverage=41%, E-value=5e-20, Identity=34%"; Hit description =UPI00016621D1 related cluster
RGSRTTRLTLRGLHALVFRGLHAVTFRVLHAVTFRGLHVFAFRGLHVLAFKGLHALPIRGLHALTFRELHVLAFRGLHLLAFRGLHILTFRGPHVLTIRGLHVLAFRGLHVLAFRGLHVLTIRGLHVLAFRGLHVLTFRGLHALAFRRGLHALTLRGLHVLAIRGLHALTFRGLDVPTFRGLNFLAFRGLHSLSFRGLHVLAFRGLHALTFRGVHVLAFRGVHALTFRGLHVLAFRGLHVLAFRGLDVLIFRGLHVLVFIGLQALAFRGLHLLALRGLHTLAVRGLHALTFRRLLALTFRGLHVLAFRGLHALTFRGLHVLAFRGVHALTFRGLH

SEQ ID NO: 112046 - protein, 62 aa, Glycine max
  Coding DNA Sequence Number=SeqID_20361
MTSEVAKEIAYKIDVLNASIGQPEHPDHVRATGANVTIKNTLDRLQGLPTLLCPWLSKNWSN

SEQ ID NO: 112047 - protein, 120 aa, Glycine max
  Coding DNA Sequence Number=SeqID_20362
MEQYLRHLVRQQAANHRAHVQTHDCLYQMSLSMQSQGFASFSCPTLDQFRAEVACPGDWPEAQAGEAPPEAPGGGEEAHEDEEMVDLLDFLGGSGDTSLGDPQIHGECCKISPDARNGLG

SEQ ID NO: 112048 - protein, 127 aa, Glycine max
  Coding DNA Sequence Number=SeqID_20363
MWTTTGEELATQLAQASKVASSRSNSFLEEGSGRPKWGRLLFVPPFLLNAPPFYFFVFEEVTETHGLRKNTFFRFPPHHGISRIALACFLLISDTSRDFIYCATKDAKYLKRLTKGCMSTSNNPWTN

SEQ ID NO: 112049 - protein, 258 aa, Glycine max
  Coding DNA Sequence Number=SeqID_20364
  Gene Ontology: Mol. function=nucleic acid binding
  Homolog annotation: Hit_ID=A2Q4S5; Match level="QueryCoverage=98%, HitCoverage=48%, E-value=4e-27, Identity=28%"; Hit description=IMP dehydrogenase/GMP reductase, putative
  Pfam annotation: Domain name=DUF1723; Domain location=43-92; Score =59.2; E_value=1.4e-14; Accession=PF08330.1; Description=Protein of unknown function (DUF1723)
ERPDLKLVSHDRKVDKIGRPAPEIEGLIAGTRLSPLIRCFVITTNPGLIFAFVERWHRETSTFHLPIGELAITLDDVVSLLHLPITGALHTFKSLVTSDAIGLLTELLEVSHEEATFETRQAGGPHVRLGWLRDLYQSQCRARRWVVAARTYLLHLVGCTLFANKSSTHCWIYEHFPTVHTSVVHDAYDKGSPQACKWLTGKAHMTGIKGDPYQRRLDALTVTDMCWMPYGEHRGVKGFDLISSYTGQLRWGQIVVYV

SEQ ID NO: 112050 - protein, 234 aa, Glycine max
  Coding DNA Sequence Number=SeqID_20365
  Homolog annotation: Hit_ID=Q6UUU1; Match level="QueryCoverage=23%, HitCoverage=36%, E-value=5e-17, Identity=81%"; Hit description =Putative uncharacterized protein
GPELPGINRDTRIYLFCEVIFRHRYLFGAKCVGCPSCSATDGVVRNGKSTRRTSALASVAAAQLLGRAIGAGLFAITPAGERGMCCKAIKLEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWAYERGRRFPGRCQEILNRE

SEQ ID NO: 112051 - protein, 141 aa, Glycine max
  Coding DNA Sequence Number=SeqID_20366
MAASDIAILRDRAHIPTKKSLLELTSQSALLAQNKLLSKQLEALIETLRCPICGGAHNSSCCIPNEEPTHEVNYMGNQPRQNFNEECKVVMKRSRMEIKADEGRAEEKVEGYKQQSTTKLTLEPISDFVELEEVVEDEDDQ

SEQ ID NO: 112052 - protein, 110 aa, Glycine max
  Coding DNA Sequence Number=SeqID_20367
RAFTKCNIQWLSARKNPEEDELSSSLSAPLDVSSIGACRPRIFFINGFLCFLEDEWQRNEERKRERRRHFKEKMSLEEAHHHRRPWIRAWRKKEMNEGRGREEHEILCSK

SEQ ID NO: 112053 - protein, 95 aa, Glycine max
  Coding DNA Sequence Number=SeqID_20368
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=87%, HitCoverage=15%, E-value=5e-37, Identity=69%"; Hit description =Photosystem I P700 chlorophyll a apoprotein A1
LFVCVVWKEEDSMIIRSPEPEVKILVDRDPIKTSFEEWAKPGHFSRTIAKGPDTTTWIWNLHADAHDFDSHTNDLEEISPKTWLSDPTHIRPSAQ

SEQ ID NO: 112054 - protein, 232 aa, Glycine max
  Coding DNA Sequence Number=SeqID_20369
MEGLVDLAVIDAFLAFHHGEESPVVAILAMYDTFYRGCEKSGARIVCCALPLYVWLVSHPFLQEGRPVYPLQGHRLCVEKGKANWDQLLASMEGRLLIGSLARRKEGSGFYLHAKDECHQTKASRLSSHGVLVTTNVRDRELRGSSNGIIGGYHKWLRVQTQGLDWLPNLKTVRDDEVKASEESDEVQALKAELERARVVEEKFKAAIVSSSSEEVKGIITGQRHDLEGRAK

SEQ ID NO: 112055 - protein, 94 aa, Glycine max
  Coding DNA Sequence Number=SeqID_20370
MAACPHLQRTTRPHHQRAARPHLQRTTCPRLERATRPHLGYYLPSPLRGLHVLALRGLHVLTIRGLHALTSRGLHVLALRGLHALTLGTSYPHR

SEQ ID NO: 112056 - protein, 112 aa, Glycine max
  Coding DNA Sequence Number=SeqID_20371
MHALLGSFNSGNWSDSKVLDSAGLSCHGFTRNWGAIILYMHRSPTGNLVPLDLEIEATLRRNRAERKRKFLEDRTVASILEEETHFSDLLSPDSPSSRESALNYLKPLHARA

SEQ ID NO: 112057 - protein, 109 aa, Glycine max
  Coding DNA Sequence Number=SeqID_20372
MENHRFISKSDSTKARSNRKHIRQQKVHLDVQHSVHASLNPASSHTEDDYNQPKTPPHSVHATVDRAPHDAEDHFNICDSSKNETSGLAEGRITNLLHLLINFTSNHNT

SEQ ID NO: 112058 - protein, 226 aa, Glycine max
  Coding DNA Sequence Number=SeqID_20373
EELATQLAQASKVASSRSNSLLEEGSGRPKSQWGRHLYHISVDPLREVETTLHIKTSSLEYKLWVGGILDAIYERVSVNGIIMDAQQYKSGVDWMFLMVIIGGELSVTFLGGVGGGGGGCWIVSHALRFTLSLPLIVTCPPHVVASRPPNRPPFFCNCSIYSNSHITDVSARVEHADELGLPFLAPTILRPKEKFSLTPQWAPNFPTEFRQALNKLPNSPHSQQSL

SEQ ID NO: 112059 - protein, 121 aa, Glycine max
  Coding DNA Sequence Number=SeqID_20374
  Homolog annotation: Hit_ID=Q2R1R7; Match level="QueryCoverage=52%, HitCoverage=3%, E-value=3e-08, Identity=49%"; Hit description=AT hook motif-containing protein, putative
MLDEYNAHAKIFRMVRDRLANSDVDNVRLRLIATREKDGRTYNVPTVSKVATLIVDFSPDQMKLKLYRILEDYFNNSLLKHIPWVESERLNYIRNNQKKLRVDKYCSLQNSLDAGTSQGFK

SEQ ID NO: 112060 - protein, 96 aa, Glycine max
  Coding DNA Sequence Number=SeqID_20375
GWWVYVRIVDVENLLCTIARPPPSTTYDGVKLPAFIVDHRVVPGDMSRGSGDLGDVRRAPGSQQIKGKQDHKARRLVGAKMVSGNRLPGDVIDYQA

SEQ ID NO: 112061 - protein, 233 aa, Glycine max
  Coding DNA Sequence Number=SeqID_20376
MSLSRRIREAVMRPSFAAGNSSLSCGQASEILALTRLQRALMDRFGKTVRQLLLRYGDVDYTGSEQSVTGHVRRQFWLPTHAADAVWHPARLCVTDAAGERGAGAAIALDGVGAVAADGGGMQLFAVAVVENLPRRCAAVARTSASDDPAGRRVFPGGESQSLADGHQRGADVRQQQRCAGGAARLCRPQPAVHFNLGSARRSAAPSPADCVETSGVQYANGAVAGGDHRLDA

SEQ ID NO: 112062 - protein, 247 aa, Glycine max
  Coding DNA Sequence Number=SeqID_20377
  Gene Ontology: Biological process=transposition, DNA-mediated
  Homolog annotation: Hit_ID=P0AAT3; Match level="QueryCoverage=18%, HitCoverage=36%, E-value=4e-18, Identity=95%"; Hit description =Uncharacterized protein ybdF
  Pfam annotation: Domain name=DUF419; Domain location=69-165; Score =52.2; E_value=1.8e-12; Accession=PF04237.4; Description=Protein of unknown function (DUF419)
LELLRADQRLIFAKSWPGLPRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDPSIKPGYHMNKKHWISVYPGEEISEALLRDLINDSWNLVVDGGARYQLLFPLVRVNFELGVIMVIAVSFGKPVVPAALMNRPTRGERRFAYWALAECILAYYVGTDEGVSEVLHVAGEKRLH

SEQ ID NO: 112063 - protein, 54 aa, Glycine max
  Coding DNA Sequence Number=SeqID_20378
TYQGNPCGVYPDLSSFTGSGVYPVLSSFIGSGVYLDLSSLFGSGVTQTFVACIK

SEQ ID NO: 112064 - protein, 127 aa, Glycine max
  Coding DNA Sequence Number=SeqID_20379
MGSSQNLRLKRGSIKSNQELRVTSLRKLGQLMVNFNGKPSAKPMDFQLVPIVKEFEEILGCPLGGRKPYLFSGFYPSTTRVAKVVKISAQELDRVKQNRNGVVGVPRKCLEERAKALANQGEWAFFY

SEQ ID NO: 112065 - protein, 90 aa, Glycine max
  Coding DNA Sequence Number=SeqID_20380
LGCFWRKQPRSPGRAGRQPPPPFSYKKAEGGCSKDPGAPWLCISAVLGEKNCFREENPSRGASVTLPRCFRKQIREGFRPFFIRSSFFNG

SEQ ID NO: 112066 - protein, 127 aa, Glycine max
  Coding DNA Sequence Number=SeqID_20381
MTQELVARGDTLRLSAPRHSVTPSVIDEQRPMWSSAPFPEMSASSGGDFLKSHKLSRTTGGGPDDTQRYLTVICTLVSSRGGGPDDARRYLTVIRTLLSYRGGGPDDKQRQNLVILHPCVIQRRRAR

SEQ ID NO: 112067 - protein, 292 aa, Glycine max
  Coding DNA Sequence Number=SeqID_20382
MDFHRHRFRGAEHQQRFEAIKGTAKFNPEIVMEFYANPWPTEGVKDMHSWVRGQWIPFDEDAINQFLGHPLVLEEGQRCEFSQWRSQASGFDEEAISQLLCIPGQDFAWTAAGRRVSVHVAQLISDAIYQFAGITAPRHPMDPEKSKRALGFPALITGLCQFYGVAVTPTKLIQPPINKAFIEKYCVPRQVQDQAPQQPEEDQQQPVADAPPSPLEEVPFLRSISNHLRRIELQMHRYMQHVTGQQAANHRGQDPSPFPWPTPEKFEATMDWLEDETNFETRAGPAEALGDD

SEQ ID NO: 112068 - protein, 239 aa, Glycine max
  Coding DNA Sequence Number=SeqID_20383
MQELGWLPKIKVSSEEEAETPKESEEVQALKVELERAQAVKKKFKTTAIKAVKTITKHTLSHPYRTRSKTRVMGDVEEVQEQMKADMLALKDQMASMMEAMLSMKRMMESNTATVAAANSAAEADPTHPSTTNQAHQPIPDMVGQGGEVLGSTGCPHMGYNRNAYPYDLPPNYTPPTMHMLNENTNHVIPVEGQQPQPMGGTREEPRERAQGDFDPYPTFTTKGPVYNAMPQPDTKGAP

SEQ ID NO: 112069 - protein, 171 aa, Glycine max
  Coding DNA Sequence Number=SeqID_20384
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MKHFTDTLISANIGTKAGTGPPLEVDGIDKLDQQLLSASNPLSSCLQGLASPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRAFAVTHHPVSS

SEQ ID NO: 112070 - protein, 51 aa, Glycine max
  Coding DNA Sequence Number=SeqID_20385
MKSLRGKEIALVKVQWGPDEGDSTWELEDRLISGTKFLKGWEYCDILEFLP

SEQ ID NO: 112071 - protein, 154 aa, Glycine max
  Coding DNA Sequence Number=SeqID_20386
  Homolog annotation: Hit_ID=A5ATL8; Match level="QueryCoverage=37%, HitCoverage=45%, E-value=3e-19, Identity=82%"; Hit description =Putative uncharacterized protein
STLEDPQIPGLNPGQAVETTKLEYETKARGANGIRYPSSPSRKRWILGAVRIDPCNAVANALSIPPGEYRRTLPGLDMPRILLKERGAFGNADTGGAWLSSARATAGDKPEEGEDDVKSSCPLCPGRHTCYNGRDKGSRSREGELTPKPSSVRL

SEQ ID NO: 112072 - protein, 617 aa, Glycine max
  Coding DNA Sequence Number=SeqID_20387
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=Q3KF49; Match level="QueryCoverage=95%, HitCoverage=55%, E-value=1e-75, Identity=32%"; Hit description=Hpt sensor hybrid histidine kinase precursor
  Pfam annotation: Domain name=HisKA; Domain location=484-546; Score =58.0; E_value=3.1e-14; Accession=PF00512.16; Description=His Kinase A (phosphoacceptor) domain
  Pfam annotation: Domain name=SBP_bac_3; Domain location=206-421; Score=33.3; E_value=3.6e-10; Accession=PF00497.11; Description =Bacterial extracellular solute-binding proteins, family 3
  Pfam module annotation: Pfam domain module=HisKA::SBP_bac_3; Domain location=484-546::206-421
MLRYTDRDAALAAIAADQADMLFSKAGNTVPANAQLDASQNLLINRPVVVTQRDRAMQPVPYAAPVRLAVDQHYLSDSVIRAQFPQAHIMRYASSRVALSALATGEADYVLDNLTSASFLIERNYLNQLALADILAPRAQDASRLLVSQRRPVLLRAINRVIAAIPAEQHRAISRQWTQRPDIWRLQQPLALTAAEQRWLQQHGSVRVGFNPFFAPLALLDGRNQFQGISAELLHQIHLRTGINFVAVPEYHEDTLLMQLQQHKIDMVAALSYNAQWPGRFTQPWLHTPFVLITAANAGAPAALHSGLRISVMKGSPVIGWLQQHYPEVQLQLVDNASLGMQQVVEGKADGMVHNQLGAAYLIKRYFSGRMRIVQRVGTQPAHISFAVHAGDPELLSIMNKALNEILPSEISQLTSRWQGTPEVTASSWPLYRAPFYALAGVAAVVSLACLLWVYQRGREIRRRRRAQRQLQIARDRADRENQAKSRWVATVSHEIRNPVNAIIGLLALEARKAGASEALLTAWQSAQALSGLVGDILDMAKIERGQLTLAPQWHSIATLCQPVLQLYQGLAHEKNLTLSYHTTLPDLEVWVDAPRLRQVIANYISNAIKFTPQCTG

SEQ ID NO: 112073 - protein, 128 aa, Glycine max
  Coding DNA Sequence Number=SeqID_20388
  Subcellular localization annotation: CTP_CleavageSite=52; ConfidenceScore=5.32e-01
MLVRMIRTRLFATAQVKSCPGMHSSCVIAPLSGCARTVGPPPISGGGPGTVRASPEMRTRSPLKVRACSPLKARTCSPLEVRACSPLMVRTCSPLKARTCSPLNGEGRVVLSRRGRVVLSTVRVTSTQ

SEQ ID NO: 112074 - protein, 24 aa, Glycine max
  Coding DNA Sequence Number=SeqID_20389
MAQPPPRERTLREMATPDFTSLLH

SEQ ID NO: 112075 - protein, 96 aa, Glycine max
  Coding DNA Sequence Number=SeqID_20390
MDGGCMNGKSNFMGLRIRLMVEDARTALGNQFVGVRTRWMHEQRKAINSSGSGLDGGGCMNGNQFMGLRIRFDSGGCTKSARQSIRGGPDSMMEDA

SEQ ID NO: 112076 - protein, 54 aa, Glycine max
  Coding DNA Sequence Number=SeqID_20391
MALRKLSSKRSRKDAAAEGTSAAPEFDSHRFRSAEHQGGRTGPAVMGKGPVDSF

SEQ ID NO: 112077 - protein, 69 aa, Glycine max
  Coding DNA Sequence Number=SeqID_20392
  Gene Ontology: Biological process=transposition, DNA-mediated
  Homolog annotation: Hit_ID=Q1J7G7; Match level="QueryCoverage=43%, HitCoverage=42%, E-value=2e-10, Identity=100%"; Hit description =Transposase
WPGLPGINRDTRIYFILRSDLPSQWLLFLSAVPPVQLLTGWCVTAKAPPDISAGKCSGHAARNHHTRRA

SEQ ID NO: 112078 - protein, 166 aa, Glycine max
  Coding DNA Sequence Number=SeqID_20393
  Homolog annotation: Hit_ID=A5AK77; Match level="QueryCoverage=59%, HitCoverage=13%, E-value=1e-11, Identity=36%"; Hit description =Putative uncharacterized protein
MAQPPPRERTLREMAAPDFTYESLCIQYPDEDVPYVLKTGLIHLLPKFHGLAGEDLHKHLKEFHIVCSTMKPPDVQEDHIFLKAFPHSLEGVAKDWLYYLAPSCPHHQISEQLLLQLLSDYPLQLWGKPYILVLFILRPTCFLLEIDGWVPDISTFAGFVVGSVSF

SEQ ID NO: 112079 - protein, 104 aa, Glycine max
  Coding DNA Sequence Number=SeqID_20394
MKIHETQCGPPRQNRGEACRPARPGEQACFLQKQQPSGGIFWRAQVGLLSKKLRKLTNCAKTPLFDFRHITEFHESRKPASFRFLRRLGTSFIARHQVIIPGRN

SEQ ID NO: 112080 - protein, 67 aa, Glycine max
  Coding DNA Sequence Number=SeqID_20395
MSTTGRGRHSVLRIFKGRRGRTGHHATCGALPAAGPYLRLSRFQGILTRFPFGVRAQSAIRRASPVP

SEQ ID NO: 112081 - protein, 39 aa, Glycine max
  Coding DNA Sequence Number=SeqID_20396
MAQPPPRERTLREMAAPDFTYKSLCIQYPDEEVKTRTNI

SEQ ID NO: 112082 - protein, 58 aa, Glycine max
  Coding DNA Sequence Number=SeqID_20397
MACLDQQHSGREGQAVVAIVVVVEDFPVSDLDDSSNLNCICCLKDHNYFVVVGFAVEG

SEQ ID NO: 112083 - protein, 96 aa, Glycine max
  Coding DNA Sequence Number=SeqID_20398
MHKALRANAPLPYPHLVTMFLQHFNVPLEDEPFVKVIRSFAIGAGAVTSFRDRKDMDGQWVRKQDLPPPIPDERTPSPPPQRDTSSSLLNDILTEL

SEQ ID NO: 112084 - protein, 282 aa, Glycine max
  Coding DNA Sequence Number=SeqID_20399
MHRSPIGNLVPLDLEIEAMLRRNRAERRRKLLQDMTLVSFLEEETHFSDSSSSNSPSSRESLTYLPEVFSMANEHQQRLTLEDYSSSSVPQFFTSIARPEVQAHNINYPHSLIHLIRLGLFSISLAGKTKRWLQSFKGNSLKTWEEVVEKWAKTTNQANVRCFSKGKNKAEAPEEATELIKNMSASDHAILHDRVHQPTKKNLLELSSHDALLTQNKLFSRQLEILTETLGCIICGEAHETGQCIPIEENTQEVHYMGNQQRQRYTQGGFSGFQQGPYNYQG

SEQ ID NO: 112085 - protein, 90 aa, Glycine max
  Coding DNA Sequence Number=SeqID_20400
MPAGLRHLEPGIMPPRHPMDPEKSNKALGFSALITGLCQFYGVPIMLTKLIRPPINWLNFEAGVGPAGTPGDEDGAQEDDGMDDVMIFFL

SEQ ID NO: 112086 - protein, 205 aa, Glycine max
  Coding DNA Sequence Number=SeqID_20401
MECLLLLQLSSHIPHLRFEDVQSQSLSPAINFAYIKKNYWNVDDLIVNFRGARKARARPADVPSSFTPPASSTSATPTLVPPGPSTQDFQHFEFMLQCLYQGHPSLVREGGGPSAQAPQQLHDASSEASIPEPFVFEISLDPPSPVVDQSSPQQLADPPSPVHEMPANLSTPLLEILEDPATPVLGLTTTPPKTLVLHFTDEEDT

SEQ ID NO: 112087 - protein, 87 aa, Glycine max
  Coding DNA Sequence Number=SeqID_20402
MKRGRSRATRKIPAATIVAACIRAEIGVGPSIASDKSSENIITIVNNKILGKAHIRRRYLVAVGKSRSPTPINIGTGNGIKGMIHEY

SEQ ID NO: 112088 - protein, 135 aa, Glycine max
  Coding DNA Sequence Number=SeqID_20403
MGAKAPHKDQRKVACHQSKGPRTKLGYDTSDGQKSPLQLRFGETLDSCARSGPFDASPKIEFRGWWTLGDSVRRRRYVGELPLLRAICRSSGGIIGNNFPILQSGELSLCGNESIAALSLQCGPDGCTGDAQARL

SEQ ID NO: 112089 - protein, 206 aa, Glycine max
  Coding DNA Sequence Number=SeqID_20404
  Pfam annotation: Domain name=zf-CCHC; Domain location=101-118; Score =20.6; E_value=0.0012; Accession=PF00098.14; Description=Zinc knuckle
MKREKHASYSSHNSCKSLSEELRDCYEGRHRSHLRPHSHRREKERKPQEANINLPYFHGKDNVEANLDWEIRVEQQLKRKYTSKSYGSYSYLKKDQGQGILGCFKCLGRGHITSQCPTKKTMIMRGQDIYSSQDEATTSPSSSESEEAKGEESSKEIYPQEEGQPLMVKETLVSIATPLRLEFIPQVKELLDEGLVRKSLNPCALL

SEQ ID NO: 112090 - protein, 95 aa, Glycine max
  Coding DNA Sequence Number=SeqID_20405
  Subcellular localization annotation: CTP_CleavageSite=57; ConfidenceScore=5.73e-01
MDNTCESSASCSSPVIGPRSPSSGSLPLLCALSGMTLRSANMHSSSFFQILPCAQPRSVALSGWLAKPEDWLSKRMKISTSQTCLINLKLRGNYY

SEQ ID NO: 112091 - protein, 71 aa, Glycine max
  Coding DNA Sequence Number=SeqID_20406
MWVQAISLFAQATCAPEFGLPRSFNQRLLVLRVGGAAVKQQINNAHRDNPSLVFKNPLQQETHVLLIPFQK

SEQ ID NO: 112092 - protein, 48 aa, Glycine max
  Coding DNA Sequence Number=SeqID_20407
  Pfam annotation: Domain name=Fer4; Domain location=6-29; Score=8.1; E_ value=0.021; Accession=PF00037.18; Description=4Fe-4S binding domain
MKMLLIPHDVAPCGACRPCVATCPSRASEGEAHGCAFQRRKDAAESPP

SEQ ID NO: 112093 - protein, 89 aa, Glycine max
  Coding DNA Sequence Number=SeqID_20408
MLWKLGGIDGDPVLRRTRIRATWEYVSSIEGGQLGMVVLCVICGYGESTCTIARPPPSTTYDGVVPGDMSRGSGDLGDVRWGAIAQNQA

SEQ ID NO: 112094 - protein, 239 aa, Glycine max
  Coding DNA Sequence Number=SeqID_20409
  Gene Ontology: Mol. function=protein serine/threonine kinase activity; Cellular component=integral to membrane; Biological process=protein amino acid phosphorylation
  Homolog annotation: Hit_ID=A7NZ90; Match level="QueryCoverage=34%, HitCoverage=22%, E-value=6e-34, Identity=85%"; Hit description =Chromosome chr6 scaffold_3, whole genome shotgun sequence
NSYDHDYAKLEINGGVKGTKAGTGPPLEVDGIDKLDGVDRPSMGDVLWNLEYALQLQEAVVQGDPEENSTNMIGELSPQVNNFNHEVSVSAAQFEATSLDDLSGVSMSRVFSQLVKSEGSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 112095 - protein, 105 aa, Glycine max
  Coding DNA Sequence Number=SeqID_20410
MAWKKKHRRDMANLTLFGKMSHIAKANSCCMNTLSSFNCTSDEDMTKSKGKDPLEGLRGPMTRARARKAKEALQQVFSILFEYKPKFQGEKSKVVSCIMAQMEED

SEQ ID NO: 112096 - protein, 114 aa, Glycine max
  Coding DNA Sequence Number=SeqID_20411
  Pfam annotation: Domain name=G-patch; Domain location=1-42; Score =11.9; E_value=0.007; Accession=PF01585.14; Description=G-patch domain
MVARVMLGNSYKPGMGLGKDNGGITSLISARGNCGKFGLGYKPTQADIRKSVAGRKSGGQGSRLGQEVEGSPPCHISRSFISTGLGHEGKSLRYAKMIRRVGWIWYDHALLVSD

SEQ ID NO: 112097 - protein, 111 aa, Glycine max
  Coding DNA Sequence Number=SeqID_20412
  Subcellular localization annotation: CTP_CleavageSite=51; ConfidenceScore=5.22e-01
LFGLDLSLLLPKDPFNLYSKAKSFQSLVFISNSLGQFLLPLLLNVYNTEVLLSSDEATLVDNGLLGVIIHSFEDMEDLVFQKNFVDEVGIVDVIHSSQSLHIPQDVDLDCV

SEQ ID NO: 112098 - protein, 134 aa, Glycine max
  Coding DNA Sequence Number=SeqID_20413
MDAGWLTFQEDRPNVRTNPLANHGGGAVNAVESDRPHRSKPLRDVATPRRFIFEALQKGGVIPHSGCKEDSCLLHSGEMHDMETCLEVEELLQRMIDQGRLEVGIKGKEEQHHMHAIYGGERCCEAQTLGDILH

SEQ ID NO: 112099 - protein, 62 aa, Glycine max
  Coding DNA Sequence Number=SeqID_20414
MDIEEDVEIPLILGRPFMLTANCVMDEVENEMGSNGLKPRLLQTLEGNMRQASGCKEVLNGE

SEQ ID NO: 112100 - protein, 102 aa, Glycine max
  Coding DNA Sequence Number=SeqID_20415
MEPSLFGLQSLIEYLLLPPRSAPTTAPPGLAPWVFAATAAPSYSSGLGPCPDGRVSAQLGTVTQLPVHPASPVLLTKNGPLGALDSMARLNRAAAPSYLFKV

SEQ ID NO: 112101 - protein, 79 aa, Glycine max
  Coding DNA Sequence Number=SeqID_20416
MLTIAEKSVDLLGGGIWEPIQSLCSDSQPLMIAADDPITASPKLSVLSSRRIPCLANSLEYPRVVVTETSCDERRDAFV

SEQ ID NO: 112102 - protein, 194 aa, Glycine max
  Coding DNA Sequence Number=SeqID_20417
YLEGKARDYGESRGVGPVCGHISMLIFGVVLFPNVDGLVDLAAIDAFFAYHHSKESPVVAILKDLFDAFDRSCEKSSARIICCLPALYDRRQNNQLVFSMEGRKGGSSLLVWGLPKHPIDRDKVINEENFEAPEEDEEVRALKTELGKAKLAKEKFKLVVTDVQKECTRLREENAATARALERETKRARKEEYG

SEQ ID NO: 112103 - protein, 47 aa, Glycine max
  Coding DNA Sequence Number=SeqID_20418
MAIEIQKETFILGIPDVCNEYRNSGGNNAKAGLNSSSDLSILSALQY

SEQ ID NO: 112104 - protein, 103 aa, Glycine max
  Coding DNA Sequence Number=SeqID_20419
MEVTEVSLVYQHPRHRFGPQQHIQHLHFRCHIFESRQRYMYTSFILRDDVDVRQMFNIFYKNPSLSFVELFVIICDNNNPPTNQHGSTSNLEDLSDEYETCWV

SEQ ID NO: 112105 - protein, 109 aa, Glycine max
  Coding DNA Sequence Number=SeqID_20420
  Subcellular localization annotation: CTP_CleavageSite=39; ConfidenceScore=5.36e-01
MILHEIRRPNSLKTVPSGVANCRNLPFGGRATRRLAGASSMGGKYTESPPTFIRGKRREKPERCGLRTLSVKGSRVVFTHGEGCLPCSYVFLNCDRKSDLRSSLRTNVG

SEQ ID NO: 112106 - protein, 76 aa, Glycine max
  Coding DNA Sequence Number=SeqID_20421
RSGEMLIGEGLTRTSLPGKHEHTDSKCSFGDSTIPFSLGKATLAYTLCLESQRKDKSSDNNYQNWKCTWNHTALAA

SEQ ID NO: 112107 - protein, 61 aa, Glycine max
  Coding DNA Sequence Number=SeqID_20422
MWVQAIGLFAQATCAPEFGLPRPFNQRLLVLHVGGGAVNQQINNAHRDQNILLLHRSHLIL

SEQ ID NO: 112108 - protein, 177 aa, Glycine max
  Coding DNA Sequence Number=SeqID_20423
  Homolog annotation: Hit_ID=Q6UUU1; Match level="QueryCoverage=88%, HitCoverage=77%, E-value=1e-18, Identity=78%"; Hit description =Putative uncharacterized protein
MAYERGGDFLEDARKILNREVRGPRQSRFSIGSAPLTSITKSDAQISGGETRQDYKDTRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 112109 - protein, 53 aa, Glycine max
  Coding DNA Sequence Number=SeqID_20424
MACLDQQHSEKEGYVVVVVEDLSISDLDDFFNLDCIYCLKGHNDSVVAGFHKL

SEQ ID NO: 112110 - protein, 226 aa, Glycine max
  Coding DNA Sequence Number=SeqID_20425
MGLIWLARGSCRLLPCLGLGPVSRPCDLGPKLLRSRACKRDGTPPLLTEAEPVETIMIGLLRWWRCICGLMCITLCLPRRAVLLDEGPGDRRSNYFTGGDGNSKRLAEARDQHQKPQGPVGLIWVQRVPGRRHTCKQINDVSNHLGHVDAHPCQDGIHQLALRQREIGVVIASGHAGAHDPHPPPCSGPGEILPRYAQQLGNGFLIEPVGPVPPLAELTLLAFLQN

SEQ ID NO: 112111 - protein, 15 aa, Glycine max
  Coding DNA Sequence Number=SeqID_20426
TDSAPFIIQEEQAEW

SEQ ID NO: 112112 - protein, 154 aa, Glycine max
  Coding DNA Sequence Number=SeqID_20427
  Homolog annotation: Hit_ID=Q6UUU1; Match level="QueryCoverage=38%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPGVSLESCAVKAKLKGQVLVTAPPPASYL

SEQ ID NO: 112113 - protein, 101 aa, Glycine max
  Coding DNA Sequence Number=SeqID_20428
MGSSQTPSLKKRFYQVKVKSLGITSLRELGQLMGQLQQQDLAMAEVSTEAIASLAQYYDQPLRRFTFGDFQLSPMVKEFEEILGCPLGEGNHTSSQISIPH

SEQ ID NO: 112114 - protein, 132 aa, Glycine max
  Coding DNA Sequence Number=SeqID_20429
MEREMITMIVDTLPMFYYEKMVGYTPSSFADLVFIGERIEVGLRIGKFNYPSLMNMKPGANGENKKEGNPCCDCRPYMAKFPTSTTISILSRYQPFSLPTTLSAKNTQSSTKATPKLATKPACRTSDTKHHP

SEQ ID NO: 112115 - protein, 87 aa, Glycine max
  Coding DNA Sequence Number=SeqID_20430
MCLSWRSSKEEVVERFLKKYFQSQRLRKGKLQSLYFISSLRDRVHQPTNKSLLELSSHDTLLAPNKMLSKQLEILTETLDGKLYNLW

SEQ ID NO: 112116 - protein, 332 aa, Glycine max
  Coding DNA Sequence Number=SeqID_20431
  Homolog annotation: Hit_ID=Q84VH5; Match level="QueryCoverage=100%, HitCoverage=58%, E-value=1e-128, Identity=63%"; Hit description =Envelope-like protein
MIPGQAPAPEKLAPKRQQGVKISENPSIATSPREVDPEMDKKIRSIVSSILKNASVPDADEDVPTSSTPNVSVADADKDVPTSSTPNVSVADADKDVPTSSTPNAEILSSPSKEDSTEEEDQATEETPAPRAPEPAPDVPDIKRAKKSGKKVPGNVPDAPLDNISFHSIGNVERWKFVYQRRLALERELGRDALDCKEIMDLIKAAGLLKTVTKLGDCYESLVREFIVNIPSDITNRKSDEYQKVFVRGKCVRFSPAIINKYLGRPTEGVVDIAVSEHQIAKEITAKQVQHWPKKGKLSAGKLSVKYAILHRIGTANWVPINHTSTCCHRFG

SEQ ID NO: 112117 - protein, 175 aa, Glycine max
  Coding DNA Sequence Number=SeqID_20432
  Homolog annotation: Hit_ID=Q6WAY4; Match level="QueryCoverage=88%, HitCoverage=28%, E-value=1e-18, Identity=37%"; Hit description =Putative uncharacterized protein
MGTNQNGKRFYQVKVKSLDVTSLKELGRLMGPLQRQAFRKVYGKILDLTVAEVFTEAVVSLAQYYDQPLRCFTFGDFQMVPTIEEFEEILGCPLGGRKPYLFSGFLPSLSKIAAVVGDSAKEMDRMKQTWNGVVGLPRKYLEGKARDMASQEKWGPFADILALLIFGVVLFPNVD

SEQ ID NO: 112118 - protein, 21 aa, Glycine max
  Coding DNA Sequence Number=SeqID_20433
MVVDEVKTKKCTDCMHQTRKN

SEQ ID NO: 112119 - protein, 70 aa, Glycine max
  Coding DNA Sequence Number=SeqID_20434
MVSLSFSIWKCCGHIEMWVEEVSKSEGRAVGHVTCTELVADWAFSLIKADQLAAFLLSKSRSNRAERRMK

SEQ ID NO: 112120 - protein, 73 aa, Glycine max
  Coding DNA Sequence Number=SeqID_20435
  Gene Ontology: Cellular component=mitochondrion
  Homolog annotation: Hit_ID=A4LAN7; Match level="QueryCoverage=83%, HitCoverage=18%, E-value=4e-16, Identity=62%"; Hit description =Putative uncharacterized protein
MAGLDPTGDWMGRGARALDNPRTVTGEPSLEKLYSIRDSLNEAGARSPDFVSLQGKMLARRVLDDEHSGTDRF

SEQ ID NO: 112121 - protein, 175 aa, Glycine max
  Coding DNA Sequence Number=SeqID_20436
MATMMEAMMSVKKIMEANAVAIAATSVVAKIWWAKIWEVRATPIMYKFKTSTPSRHMVCLPNYTPPNVVYIPNEDVNNSTPILIKSQQPQSDHAHVSRPMEETHEIPHHDLANFEPCLGYAAEGQAVGGIPLQNTLEGPQYHPQPQPSRSTAVKNPHDYGRNGKVGSSRGKAQGH

SEQ ID NO: 112122 - protein, 152 aa, Glycine max
  Coding DNA Sequence Number=SeqID_20437
IPGQCTLLIHIDYSVLRHFQIPLDDEPFVQVKRSFAIGAGAVTSFGYHKDQNGQWLKKDALPPQDECTPSPPPQREDSALMNEVLSELRGLRSYVGDRFNSLDSRFAGMDIRLTQLEEDVGYIRQRGGKGCEKAYSSHDARRMVCNDQAEMT

SEQ ID NO: 112123 - protein, 111 aa, Glycine max
  Coding DNA Sequence Number=SeqID_20438
MAFIIGESFGGGHTREGLPAHHTPSGTTRVPSVCTIVELPDTTLTPASRSKEGPNVKTNLLASHGGASVNAIEEDGPSRAKRLGEVATSRCFIYQSLQVACMVLPWRRRKG

SEQ ID NO: 112124 - protein, 190 aa, Glycine max
  Coding DNA Sequence Number=SeqID_20439
MVSIWDLARVEVSMEPIASLAQYYDQPLRCFIFGDFQLSPMVEEFEEILGCPLGGRKPYLFSGQVENGVVGIPRKYLERSTFFSPIIKESPVVAMLADLYDTFDRRCEESNARIVCCTPALYVGLVSHLFLQEGRPVYPLQGYRSCVEKGKANWDQLLASMGRRLLIGSLARRKEESGFYLHAKDVQMFP

SEQ ID NO: 112125 - protein, 97 aa, Glycine max
  Coding DNA Sequence Number=SeqID_20440
MVVSFFLTHLLLEVASPLSLPFSIPLPLIFQEAKESIDEEDPRPTSSNGAYIMWYQEHLHLGPNDVPQSQTVFLEEDVSYMMPMMKLSCGAEFWLDL

SEQ ID NO: 112126 - protein, 95 aa, Glycine max
  Coding DNA Sequence Number=SeqID_20441
MRAGNSDIYGFLEPQSTQRSGQSQFETESYVKSWMQSSKRDVYLRAYLNGALKGLDDAPQSKSKAPARWIVVKCNRQKGSTECDYYVMHWMSTII

SEQ ID NO: 112127 - protein, 229 aa, Glycine max
  Coding DNA Sequence Number=SeqID_20442
VRAKGEESSEEIYPQEEGQPLVVKEKCKEVSISSKRLAKKETHFTIKTNIKETFPLRQPPHFLFCRKTLASIATPLGLEFIPQVKKLLDEGLVHKSLNPCALLVPEIVIIRHQVPKIGGMMNVLSGATLFCKIIHAPNIFMIHVHRDSLGSDQGVPTDPKRIKVIPDWPTPPSVEGRSPEYEEPRDLRSNPFQGGGDDAILPPKVLDRRLQEDWARDTKEGPRVLMNLR

SEQ ID NO: 112128 - protein, 50 aa, Glycine max
  Coding DNA Sequence Number=SeqID_20443
MKEGRIPKELACYFILLIKHMSLITSKPNDASSVPNTPLDARGSSGASNP

SEQ ID NO: 112129 - protein, 168 aa, Glycine max
  Coding DNA Sequence Number=SeqID_20444
LSEELRDYYEGRHRSHLRPHSHRREKERKPQEANINLSYFHGKDNVEANLDWEIRVEQQLKKKSTSKSYGSHSYPKKDQGQGILGVTPSKPKDDKGKAIEKQAPKASYYFTSSSESEEAKWEESSEEIYPQEEGQPLVVKEKCKEALASIATPLGLEFIPQVKKLLDE

SEQ ID NO: 112130 - protein, 178 aa, Glycine max
  Coding DNA Sequence Number=SeqID_20445
  Subcellular localization annotation: CTP_CleavageSite=41; ConfidenceScore=5.19e-01
MAESSKKRKGSSSFTAATGHRRDGPSEAPTTPIHPSLSSPRSSTLFSSDDQHLQYLSQFSSRIILDPKYLDIDFFNDETFDCYQVFQNFGLVDFMSLKLPYYAELVKVFYSNLKIQDGIISSEVHGISMIIDQSLFFSLTKLPSQGAPFEGTIVDDWKFDYSSHDACRMVCNDQAEMT

SEQ ID NO: 112131 - protein, 67 aa, Glycine max
  Coding DNA Sequence Number=SeqID_20446
MKVQVDDSWLWHRRFGHFNTHASKLLHEKNMMRDLPSIKENNESMESERSIGAYTYGRLWTNEDAIT

SEQ ID NO: 112132 - protein, 63 aa, Glycine max
  Coding DNA Sequence Number=SeqID_20447
MELPDSEKRVERQCKEARTVPVGQAKQAFQLALLLAVVLKSMGNGQGFSFRSGGFHPPCHVHP

SEQ ID NO: 112133 - protein, 168 aa, Glycine max
  Coding DNA Sequence Number=SeqID_20448
SGGPDDYAEIPYGIRSLLSSRGGGPDDKQRPSFQVSPNYPELRHVTCTLVSSRGGGPDDTRRYLTVIRTLLSSRGGGPDDKQRPKTKFGHSAPLYHPEAAGPMIRGDTLRLSAPFCHPEAAGPMTSRDQVWSFCTLVSSRGGGPDDTRRYLTVIRTHLSSRGGGPDDK

SEQ ID NO: 112134 - protein, 201 aa, Glycine max
  Coding DNA Sequence Number=SeqID_20449
MKDKRDEEEKLENQNKKKDSKASSSKAKGKEKEEKDSSKKIGTSLSITIHLELEVIPQVKELLDEGLVRKSLNPCALLIHKIGIMRHQIPMIGGMMNVSSGATLFCKITHALNIFMICVHRDSLGRLDLCASMRSFNGDFPPWRCSGRQRRRGEKRLHPLRNKPWKNELHHQDEPWIRSLERMLQWRKRKRERKREGGARN

SEQ ID NO: 112135 - protein, 131 aa, Glycine max
  Coding DNA Sequence Number=SeqID_20450
  Subcellular localization annotation: CTP_CleavageSite=20; ConfidenceScore=5.25e-01
MKLTKFGSSSVADGVDVKSYASKVKSTGISEPLSASEVRLNPSAFVQSVPSSEKEWGKVWEVFIPQSKNKQGQRYGFVRFKGVEDAGWLERQLDNKIYIEGKKLFVNKPKFQRRGKREVGRTGGEVVRVRK

SEQ ID NO: 112136 - protein, 363 aa, Glycine max
  Coding DNA Sequence Number=SeqID_20451
  Homolog annotation: Hit_ID=Q2HW90; Match level="QueryCoverage=26%, HitCoverage=19%, E-value=3e-10, Identity=41%"; Hit description =Putative uncharacterized protein
IDAFLAYHHSKESPVVAVLADLFDTFDRRIDWDQLLAGIGGRTRSWFPRWKEGKEGVLFSCGRYPNIPLIGTRGYINYNPALAIRQLGYPMRGAPTEESMSPFLVRDFGRTNSKTIQRIHKAWETPLRKDQELRGIRNGIIARQVKVVSEESFEAPEEDEEVQALKSELGKAKLAKEKFKLAATHIRKECAGLREENAITARALEQETKRARKEEYGRNKFRGALWGSNSELKLRREERDQSRAHSMVLKEELVACSRSKRSLSQRLCETETNMLAIIAKYQEELGLATTHEHRIADEYAQVYAEKEARGRVIDSLHQEATMWMDRFALTLNGSQELPRLLAKAKAMADTYSAPEEIHGLLGY

SEQ ID NO: 112137 - protein, 251 aa, Glycine max
  Coding DNA Sequence Number=SeqID_20452
  Homolog annotation: Hit_ID=A4WC56; Match level="QueryCoverage=32%, HitCoverage=51%, E-value=2e-21, Identity=61%"; Hit description =Putative uncharacterized protein
SGITGHRIYLFCEVISVTGIYSAQSASAVPPVQLLTGWCVTAKAPPDISAGKCSGHAARRVPFAIQAAQLLGRAIGAGLFAITPAGERGMCCKAIKLGNARVFPEFDLLADYFARRRGLLVVEIPALEELDQVELFSKSIRTAAHRGHVDQIIQESLADGVIDEKEAADIMRYHRKHLQARDAEIKLIDTVDLEGGPVGKPVVPAALMNRPTRGERRFAYWALAECILAYYVGTDEGVSEVLHVAGEKRLH

SEQ ID NO: 112138 - protein, 175 aa, Glycine max
  Coding DNA Sequence Number=SeqID_20453
  Gene Ontology: Mol. function=carbohydrate transmembrane transporter activity; Cellular component=integral to membrane; Biological process=carbohydrate transport
  Homolog annotation: Hit_ID=A4WAE6; Match level="QueryCoverage=98%, HitCoverage=43%, E-value=2e-59, Identity=66%"; Hit description =Probable sugar efflux transporter
MLLTRNIERRLLLAILFILFVASHLLSAVAWDFTSLVLSRIGIALAHAVFWSITASLAIRVAPAGKKTQALSMLATGTALAMVLGVPIGRIVGQYLGWRTTFGMIGLSALVLLIMLVRILPRLPSEHTGSLSSVPMLFRRPALVAMYILVTVVVTAHYTAYSYIEPFMQVVASAD

SEQ ID NO: 112139 - protein, 156 aa, Glycine max
  Coding DNA Sequence Number=SeqID_20454
  Gene Ontology: Mol. function=hydrolase activity; Cellular component =cytoplasm; Biological process=metabolic process
  Homolog annotation: Hit_ID=Q0T2W2; Match level="QueryCoverage=100%, HitCoverage=49%, E-value=7e-72, Identity=83%"; Hit description =Pyrimidine-specific ribonucleoside hydrolase rihB
  Pfam annotation: Domain name=IU_nuc_hydro; Domain location=3-156; Score=58.1; E_value=3e-14; Accession=PF01156.10; Description=Inosine- uridine preferring nucleoside hydrolase
MTARKIILDCDPGHDDAIAIMLAAKHPSIELLGISIVAGNQILDKTLVNGLNVCQTLNIDTPVYAGMPQPIMRQQIVADNIHGETGLDGPVFDPLTRKAETKHAVNFIIDTLMNSDGDITLVPVGPLTNIAVAMRMQPKIIPKIREIVLMGGAYGT

SEQ ID NO: 112140 - protein, 216 aa, Glycine max
  Coding DNA Sequence Number=SeqID_20455
  Gene Ontology: Mol. function=receptor activity; Biological process =regulation of transcription
  Homolog annotation: Hit_ID=A9MK46; Match level="QueryCoverage=95%, HitCoverage=89%, E-value=9e-76, Identity=67%"; Hit description =Putative uncharacterized protein
  Pfam annotation: Domain name=cNMP_binding; Domain location=19-109; Score=66.4; E_value=9.8e-17; Accession=PF00027.20; Description =Cyclic nucleotide-binding domain
MASGYCDKFSADVIPHTHLFHILAGDYIVREGSLPAYMFYLARGRTKLYVTLANGRISLVDFFNAPCFIGEIEVLDETHASRAVQAIEACWCLALPVKTCRTLLLNDAQFLRHACLGLVKKNFRNIVTSTRNQAFPLVNRLAAFILLTQHDDVYKEKHTQVAEYLGVTYRHLLYVFEQFSAGGVLRKQQGGYAIGNRAALTALAEEMEPGAALPGH

SEQ ID NO: 112141 - protein, 230 aa, Glycine max
  Coding DNA Sequence Number=SeqID_20456
MQPISLQTRYRSANENTIALWAKNAGIGNIHEENYYDPVKLALAAGIKPSVSLPVLRLIDELQRLTQADPLADTLPAQGLHFTFLPLTLPLYNINERLPAKVAQLTTIWQEFAAKKIVIRDLRLVALPSQLLLAGIPDTPAIAMRQSFCDKILDSDWKNELLMRHGNSPLPAPFWHSTLLRYSAEFLPGILRQFFYERQDINFAEVAGELMLAKTNYNWTKCYPLLPARV

SEQ ID NO: 112142 - protein, 431 aa, Glycine max
  Coding DNA Sequence Number=SeqID_20457
  Homolog annotation: Hit_ID=Q7N990; Match level="QueryCoverage=59%, HitCoverage=84%, E-value=8e-89, Identity=62%"; Hit description =Similar to unknown protein of Photorhabdus
  Pfam annotation: Domain name=DUF1814; Domain location=175-410; Score =110.2; E_value=6.5e-30; Accession=PF08843.2; Description=Domain of unknown function (DUF1814)
MTAIERLNAFDRQGRYVFAVRDLAKVFYDDSDKAFNAGLNRLVKDGILQRASRGVYVYAYARSKDAYTLERIVQTLRRGEYSYLSLESALSAYGVISQIPMGRLTVMTTGRSEEHITPYGVIEFTHTKRSPEQILQDTILGESPLRLATKKAALRDLRRAMASAQLEGMRNVVEKELLHYDILYCLDKAGLLQNLTFQGGTSLRLCYDGNRFSEDLDFAGGINFSGADLKNMKVCIEDYLGTRYGLEVTVKEPAELRRQPGYEEIRVDKWQVSVTTAPEKRDMPKQPIKVEVANIPAYSRKPLPLSRNYPVLPDGYSDTLVMCESLDEIMSDKLISLVATTKYLRYRDVWDLPWLMQQGAAYDVGWIRQKIEDYRIPDYEKLLKQRLAGIENIVKDGRFYNEMRRFIPQQENDQMTPSECNSDSWPGVQRR

SEQ ID NO: 112143 - protein, 779 aa, Glycine max
  Coding DNA Sequence Number=SeqID_20458
  Gene Ontology: Mol. function=nucleobase transmembrane transporter activity; Cellular component=membrane; Biological process=nucleobase, nucleoside, nucleotide and nucleic acid transport
  Homolog annotation: Hit_ID=A6T7Z8; Match level="QueryCoverage=55%, HitCoverage=94%, E-value=1e-170, Identity=69%"; Hit description =Putative allantoin permease
  Pfam annotation: Domain name=DEAD; Domain location=530-666; Score =21.4; E_value=1.1e-06; Accession=PF00270.20; Description=DEADDEAH box helicase
  Pfam annotation: Domain name=Transp_cyt_pur; Domain location=26-448; Score=107.4; E_value=4.5e-29; Accession=PF02133.6; Description =Permease for cytosinepurines, uracil, thiamine, allantoin
  Pfam module annotation: Pfam domain module=DEAD::Transp_cyt_pur; Domain location=530-666::26-448
MSAQIPAADYSGAEKQRLSETRSIDYIPLSERHGHPFSQFTLWFGGNLQITAIVTGALAVVLGGDVVWSIVGLLVGQIVGAAIMSLHAIQGPRLGLPQMITSRMQFGVFGAVIPLVLVCIMYVGFSASGTVLAGQALAKLVNVSNAAGMIIFSAIIIVIAVLGYRVIHKLGKVASVIGVLAFVYLFITLLSSHDLAAVWQNQHFSVASFLLAVSLSSSWQIAFCPYVSDYSRYLPVDVSAKKLFSSVFFGTVLGTQASMTLGVIVAAIAGKAFSGNEVGYIVGLGSSATMAMVIYFAICFGKITFTTLNAYGSFISLTTIVSGFRQQTAISRGGRILFVVLMVTLSCIIALLSEPAFLKSFTHFLLFLLAFFVPWSAISLTDFYLITQGKVDVPALSQPDGRYGRWNWAGIIIYFLGVLVQLPFIDNPLHHGSLTWIFAGNDVSWIIGWFVTALLWLAALLRRVFSRRPHRQYPDNAVNAAARYTADRPFENAGVMDASLSAFTVHPGHATVVSPHFPGGDPRTTGSLARHRQRTTLPALAADVQRNLALPLAGVAAQRAELGEADITLEVGMRSGDTLSAERAKLQRRPPDILITTPESLFLLLTSKARETLRGISTVIIDEVHAVAGSKRGAHLALSLERLDVLLAQPAQRIGLSATVRPPEAVAAFLGGAEDMTDIQQRPDARAAQESSLAAGSIWPHIEAGILDEVLRHRATLVFTNSRGLAEKLTARLNELYARRSAPEHGVTEPALAYGSFSGGTEKRATPAEAYIARSHHGS

SEQ ID NO: 112144 - protein, 519 aa, Glycine max
  Coding DNA Sequence Number=SeqID_20459
  Gene Ontology: Mol. function=nucleoside-triphosphatase activity; Cellular component=intracellular; Biological process=intein-mediated protein splicing
  Homolog annotation: Hit_ID=A9HPQ4; Match level="QueryCoverage=98%, HitCoverage=38%, E-value=1e-159, Identity=55%"; Hit description =Putative ATP-dependent helicase lhr
  Pfam annotation: Domain name=DEAD_assoc; Domain location=433-519; Score=-37.7; E_value=0.00017; Accession=PF08494.2; Description=DEADH associated
SKARETLRGISTVIIDEVHAVAGSKRGAHLALSLERLDVLLAQPAQRIGLSATVRPPEAVAAFLGGAGATRIVNPPAQRPLQLTITVPVEDMTDIQQRPDARAAQESSLAAGSIWPHIEAGILDEVLRHRATLVFTNSRGLAEKLTARLNELYARRATPEHGVTEPAFAYGSFSGGTEKRATPAEAYIARSHHGSVSKEQRLEIENALKAGELRCVVATSSRGTAFGGQRAAAYWPGRSPGGGYARADPFKTLPRNAFDAVLDMLSGCYPSDEFANLRPRIIWNRQQQTLSGRPGAQHLAVTSGGTIPDRGMFSVMLPEGEEQSGARRVGELDEEMVYESRINDIITLGATSWRIQQITHDQVVVVPAPGRSARLPFWHGDSLGRSATLGEAIGRYLRHAASGVLPGSDNLDANARHSIRALIDEQIAATGLVPDDRNLLIERCRDETGDWRVILHSPYGQRVHAPWALAIAERIGRQMGLDPAVVASDDGIVARFPDSEGRVPALNCFCLRRTNSSDR

SEQ ID NO: 112145 - protein, 215 aa, Glycine max
  Coding DNA Sequence Number=SeqID_20460
  Subcellular localization annotation: CTP_CleavageSite=50; ConfidenceScore=5.67e-01
MIDAACAYIRMIPNRFSTTAQRANSITISTSKVTSGKAASRPPRRSLRFAASEISTTIKAVRTNDRDDLFQILTSRLRRSLCVHQMFAYMALEQFAHQAINSAAHCRNLLQYLEALLTRFDGGFQRRRLTFYASNAVYNSLYGAFGPPATDYTDIDIQIPGGWIWPQNRRASISACLIRKPAGAKDADAPVGKPKAGASFRLTIAKRQSGRFRRA

SEQ ID NO: 112146 - protein, 476 aa, Glycine max
  Coding DNA Sequence Number=SeqID_20461
  Gene Ontology: Mol. function=transporter activity; Cellular component= integral to membrane; Biological process=transport
  Homolog annotation: Hit_ID=A4WA69; Match level="QueryCoverage=55%, HitCoverage=89%, E-value=1e-122, Identity=80%"; Hit description =Substrate-binding region of ABC-type glycine betaine transport system precursor
  Pfam annotation: Domain name=OpuAC; Domain location=32-304; Score =272.5; E_value=8.5e-79; Accession=PF04069.3; Description=Substrate binding domain of ABC-type glycine betaine transport system
MATANLLARWVKRTALVLTATLTLSHSALAATPIVMATKSFTEQHILSAMTVMWLQKKGFQVIPKTNIATTIGRNAMINKQIDMTWEYTGTSLIIFNHINKPMSSEEAYKTVKQLDAKLGLVWLNPAPMNNTYAFAMQRQRADAEGISTMSQLVAKLEQVRNTDPDHNWKLGLDLEFAGRSDGLKPLQKAYNMPLDRPQIRQMDPGLVYNAVRDGFVDAGLIYTTDGRVKGFDLKVLEDDKHFFPSYNVTPVVRQDVLESHPGLEAALNALSPLITDEAITEMNKRVDIDHQSPQQVAPHLAGAGGGGFCHPRRRAAGHSDCPLQMAGNTGAGHRHHRADHPDHCAVWPDDSAVFTDRSGDWCPAGDYRGVSLFTAADSGRGIGMTFWQRLRWVEIPMALPVIFGGIRTAVVMNVGVMAIAAVIGAGGLGLQLLDGISGSDVRMLIAGALMICLLAIILDWLLHRLQSALTPKGIR

SEQ ID NO: 112147 - protein, 211 aa, Glycine max
  Coding DNA Sequence Number=SeqID_20462
  Gene Ontology: Mol. function=oxidoreductase activity; Cellular component=cytoplasm; Biological process=metabolic process
  Homolog annotation: Hit_ID=A4WA85; Match level="QueryCoverage=72%, HitCoverage=61%, E-value=4e-68, Identity=83%"; Hit description=Short- chain dehydrogenase/reductase SDR
  Pfam annotation: Domain name=KH_2; Domain location=50-100; Score=4.4; E_value=0.099; Accession=PF07650.8; Description=KH domain
  Pfam annotation: Domain name=KR; Domain location=39-202; Score=-54.9; E_value=0.00038; Accession=PF08659.1; Description=KR domain
  Pfam annotation: Domain name=adh_short; Domain location=35-206; Score= 87.6; E_value=4.1e-23; Accession=PF00106.16; Description=short chain dehydrogenase
  Pfam module annotation: Pfam domain module=KH_2::KR::adh_short; Domain location=50-100::39-202::35-206
MVQGCTANVQERFCNTPLTLFMSAAAGLMLRNSEMIIFVTGATAGFGQSITRRFIATGHKVIASGRRAERLQELKQELGDNLYTVQLDVRNRAAIEEAIAALPAEWRDIDVLVNNAGLALGVEPAHKASVEDWENMIDTNNKGLVYMTRAVLPAMVERNVGHIVNIGSIAGSWPYAGGNVYGATKAFHVNINTLEIMPVTQTTAGLKVFKG

SEQ ID NO: 112148 - protein, 390 aa, Glycine max
  Coding DNA Sequence Number=SeqID_20463
  Gene Ontology: Mol. function=beta-lactamase activity; Cellular component=outer membrane-bounded periplasmic space; Biological process=beta-lactam antibiotic catabolic process
  Homolog annotation: Hit_ID=A7MK62; Match level="QueryCoverage=90%, HitCoverage=93%, E-value=1e-129, Identity=65%"; Hit description =Putative uncharacterized protein
  Pfam annotation: Domain name=Beta-lactamase; Domain location=38-387; Score=305.7; E_value=8.6e-89; Accession=PF00144.15; Description=Beta- lactamase
MRIVGKPGRGKGIFMFSWARLSALALLVSGSALATTSPDSIIKPLMQQYQIPGMAVAILHDGKTEFYNYGVASKESGQPINEQTLFEIGSLSKTFTATLASYAAQQNKLNFSDAASQWLPELKGSAFDRVSLLNLATHTSGTPLFVPDDVTNTRELMRWYKQWQPEAQPGTVRVYSNLGIGMLGMIAAKSLHQPFISAMEKQLLPAMGMTHSYVQVPASQMGRYAQGYNKQDRPVRVTPGPLDAESYGLKSTSADLIRWLTIQLQQQPVAPAWQQAVAATHQGYYHTEAAFTQAMMWEYYPLPVTTQQLGDGNSGARIMKGMKATRITPPQAAPQQAWYNKTGSTNGFATYAVFIPSQRVALIMLANKWFPNDDRVVAAEKIISNIGKGE

SEQ ID NO: 112149 - protein, 640 aa, Glycine max
  Coding DNA Sequence Number=SeqID_20464
  Gene Ontology: Mol. function=transporter activity; Cellular component= membrane; Biological process=transport
  Homolog annotation: Hit_ID=A7FHV0; Match level="QueryCoverage=49%, HitCoverage=100%, E-value=1e-141, Identity=80%"; Hit description =Ribose ABC transporter, periplasmic ribose-binding protein
  Pfam annotation: Domain name=BPD_transp_2; Domain location=64-311; Score=149.0; E_value=1.3e-41; Accession=PF02653.7; Description =Branched-chain amino acid transport system  permease component
  Pfam annotation: Domain name=Peripla_BP_1; Domain location=351-632; Score=-21.3; E_value=0.00021; Accession=PF00532.12; Description =Periplasmic binding proteins and sugar
  Pfam module annotation: Pfam domain module=BPD_transp_2::Peripla_BP _1; Domain location=64-311::351-632
  Subcellular localization annotation: CTP_CleavageSite=20; ConfidenceScore=5.03e-01
MKNGANGMTDRTQTLDSAPRVAKPASGKRLNLARLLLEGRAFIALLVIIATFSLLSPNYFTGANFLTMASHVAIFGLPAIGMLLVILNGGIDLSVGSTLGLAGVMAGFMMQGINLEALGVVLYLPVWAVAILTLVLGALVGLVNGVLIAIFRVPAFVATLGTMYVARGIALLITNGLTYNKLSGSEALGNTGFDWLGFNRLFNIPGGNERAADLSGVPVKRIKISVYVLSGICAAMAGLVLSSQLTSAGPTAGTTYELTAIAAVVIGGAALTGGRGNVRGTLLGAFVIGFLSDGLVIIGVSAYWQTVSLAPNRKTNLYPNNNGAPMFTKRLFIAAAAMAISTFALPSWANNGLMTIIVNDPSNPYWLTEGQVAQKAAEKLGYSAKVSAHKGDTNTESQLIDTAITNKSKAIILDPANADGSIGSVKKAIAANIPVFVINAELNQSGLAKAQLVSNNAQGAAVGAMEWVKQVGDSASYVELVGPPSDNNAATRANGFDTVLSQYPTLKKVGQEVANWDRTQGFNKMQSLLQANPNIKGVISGNDEMALGAIAALKEAGKLSQVKVGGFDGSPDAVDAVKAGTLAYTVMQPVAQFAQKAVEQADTFLKTGKTGVAQEKQLFDCILITKDNAGDFVSPFVLKQ

SEQ ID NO: 112150 - protein, 416 aa, Glycine max
  Coding DNA Sequence Number=SeqID_20465
  Gene Ontology: Mol. function=nucleoside:sodium symporter activity; Cellular component=integral to membrane; Biological process=transport
  Homolog annotation: Hit_ID=P33021; Match level="QueryCoverage=99%, HitCoverage=99%, E-value=1e-158, Identity=70%"; Hit description =Nucleoside permease nupX
  Pfam annotation: Domain name=Gate; Domain location=98-199; Score =47.4; E_value=5.1e-11; Accession=PF07670.5; Description=Nucleoside recognition
  Pfam annotation: Domain name=Nucleos_tra2_C; Domain location=202-413; Score=321.9; E_value=1.2e-93; Accession=PF07662.4; Description=Na+ dependent nucleoside transporter
  Pfam annotation: Domain name=Nucleos_tra2_N; Domain location=1-82; Score=102.6; E_value=1.2e-27; Accession=PF01773.11; Description=Na+ dependent nucleoside transporter
  Pfam module annotation: Pfam domain module=Gate::Nucleos_tra2 _C::Nucleos_tra2_N; Domain location=98-199::202-413::1-82
MDIMRSVLGMVVLLAIAFLLSVNKKHISLRTTGAALLIQIALGGAILYLPPGKWLAEKVASGVHQALAYSDAGSAFLFGALAGPQMDKVFNGAGFVFAFHVLPAIIFITALVSVLYYIGVMGAIIRLLGGIFQRALNISKIESFVAVTTIFLGQNEIPAIVKPFVNRLNRNELFTAICSGMASIAGSTMLGYAGLGVPIEYLLAASLMAIPGGILFARLLSPATEASQVTFTNLSFSDTPARSLIEAAASGAITGMKIAAGLATVVMAFVGIIAMLNGILGGIGGWFGHGDISLQGILGFALAPLAWLMGVAWHDAALAGSLIGQKLVVNEFVAYISFSPYLHQAGALDGKTIAIVSFALCGFANFGSIGVVVGAFSAVAPERTPEIARLGLRALIAATLSNLMSATIAGFFIGLG

SEQ ID NO: 112151 - protein, 206 aa, Glycine max
  Coding DNA Sequence Number=SeqID_20466
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=38%, HitCoverage=10%, E-value=3e-33, Identity=68%"; Hit description=DNA -directed RNA polymerase subunit beta
  Pfam annotation: Domain name=RNA_pol_Rpb2_3; Domain location=1-45; Score=48.8; E_value=1.8e-11; Accession=PF04565.7; Description=RNA polymerase Rpb2, domain 3
LTGRTASFRIRDIHPSHYGRICPIDTSEGINVGLIGSLAIHARIGNSLALNRDIQEEQTVPARYRQEFLTIAWEQVHLRIGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYP

SEQ ID NO: 112152 - protein, 41 aa, Glycine max
  Coding DNA Sequence Number=SeqID_20467
  Homolog annotation: Hit_ID=Q2HW89; Match level="QueryCoverage=80%, HitCoverage=3%, E-value=2e-07, Identity=78%"; Hit description =Integrase, catalytic region; Ribonuclease H
VDSRGSPVKRAFSGGALMLANMDDEELPSPVNSDVVKRYYA

SEQ ID NO: 112153 - protein, 27 aa, Glycine max
  Coding DNA Sequence Number=SeqID_20468
TIHWGSRSPFEGSYPRNRMELFFTTGP

SEQ ID NO: 112154 - protein, 133 aa, Glycine max
  Coding DNA Sequence Number=SeqID_20469
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=63%, HitCoverage=70%, E-value=2e-24, Identity=69%"; Hit description=LacZ protein
MMAKCFDINFQDSCKIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRAVLLPLRTT

SEQ ID NO: 112155 - protein, 48 aa, Glycine max
  Coding DNA Sequence Number=SeqID_20470
MDKILKEKEKEAMKILQLKSKQMMNFRENGKLLEIIPLTTSFGDISKG

SEQ ID NO: 112156 - protein, 146 aa, Glycine max
  Coding DNA Sequence Number=SeqID_20471
  Homolog annotation: Hit_ID=A7ZH17; Match level="QueryCoverage=21%, HitCoverage=81%, E-value=6e-08, Identity=83%"; Hit description =Putative uncharacterized protein
MVTFHHGDVVEGKGDQAYRYRRPRGGARCINESANARGEAVCVLGASGVYTGLLCWALMRVSVKCFMWQEKKGCTGASAEYVIQDIFRFPRSLTRYARSFDCGERKWLTNGRRFLEDARKILNREVRGPRQSRFHRLRSPDKHHEI

SEQ ID NO: 112157 - protein, 79 aa, Glycine max
  Coding DNA Sequence Number=SeqID_20472
MIIEESIHVAFDETNPIMPRKDTLDDISDSLEGMHIHGEENKGKGKGNDEDFQIDETKTSTDLPREWRTSRYHHLEHHR

SEQ ID NO: 112158 - protein, 149 aa, Glycine max
  Coding DNA Sequence Number=SeqID_20473
  Subcellular localization annotation: CTP_CleavageSite=51; ConfidenceScore=5.04e-01
HVLALRGLHALTLGTSYPHRQRTTRPRLERTTRPQHQRAAHPHLQRTISPRLERATRPHLGGLHVLALRGLHVLTIRGLHALTSRGLHVLALRGLHALTLGTTYPHRQRTTRPRLERTTRPHHQRAARPHLQRTISPRLERATRPHLGY

SEQ ID NO: 112159 - protein, 82 aa, Glycine max
  Coding DNA Sequence Number=SeqID_20474
MGGGMNEKVKVILWMNALLEPKLLNPRKTMNCWQANPITSLESEKEAKFIIAKSSSWAKLSSWAKRISSAKRSSSALSAKEI

SEQ ID NO: 112160 - protein, 48 aa, Glycine max
  Coding DNA Sequence Number=SeqID_20475
MLMHNPPTWALRNIPPEGGCFWRKQPCSPGRAELAWASWAATTSPILL

SEQ ID NO: 112161 - protein, 99 aa, Glycine max
  Coding DNA Sequence Number=SeqID_20476
MSLHSSSSVNGEGSTPKDPLYKILDELRSLKLWKEKQERKEKVVMTLARVLSEELSDYYRGCHSSHTKHHSKEEKRIEGLKRLTLASHFSMEKIMLRPT

SEQ ID NO: 112162 - protein, 156 aa, Glycine max
  Coding DNA Sequence Number=SeqID_20477
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MRDSRVRLPRKENARSRHQRLFEENVGKTGKVWPTNFNRERFGSCIYAWGSPGDPLVLERPPPRWSSNSPYSESYYNSLAVVLQRRDWENPGVTQLNRLAAHPPFASWRNSEEARTDRPSQQLRSLNGEWDAPCSGALSARVWWLRAAWTATLAAL

SEQ ID NO: 112163 - protein, 151 aa, Glycine max
  Coding DNA Sequence Number=SeqID_20478
MAYRKRKAPSTPTQARFDRSRFTSQEAWERYTDIVVPRKLLPERNVVVYYTEFDEFKEELERCHWDEEFTEFMDGNIDVAIDTLNTFLKTPVVVEEGETLCAYSRFALLRPNPQDLAAKLCIPGRGFELNADGQPLKILRKNMTTLAQTWS

SEQ ID NO: 112164 - protein, 117 aa, Glycine max
  Coding DNA Sequence Number=SeqID_20479
  Gene Ontology: Mol. function=nucleic acid binding; Cellular component= cytoplasm; Biological process=mRNA metabolic process
  Homolog annotation: Hit_ID=A5C9H4; Match level="QueryCoverage=55%, HitCoverage=9%, E-value=4e-15, Identity=67%"; Hit description =Putative uncharacterized protein
  Pfam annotation: Domain name=RRM_1; Domain location=21-97; Score =11.6; E_value=0.012; Accession=PF00076.13; Description=RNA recognition motif. (a.k.a. RRM, RB
MKQRWFIVDCSNLLVLHMATIFITRIIINSSTRRSHINGLWWMMELMATACKSTMVMIESNGHSKGYGFVAFSTLEEENKALNEMNGKMIGHKPLYLAVAQRKEERKALLQVKILMP

SEQ ID NO: 112165 - protein, 62 aa, Glycine max
  Coding DNA Sequence Number=SeqID_20480
MAGVITYPSAGGQHGAHGCIFQGRKMHGVATNVYLRKTSKKSERVFPSLLRILNCDEEIRPT

SEQ ID NO: 112166 - protein, 74 aa, Glycine max
  Coding DNA Sequence Number=SeqID_20481
MGKAVASGGSNPARLGELGGNHLPYFAINRGGRQEGRAEALPKRFRNVFREESRKDFNRSSTFSFVFIVLRSQR

SEQ ID NO: 112167 - protein, 88 aa, Glycine max
  Coding DNA Sequence Number=SeqID_20482
  Gene Ontology: Biological process=transposition, DNA-mediated
  Homolog annotation: Hit_ID=Q1J7G7; Match level="QueryCoverage=34%, HitCoverage=42%, E-value=2e-10, Identity=100%"; Hit description =Transposase
GHQDLFILRSDLPSQWLLFLSAVPPVQLLTGWCVTAKAPPDISAGKCSGPICAAIGAGLFAITPAGERGMCCKAIKLGNARVFPVTTL

SEQ ID NO: 112168 - protein, 165 aa, Glycine max
  Coding DNA Sequence Number=SeqID_20483
MPISPCGSISWDRAHKTHSGPGEAQQGLGVSTSGYGPLSVLPGARPPQQGIAPARHSVDPEKSNRVMGFPALIMGLCQFYRVPVAPSKVIRPPTNLAFNNKYCAPCRRRARHHNSLGMAGSGQQTHRRHLQSPSAHLQKLERCLRPVVDQQAIKSKAKVSKVLGP

SEQ ID NO: 112169 - protein, 144 aa, Glycine max
  Coding DNA Sequence Number=SeqID_20484
  Subcellular localization annotation: CTP_CleavageSite=43; ConfidenceScore=5.11e-01
GLHVLTFRGLHVLTFGGLHVLTLKRVAHPCLQRVTSPHLQRTTCAHLKRVTRLRHQRATRPQTLEDYTSSPSECYTSSPSEGYTSSNFRGLHVLTFRVLHVLTFRVFHVLTFRGLHAIAFRGLRVLTFSGLHIHALRGFKVLCP

SEQ ID NO: 112170 - protein, 88 aa, Glycine max
  Coding DNA Sequence Number=SeqID_20485
  Gene Ontology: Biological process=transposition, DNA-mediated
  Homolog annotation: Hit_ID=Q1J7G7; Match level="QueryCoverage=34%, HitCoverage=42%, E-value=2e-10, Identity=100%"; Hit description =Transposase
MVKVGTSYVPINVSFSPKSWPRASRYQQGHQDLFILRSDLPSQWLLFLSAVPPVQLLTGWCVTAKAPPDISAGKCSGHAARNHHTRRA

SEQ ID NO: 112171 - protein, 93 aa, Glycine max
  Coding DNA Sequence Number=SeqID_20486
MLPALAASVCCQAADLLTVCAAAEAWIEALKASEKEILMETKIAQRELKESKLEQELEVYTKEKMLSRKVSSNEELDNWPRKRENTSSKNFIV

SEQ ID NO: 112172 - protein, 48 aa, Glycine max
  Coding DNA Sequence Number=SeqID_20487
MEAGSLSFNEVLQWRSEEGRHHPLGNKPRKKGASPPRISLDKKLEEDV

SEQ ID NO: 112173 - protein, 68 aa, Glycine max
  Coding DNA Sequence Number=SeqID_20488
VILVASTLNYLPSLEVASTLTYLPSLGSGVYPDLSSFTGSGVIQTFIACIKRSAPTQVHIIWYQSFGS

SEQ ID NO: 112174 - protein, 146 aa, Glycine max
  Coding DNA Sequence Number=SeqID_20489
  Homolog annotation: Hit_ID=A5C0V2; Match level="QueryCoverage=61%, HitCoverage=7%, E-value=8e-08, Identity=37%"; Hit description =Putative uncharacterized protein
MYFSSFALTWIFSWQYRYGKTENNKQYPPLQRHAFVKWWTQFDTSKAAPNQVKNWFQSHPEFLKPVDPETSLFLNQKSQLAAFLASSKSKESLAQNLKEVLQLLQQEEDEESSKKGAESSEDIDDQDDDPFYQNEDDCFGISLKDD

SEQ ID NO: 112175 - protein, 84 aa, Glycine max
  Coding DNA Sequence Number=SeqID_20490
MYEYPRRTRALMCKHSFQNSYGCSCFVGKREMPPKKLSTKRSRRDAAAEGPNSTPEFDSHRFQSVDDMNPHGTRADLGSSRIKP

SEQ ID NO: 112176 - protein, 169 aa, Glycine max
  Coding DNA Sequence Number=SeqID_20491
MSGFTRNSPQISASPHQLDLAPYASEPYHAQWNAPGLLRDKHTLRSSRILGEMEVDEPWIGLWLPLNYQVDMGASFLAAKFTSWLVFLVCAKGGVRHWKCGRQTLWVDLGMAFVDNWVVGKEKVCYWLSKDIVGVGGELGRTGMAVTAWVSPSSSPSSFAPVFSVVLVG

SEQ ID NO: 112177 - protein, 70 aa, Glycine max
  Coding DNA Sequence Number=SeqID_20492
MFAHSGGRLLVPWDGRGCKSSPYFAYKYGEESRSLRKGSDLLGISPSLEIAEENYFREENPSRGASVMFP

SEQ ID NO: 112178 - protein, 113 aa, Glycine max
  Coding DNA Sequence Number=SeqID_20493
MSKSCGFGMTGPLDESISCFLIRVDPWVLVPITFRGLHVLANRGLHALTFRGLHVLALRGLHALTLVTLTVERTTRPRLERTTRPHHQRAARPHLQRTTCPRLERATRPHLGY

SEQ ID NO: 112179 - protein, 246 aa, Glycine max
  Coding DNA Sequence Number=SeqID_20494
  Homolog annotation: Hit_ID=Q84VH5; Match level="QueryCoverage=100%, HitCoverage=38%, E-value=2e-81, Identity=65%"; Hit description =Envelope-like protein
MATSPKETSAPGSPTVPSSPSSTKAPSIQEQPEFHIQPIQMIPGQAPVPEKLVPKRHRGVDTEMDKKIRSIVSNILKNASVPDADEDVPTSSTPNASVPDVEKDVPTSSAPNAEVLSSSSKERSTEEDDQAAEETPAPRAPEPAPGDLIDLEEVESDEEPIANKLAPGIAERLQSRKGKTPIKRSGRIKTMAQKKSTPITPTTSRRSKVAIPSKKRKEISSSDSDDDVELDVPDIKRTKTSGKKVP

SEQ ID NO: 112180 - protein, 127 aa, Glycine max
  Coding DNA Sequence Number=SeqID_20495
MTSSGQMWSFCTLVSSRGGGPDDTQRYLTIIRTLLSSRGDGPMTAAECGHSAPLASRGEAAGPMTRGDTLRLSAPFCHPEAAGPMTAAANVVILHPSSIAADKPVDMREIYIIFRTYRSVDTDFESC

SEQ ID NO: 112181 - protein, 153 aa, Glycine max
  Coding DNA Sequence Number=SeqID_20496
MRTIPFTGTLQTVLGHNPVTESINQHPGILDRFFRRTNSETRQLEQIVDIKSNIDIGSNSRIDSLNPRHLYNLNWLSSDRTSLYKYRRIDDFHLTNGRHEIIRLISGQTGRQLLSTNRIYVDLGLIAKGVRSLTRSIVGAKAFVVLFDQRKNK

SEQ ID NO: 112182 - protein, 117 aa, Glycine max
  Coding DNA Sequence Number=SeqID_20497
VFCLALFLLGCDSLCCLNVVLLGDDLWKLERIDGDPVLRETCEDIGLRLGVRELPILFGGVLATGDGCEFMLNALWMWKTLLCTIARPPPSTTCDGVKLPAFMSVEPQSEYLWRYVA

SEQ ID NO: 112183 - protein, 117 aa, Glycine max
  Coding DNA Sequence Number=SeqID_20498
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=83%, HitCoverage=75%, E-value=3e-25, Identity=66%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSGGGVWWLRAA

SEQ ID NO: 112184 - protein, 46 aa, Glycine max
  Coding DNA Sequence Number=SeqID_20499
MDNTYTHLDMHIHGVSKGTGPPPIHLFPTYIRYEIITGTNHAYNNA

SEQ ID NO: 112185 - protein, 170 aa, Glycine max
  Coding DNA Sequence Number=SeqID_20500
  Homolog annotation: Hit_ID=A0ST23; Match level="QueryCoverage=16%, HitCoverage=57%, E-value=9e-09, Identity=96%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMKFLPKKGLHFYPVGKPVVPAALMNRPTRGERRFAYWALAECILAYYVGTDEGVSEVLHVAGEKRLH

SEQ ID NO: 112186 - protein, 219 aa, Glycine max
  Coding DNA Sequence Number=SeqID_20501
  Homolog annotation: Hit_ID=Q84VH5; Match level="QueryCoverage=97%, HitCoverage=37%, E-value=6e-96, Identity=74%"; Hit description =Envelope-like protein
MDLIKAAGLLKTVTKLGDCYESLVREFIVNIPSDITNRKSDEYQKVFVRGKCIRFSPAVINKYLGRPTEGVVDIAVSEHQIAKEITAKQVQHWPKKGKLSAGKLSVKYAILHRIGTANWVPTNHTSTVATGLGKFLIMLSQHPNILNNIDSVKKRESPLSLHYKLFEGTHVPDIVSTSGKAAASGAVSKDDLIAELKDTCKVLEATIKATQRRKWSWNG

SEQ ID NO: 112187 - protein, 118 aa, Glycine max
  Coding DNA Sequence Number=SeqID_20502
MVLAREHNKANQMYVRTETRADRRSNEESGEEKEGLDHGGEKDVVFYVPAMHGASADGAFDRDESRGMSPLAIGIGCSTCSCLGRSWKAPLELAIWVALPCKICVLKVKKNVVACVER

SEQ ID NO: 112188 - protein, 359 aa, Glycine max
  Coding DNA Sequence Number=SeqID_20503
  Homolog annotation: Hit_ID=Q6WAY3; Match level="QueryCoverage=37%, HitCoverage=6%, E-value=9e-08, Identity=30%"; Hit description =Gag/pol polyprotein
TEPVSHGPASERESPAQEFYILQSSVETRGLGRRREPVEAEQYSQQMMERGHGMYYTPATFFEYPSQMYQYPFEGHHTDTSASEHSFGGVAETQAHFSWPTMTPSQQHDGPKATPNAPFAPQWNVPGAIPDMGDILGVDLRQEFFAEAEQAEAGRQHSRRNLDRQARRWDRPWARVLGGLRVSVLDYGLGLAFRGLGLWGWVYCFGLGIRAEGGATSQKPRHPSVAKPGPFPYQNSHAVPWRYTPSNKEEEEATDISSLSAKVTNITGLSGVTLSGRVFAPPDLPIQPTNVKGKAKVVEEQDDKTPLTPNEDIPVKGLQEKRDGYGKKEVSLEEAREFLRIIQQSEFKVIEQLNKTPAR

SEQ ID NO: 112189 - protein, 125 aa, Glycine max
  Coding DNA Sequence Number=SeqID_20504
  Subcellular localization annotation: CTP_CleavageSite=87; ConfidenceScore=5.25e-01
MLPTTDLVYDGVLRCSSGLLFLSAVPPVQLLTGVVRNGKSTAGHQRWQSVAVTLRVTTTPAALNAPLQGASHSPFRLRNCWEGRSVRASSLLRQLAKGGCAARRLSWVTPGFSQSRRCKTTASEL

SEQ ID NO: 112190 - protein, 105 aa, Glycine max
  Coding DNA Sequence Number=SeqID_20505
  Gene Ontology: Biological process=transposition, DNA-mediated
  Homolog annotation: Hit_ID=Q1J7G7; Match level="QueryCoverage=31%, HitCoverage=47%, E-value=1e-11, Identity=96%"; Hit description =Transposase
TPGFIYSAEVIFRPQVLQWLLFLSAVPPVQLLTGWCVTAKAPPDISAGKCSGHAARRVPFAIQAAQLLGRAIGAGLFAITPAGERGMCCKAIKLGNARVFPVTTL

SEQ ID NO: 112191 - protein, 92 aa, Glycine max
  Coding DNA Sequence Number=SeqID_20506
MDMRGRDCSKKGSPNPLMSNTKEPKKIWVPRKRNFLVIDNLDSMKQMSVMVPRQWLLTTNDGRKVYVPMHDSLSWWNSHFQRESKRHNNRHG

SEQ ID NO: 112192 - protein, 49 aa, Glycine max
  Coding DNA Sequence Number=SeqID_20507
MESKITKVEENGYHHQKGEDCRSKLHDVESRFIQVVLMITKMMTKSLRE

SEQ ID NO: 112193 - protein, 239 aa, Glycine max
  Coding DNA Sequence Number=SeqID_20508
  Subcellular localization annotation: CTP_CleavageSite=86; ConfidenceScore=5.42e-01
MIGPLDESISYKGGPLGTSTYRLQRTTRPRLQRVACPCLQRNTRPYLQRVTGPRLQRTIRPPLQRTTRPRLQRTTRPRLQRTTRPRLQRATRLLLQRTTCPHHQRTTHPCHQRATRHHLQRTTRPRLERVARPRLQKDTRPRLQRTAHPRLQRATCPRLQRTACPRLQRAARPRLQRATRPPLRRATRPHIQRATRTRLQRATRSHLQRTTRPRHQRAARPRLQRTARPCLLRTTRPRL

SEQ ID NO: 112194 - protein, 222 aa, Glycine max
  Coding DNA Sequence Number=SeqID_20509
QSDACLALSNSPVSQASQADHLVQGFQSEYFQQNVCLDRASNHLDPMIHLQVILCESARQGEKDMPDSQEKDSQCSQNALLSVMPELMFRRVPVGSLMPMQGESTAKGKFNHWEGLTIYWIWSTGQLDRTGSMLRVLGSVKKAASSILRAASKGEKACFSELGHMSGKESEVYDAEPTSLTDYSAPARGDSARLANSILVRYGSCWVSPSLQNFPRSSARAV

SEQ ID NO: 112195 - protein, 168 aa, Glycine max
  Coding DNA Sequence Number=SeqID_20510
  Gene Ontology: Biological process=transposition, DNA-mediated
  Homolog annotation: Hit_ID=Q1J7G7; Match level="QueryCoverage=22%, HitCoverage=67%, E-value=9e-11, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTFEPYTESTQTKTNYIKLIDTVDLEGGPVGKPVVPAALMNRPTRGERRFAYWALAECILAYYVGTDEGVSEVLHVAGEKRLH

SEQ ID NO: 112196 - protein, 192 aa, Glycine max
  Coding DNA Sequence Number=SeqID_20511
MRGAPTEESLSPFLVRDFGSAKFQDWLAKLKIINEENFEAPEEDEEVRALKTELGKARLAKEKFKLVATDVRKECAGLREENAATAKALEQETKRARKEEHGRDKFRGALWGNNSELKLRREERDQSRVHSMVLKEELAVCSRSKRNLSQRLCETETNMLAIITKYQEELSLATAHEKRWRRVCPSVCRKEA

SEQ ID NO: 112197 - protein, 213 aa, Glycine max
  Coding DNA Sequence Number=SeqID_20512
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=40%, HitCoverage=72%, E-value=8e-24, Identity=67%"; Hit description=LacZ protein
  Subcellular localization annotation: CTP_CleavageSite=32; ConfidenceScore=5.07e-01
GGGAYGKTALPRPSHFPVKYLPGIFQEISAPFCQHSKPVYTPLAPNTQTASPRVGRFINAAGTTGFPTGKRAVSATQLIYKCSEFLSLPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 112198 - protein, 159 aa, Glycine max
  Coding DNA Sequence Number=SeqID_20513
  Homolog annotation: Hit_ID=Q5NRP4; Match level="QueryCoverage=64%, HitCoverage=6%, E-value=9e-07, Identity=32%"; Hit description =Putative gag-pol polyprotein, identical
  Pfam annotation: Domain name=zf-CCHC; Domain location=118-135; Score =19.0; E_value=0.002; Accession=PF00098.14; Description=Zinc knuckle
MKREKHASYSSHNSFKSLSEELRDYYEGRHRKSQEVNIKLSYFHGKDNVEAYLDWEIRVEQKLKIKPTLKSYGGHSYPKKDQGLGILGAAPSKPNDDKGKTIETQPPKASMQEKTSSIKCFKCLGRGHITSQCSTKKIMIMRSQDIYSSQDEATTSPFL

SEQ ID NO: 112199 - protein, 69 aa, Glycine max
  Coding DNA Sequence Number=SeqID_20514
  Homolog annotation: Hit_ID=Q5CDC4; Match level="QueryCoverage=40%, HitCoverage=21%, E-value=1e-07, Identity=100%"; Hit description =LacOPZ-alpha peptide from pUC9
MADTISCLADAVLCNILSLSQPKKLLQTAFSPSDGGTELEFVIMVIAVSCVKLLSAHNSTQHTSRKHKV

SEQ ID NO: 112200 - protein, 113 aa, Glycine max
  Coding DNA Sequence Number=SeqID_20515
  Homolog annotation: Hit_ID=UPI0000ECBAF8; Match level="QueryCoverage =36%, HitCoverage=48%, E-value=1e-16, Identity=100%"; Hit description= UPI0000ECBAF8 related cluster
  Subcellular localization annotation: CTP_CleavageSite=55; ConfidenceScore=5.19e-01
RKRKSAQYANRLSPRVGRFINAAGTTADNNFTQETAMTMITNSSSVPPSLGENAVCNNFFGMQAWHWPSFYNVVTGKTLALPNLIALQHIPLSPAGVIAKRPAPIALPNSCAA

SEQ ID NO: 112201 - protein, 206 aa, Glycine max
  Coding DNA Sequence Number=SeqID_20516
MGKAEEVQEKVKADMEAMKEKMATMMEAMMSMKKIMEANAVTIAATSTAAKVNPMPPSGLNQMNHPTLDMVGKDLGSRDGPHDVQNQNKHAFPPYGLPPNYTPPNVAYTPNEDTHEIPHHNLADFEPCLGYATERQAVGGIPLQNPLEGPQYHPQQHLLHSTTSKNPHAMAKMGKLDHLEERLKAIEEVPDFEKYKGTTCPKNHLK

SEQ ID NO: 112202 - protein, 158 aa, Glycine max
  Coding DNA Sequence Number=SeqID_20517
MASKKTKSFASSSTQARFDRSRFHSQEAWERYINIIVPRKLLPERNMVVYYIEFDEFKKELERRKWDEELTNFADGSIDVAIVRGHLVKFDEDTLNTFLKTPVILEEGENLCAYSRLALLRPDPQELAAKLCIPGRGFELNADGLPLKILRKNMTTLA

SEQ ID NO: 112203 - protein, 118 aa, Glycine max
  Coding DNA Sequence Number=SeqID_20518
  Homolog annotation: Hit_ID=A0ST23; Match level="QueryCoverage=21%, HitCoverage=51%, E-value=3e-07, Identity=100%"; Hit description =Putative reverse transcriptase
MGDKEECILFYERGGGRNWAASSSMFLNQAYRYRRPRGGARYQLLFPLVRVNFELGVIMVIAVSFGKPVVPAALMNRPTRGERRFAYWALAECILAYYVGTDEGVSEVLHVAEKKGCT

SEQ ID NO: 112204 - protein, 232 aa, Glycine max
  Coding DNA Sequence Number=SeqID_20519
  Homolog annotation: Hit_ID=A0ST23; Match level="QueryCoverage=10%, HitCoverage=51%, E-value=8e-07, Identity=100%"; Hit description =Putative reverse transcriptase
WDLLRADQRLISPKVGPGLPGINRDTRIYLFCEVISVTAVPPVQLLTGWCVTAKAPPDISAGKCSGRVPFAIQAAQLLGRAIGAGLFAITPAGERGMCCKAIKLGNARVFPEFDLKMRVRESFTHGEGCFPRSYVFLNCDEDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 112205 - protein, 53 aa, Glycine max
  Coding DNA Sequence Number=SeqID_20520
MVEEDRSTDEHNLYPPQAKSHLVEAKEREYVHLAEVAHPSSTIAHPCPYGSRR

SEQ ID NO: 112206 - protein, 287 aa, Glycine max
  Coding DNA Sequence Number=SeqID_20521
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDCPDEPDNYQMSLKGRRIPRRDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112207 - protein, 57 aa, Glycine max
  Coding DNA Sequence Number=SeqID_20522
MRGVATNVYSRKTSEKPERCALRTLSVKGSGVVFMHGEGCFPCSYVFLNCDKEIRPT

SEQ ID NO: 112208 - protein, 153 aa, Glycine max
  Coding DNA Sequence Number=SeqID_20523
MVEEVMRVYLVYFQDVEAMSSKGTSFVVQVEGTSTWVVVTENKRWYISCGSVQVEGTSTWLFKENKGWYIPCGSLLVKVFTRLKEISRTAGCLGTGCMHGLIFYLKWCLHSSFSFSITLQSDLKKQRNPLMKKIQGLTAPHGATSCGIKSLFI

SEQ ID NO: 112209 - protein, 119 aa, Glycine max
  Coding DNA Sequence Number=SeqID_20524
  Subcellular localization annotation: CTP_CleavageSite=31; ConfidenceScore=5.06e-01
MWSSAPFPEMSTSSGRDYFSLTPLSQKLGAKASLLSTAPPFPIMTWVTYGYPHLWSSRDGKFDDMRGYRMVICTFRQPGAKKPVDGQGLMSSSAPFVNQEGSKPFDAQGLTSSSAPFVI

SEQ ID NO: 112210 - protein, 113 aa, Glycine max
  Coding DNA Sequence Number=SeqID_20525
  Subcellular localization annotation: CTP_CleavageSite=32; ConfidenceScore=5.73e-01
MTLSSWQNKLNRTMATPPGSPPPHPLPPADPSASSFTVKRTRKATRLRSLATRQPGAGRLVVTVDPDTGKADGPHKKKLRTYLGIVARDKVDVTYETWKEVPTAQKDLIWEDI

SEQ ID NO: 112211 - protein, 254 aa, Glycine max
  Coding DNA Sequence Number=SeqID_20526
  Gene Ontology: Mol. function=phosphoprotein phosphatase activity
  Homolog annotation: Hit_ID=A5BZP3; Match level="QueryCoverage=57%, HitCoverage=28%, E-value=4e-16, Identity=33%"; Hit description =Putative uncharacterized protein
MLRNLTDYIIIPFLPSGTLQNFTDCALTLPFNFRYVTELHGLCYNAFLLISSMSRNFTNCLTMGAKYLEVVKRGSHPNNGWSPDEIRQSFYKISMTSSSSCSSNIQIKSGLIDGDILWMQAKHVSKHIWNGEEDRKLHMRRVVPMYQGQEEIPEEIIPLLRQSSLRVDGLPLIGPTNLDWVNLCEELLGVRPQEGELQGSKIKLSWLAHHFPQLNNHDGNLQQLERFTRAWILRFIGGVLFVDKGSSKVSLRYL

SEQ ID NO: 112212 - protein, 57 aa, Glycine max
  Coding DNA Sequence Number=SeqID_20527
MEEKVASLRSFVDKTSLRSFFEKTSLRSYSFATHTPLITKLTSLRSFLEKIHKEARD

SEQ ID NO: 112213 - protein, 128 aa, Glycine max
  Coding DNA Sequence Number=SeqID_20528
ITTHGSKLVAEGCMNENGIHGALKKGKAWRIALSNHYAWLQTRGCRMHERKRNSWGSEKGGREWIIALNNHYAWLQTVAEGCMNENGIHGALKKGKAWRIALCNHYAWLQTRRWRMHERKRNSWGSEK

SEQ ID NO: 112214 - protein, 110 aa, Glycine max
  Coding DNA Sequence Number=SeqID_20529
MSVSGCYQAFRLTDRKKNVYTDNHSGISARQRDSNVSMTDLVSVEDEVNLRFSSYRQQKNVYTDNHSGISACQRDSNVSMTDLVCAEDDVNLRVSTGLSAAIDEGCRRRR

SEQ ID NO: 112215 - protein, 58 aa, Glycine max
  Coding DNA Sequence Number=SeqID_20530
  Subcellular localization annotation: CTP_CleavageSite=55; ConfidenceScore=5.10e-01
MGVQIAIRPTWALQKIPPKGSEALPKRFRNVFREGISRRFRPFFDVLHSFFIVLRSST

SEQ ID NO: 112216 - protein, 119 aa, Glycine max
  Coding DNA Sequence Number=SeqID_20531
MHKKRSSASDLIPIDLEINATCRRRNQERIINFLQDLEAAAIPEEEPQSSEASSSFPIAEHSHLDPIEDYIMAEEPRRVTLEDYSSSNVPEFFTSIAQPKVQAQTITYPPSLIQSVDSE

SEQ ID NO: 112217 - protein, 51 aa, Glycine max
  Coding DNA Sequence Number=SeqID_20532
MPEIKRKHCYTIREVHLGLPGSSSRMRELRRSDFLFDGGYVGANNPLLSTS

SEQ ID NO: 112218 - protein, 142 aa, Glycine max
  Coding DNA Sequence Number=SeqID_20533
  Homolog annotation: Hit_ID=Q2HW90; Match level="QueryCoverage=57%, HitCoverage=16%, E-value=4e-09, Identity=43%"; Hit description =Putative uncharacterized protein
MARVEKVVKISAQELDRVKQNRNGVVGIPRKRLEERAEALANQGEWTLFIDILALLVFGIILFPNVDGLVDLVVIDTFLAYHHSKESPVIAVLADAYDTFDLRCEKSSARIVYYTSALYVWLVSHVFHHEARHACSLQGHHM

SEQ ID NO: 112219 - protein, 136 aa, Glycine max
  Coding DNA Sequence Number=SeqID_20534
MKLAKFRLKAQVEKDEGPSGEGQSPRVEKDKGPSGEERRPKWRRMKAQVEKDEDPEAETLSRQLITYQGNPCGVYPDLSSFTGSGVYPDLSSFIGSGVYPDLSSFIGSGVIQTFVACIKRSTPTQVHIIWYQSFGS

SEQ ID NO: 112220 - protein, 259 aa, Glycine max
  Coding DNA Sequence Number=SeqID_20535
  Gene Ontology: Mol. function=catalytic activity; Cellular component =extracellular region; Biological process=cell wall organization and biogenesis
  Homolog annotation: Hit_ID=A8G8Y3; Match level="QueryCoverage=32%, HitCoverage=18%, E-value=1e-35, Identity=80%"; Hit description=UDP-N- acetylmuramate precursor
VSKNELAPSLGRADEVFLFQPHHIPWQVADVADACIQPAHWSADIDTLVEMVAKAAQPGDSILVMSNGGFGGIHQKLLERLGDLPSSQPSPASGRRGRPVRTSHSALVLRYLSTMLQLPQHCASATSALRFISPLPLAGEGEGRATVRSGLTLQPARAGTGKSGGRLLAAYWRLSLSARCGSYCAAADGQRADRDSALPPPRHHPVRSADRAAAPACGTAQPAGCGGSSAYPAPGGLALRRADAAFYQSAAAGGGGLPS

SEQ ID NO: 112221 - protein, 92 aa, Glycine max
  Coding DNA Sequence Number=SeqID_20536
MNSLSEADWLSELSQPILLRASEARHTGASSKGGKCAESPPTFICGKRRKNRRKSVMKNIPDLGVVFTFEEGQQKRGSCSSVPSIEEEIRPT

SEQ ID NO: 112222 - protein, 247 aa, Glycine max
  Coding DNA Sequence Number=SeqID_20537
MELIENMAASDHAVLRDRTHIPSKRKTLNKLPTQLQAAQPSHSAIMQAGGCSICGGTQESGNQFNKDQGGSSNRPPNQGPNLYVRTAKLEDTLTQFMQVSMFNHKSTESTIKNLEIQVGQLAKQIAESSSGGFGANTEKNPKEECKVVITRRKRGLSVEDESRSNGGELEVEKEKEGDQMGERKINEVDEVENEKNHKKRKSEGDEIKESEKKKTKSELVKEKKKKVVPNSGREAPYPLVPSKKDKE

SEQ ID NO: 112223 - protein, 217 aa, Glycine max
  Coding DNA Sequence Number=SeqID_20538
  Homolog annotation: Hit_ID=Q6WAY6; Match level="QueryCoverage=30%, HitCoverage=11%, E-value=9e-07, Identity=40%"; Hit description =Putative uncharacterized protein
MGTRGCINYNPILAIRQLDYPMRGAPLEEDLTPIIERGFNSTNAEALQKVRQAWEMMQKKDKELRGSSNGPIGGYHRWLEAYTQGLDWLPNLRTTKGVEVEAPEEDDEDLPKVQEKLVVAVMRDRDQHVNHRQQVPRRIKSSQAHKHKVADEYARVYAEKEARGRVIDSLHQEATMWMDRFSLTLNGSQQLPRLLAKAKAMADAYSAPEEIHELLNY

SEQ ID NO: 112224 - protein, 119 aa, Glycine max
  Coding DNA Sequence Number=SeqID_20539
  Gene Ontology: Mol. function=aspartic-type endopeptidase activity; Biological process=DNA integration
  Homolog annotation: Hit_ID=A5BPN8; Match level="QueryCoverage=78%, HitCoverage=13%, E-value=1e-22, Identity=48%"; Hit description =Putative uncharacterized protein
MKQKIIESAHVVSTSKDKGKRKRNEEPKNEATKGPKQKKQNQASVPRNTWWLDSGATANISVSMQGCLSYRKPIDSERWIYVGDVKSVELPMVNPLMRNCVVLSVELIIQTQEHYGISA

SEQ ID NO: 112225 - protein, 382 aa, Glycine max
  Coding DNA Sequence Number=SeqID_20540
  Homolog annotation: Hit_ID=Q6WAY6; Match level="QueryCoverage=72%, HitCoverage=47%, E-value=2e-14, Identity=25%"; Hit description =Putative uncharacterized protein
MTPSTEDVKRATQGLFVVLQLFMYEKGGANWDQLLASKEGASVNWFPRWKEGRTGVLISCGGFPNVPLMGTRGCISYNPVLAIRQLGYPMRRAPLEDELAPVISRGFNKTNVETLQKDKELRGSNNGPIDGYRKWLKAHVQGLDWLPSLRTAKREEVEALEEDEEVQALRAELEHAQTVKERFKSTALKIRKENTKLRDVNVATTKALERETKRARREEHGRNKFRGALWGSNSELKLRREERDQSQVDSLILKDELKACSRSKRSLSQRLCETETNMLAIISKYQEELNLATAPEHRVADEYAQVYTEKEARGRVIDSLHQEATMWMDRFALTLNGNQELPRLLAKAKAMVDTYSTPEEIHGLLSYCQHMIDLMAHIIRNH

SEQ ID NO: 112226 - protein, 142 aa, Glycine max
  Coding DNA Sequence Number=SeqID_20541
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=71%, E-value=1e-24, Identity=69%"; Hit description=LacZ protein
  Subcellular localization annotation: CTP_CleavageSite=36; ConfidenceScore=5.06e-01
MKHFTDTLISANISNDGTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 112227 - protein, 68 aa, Glycine max
  Coding DNA Sequence Number=SeqID_20542
MTSKIILIMLKNQELRKFQRFKNQVLRIKIQDSRIKFQESRFKNNQDQDSRLKIQDSRIKRRLNQDKY

SEQ ID NO: 112228 - protein, 68 aa, Glycine max
  Coding DNA Sequence Number=SeqID_20543
YSLQAYPYGLPPDFAPRAALEDLSQAPTFEGQLPPYDDYPVQDDEEGNISAPCSTSKIHPPMNYPNQT

SEQ ID NO: 112229 - protein, 106 aa, Glycine max
  Coding DNA Sequence Number=SeqID_20544
MEAMKDQMTTMMEAMMSMRKMMEVSAAAVAITSVATKVDPTHPSGVNQVQSKHPFPPYSLSPNYTPPNVVHVPDENIDHSAPIPLESQQPQSGHAHVAQPMGETHE

SEQ ID NO: 112230 - protein, 70 aa, Glycine max
  Coding DNA Sequence Number=SeqID_20545
  Subcellular localization annotation: CTP_CleavageSite=63; ConfidenceScore=5.45e-01
MGVQIATRPTWVFQNVPPEGGCYWRKQPSSPGRARKSKPKRFRNVSVGDFMKIFNRSSSFVFRRSSVFNR

SEQ ID NO: 112231 - protein, 44 aa, Glycine max
  Coding DNA Sequence Number=SeqID_20546
MADALATLVSQPTLLRASEARLSGQQKRGSCSYVPSIEEKIRPT

SEQ ID NO: 112232 - protein, 59 aa, Glycine max
  Coding DNA Sequence Number=SeqID_20547
MDSAASKHICRDREMFDILKTDGEFDCFKLGNGGKMKVEGIGSVRMKLHDGAIRIFSNV

SEQ ID NO: 112233 - protein, 127 aa, Glycine max
  Coding DNA Sequence Number=SeqID_20548
  Subcellular localization annotation: CTP_CleavageSite=67; ConfidenceScore=5.22e-01
MGYQLGKRVFSLCKELKNFDILTFRNTRKVATPLKKARLWLRGGGGSSRSTSASSSGGGSSGKQNVRVVAGRSSRRDEVVQAIVGVLGFWRDGVPTSTVFDDFHQNYNDRVIDKCRCTTNAPHKKLI

SEQ ID NO: 112234 - protein, 51 aa, Glycine max
  Coding DNA Sequence Number=SeqID_20549
MEKFENKNIGEKKAKKAYITWDDNDLESSDDSEKEVINLCLMGKNYESEKE

SEQ ID NO: 112235 - protein, 198 aa, Glycine max
  Coding DNA Sequence Number=SeqID_20550
  Gene Ontology: Biological process=transposition, DNA-mediated
  Homolog annotation: Hit_ID=Q1J7G7; Match level="QueryCoverage=19%, HitCoverage=67%, E-value=1e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSILLQARGGARYQLLFPLVRVNFELGVIMVIAVSFGKPVVPAALMNRPTRGERRFAYWALAECILAYYVGTDEGVSEVLHVAGEKRLH

SEQ ID NO: 112236 - protein, 301 aa, Glycine max
  Coding DNA Sequence Number=SeqID_20551
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMASRVEVGRSILSAKSKFIPSRIISKASFQTLKFVHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112237 - protein, 45 aa, Glycine max
  Coding DNA Sequence Number=SeqID_20552
MANSDAILPRKGPVTRTMSKRHQEDWARAVEEGPRILMNLRGSIL

SEQ ID NO: 112238 - protein, 112 aa, Glycine max
  Coding DNA Sequence Number=SeqID_20553
MNKYEEQGIKENSPNKKIEEAKEHHLDEDALIPHDVSSIGACRPRIFFINGFLCFLEDEWKRKRERRCHFKEKMSLEEAHHHRRPWIRAWRKNEMAEGREREEHEILCSKKL

SEQ ID NO: 112239 - protein, 250 aa, Glycine max
  Coding DNA Sequence Number=SeqID_20554
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
ASRYQQGHQDLCILRSDLPSQWLLFLSAVPPVQLLTGWCVTAKAPPDISAGKCSGRVPFAIQAAQLLGRAIGAGLFAITPAGERGMCCKAIKLGNARVFPVTTLNSIDLVRWLEVQRLNFSHQKELCRSDFLSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112240 - protein, 235 aa, Glycine max
  Coding DNA Sequence Number=SeqID_20555
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARYGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112241 - protein, 231 aa, Glycine max
  Coding DNA Sequence Number=SeqID_20556
  Homolog annotation: Hit_ID=A5B5G7; Match level="QueryCoverage=90%, HitCoverage=14%, E-value=9e-11, Identity=27%"; Hit description =Putative uncharacterized protein
MASKRRKSSASYSSHIRFDRSRFHSQEAWDRYNDIVVPRKLLLERNEVIYHTEFDEFKEELERRKWDEELTSFDEGNIDVAIVKELYANLYDPEDKSPKQVRVRGHLIKFDEDTLNTFLKTPVIIEEGETLPTYSRFALLRPDPQELAAKLCISGRGFELNADGQPLKILRKNMTTLAQTWSVLSYSNLVPTSHTSDITLDRVKLIYGIIMKMDMNLGYLISHQDFYHCPA

SEQ ID NO: 112242 - protein, 78 aa, Glycine max
  Coding DNA Sequence Number=SeqID_20557
MAPKKLTSKGARKTIAGEGSSTAPPVEIEFDGHHFRSEEHQHRFEVIKDWSFLKEIRVQLAEGEYIEFQAEIARRHWT

SEQ ID NO: 112243 - protein, 421 aa, Glycine max
  Coding DNA Sequence Number=SeqID_20558
  Gene Ontology: Mol. function=ubiquitin thiolesterase activity; Cellular component=intracellular; Biological process=ubiquitin -dependent protein catabolic process
  Homolog annotation: Hit_ID=A7QR74; Match level="QueryCoverage=90%, HitCoverage=93%, E-value=3e-79, Identity=39%"; Hit description =Chromosome chr13 scaffold_149, whole genome shotgun sequence
  Pfam annotation: Domain name=DUF239; Domain location=205-379; Score =192.5; E_value=1e-54; Accession=PF03080.6; Description=Arabidopsis proteins of unknown function
MGKLLHFSAMGSTIFILLGLVVTVYGFVDYGSSSLSRLKVLEVERKLKQLRGHSLKTIQSEDGDIIDCIDINKQPAFDHPALKGHKIQMAPTYNSAKKDMTIGTKTTRTRKNAKSGKMMKQRDEGSSVTVTSQVWQKSGRCPEGTIPVRRIQERDMIKAHSIEDYGRKKPSFSHQHVGQLNNNLDSFVQLKNHSKAIALAVGFRYLGAKGDIKVDNPSVEKDDEYSTSQVSLLTGPYNDFECVEAGWAVNPSVYGDRQTRLFVYWTISNEIALGAAIYPISIPGGLQYIITIYIYKDPYTNNWWVQYGENTNIGYWPPELFETIRYNAESVEWGGEVYSSTIGHTPHTATQMGNGQFASVFGESSTITRMRIHDNSAALKIPEYVAEFTDEFNCYDVWYLSDYVEDPELYYGGPGQNPKCP

SEQ ID NO: 112244 - protein, 356 aa, Glycine max
  Coding DNA Sequence Number=SeqID_20559
  Gene Ontology: Mol. function=protein binding
  Homolog annotation: Hit_ID=A7P4H4; Match level="QueryCoverage=97%, HitCoverage=98%, E-value=1e-145, Identity=65%"; Hit description =Chromosome chr4 scaffold_6, whole genome shotgun sequence
  Pfam annotation: Domain name=DUF266; Domain location=84-346; Score =573.2; E_value=2.7e-169; Accession=PF03267.5; Description =Arabidopsis protein of unknown function, DUF266
MQSRVLTLEEGKERINQSNKPLRPVRLLVLFFALCVLFSVISIYTVKHFGIESVVTTMSSSFQPCYYEEPGGLDKWIRPPSSLIHNMSDEELLWRASFVPRIKGYPYPRVPKIAFMFLTKGPLPLAPLWERFLKGHEKQIPSQVSEWGRMSMCDAERRLLANALLDISNEWFILLSESCIPLYNFSFVYHYIMKSKHSFVGAFDDPGPYGRGRYNEHMAPLVNVTKWRKGSQWFEVNRKLAITIVEDTTFHPIFEQYCRPACYVDEHYFPTMLTIQAANVLANRSITWVDWSRGGAHPATFGRNDITEEFFNRVRRGHTCLYNNRNSSVCALFARKFAPSALEPLLHMVDSKVLDF

SEQ ID NO: 112245 - protein, 158 aa, Glycine max
  Coding DNA Sequence Number=SeqID_20560
  Gene Ontology: Mol. function=3'-5' exonuclease activity; Cellular component=intracellular; Biological process=nucleobase, nucleoside, nucleotide and nucleic acid metabolic process
  Homolog annotation: Hit_ID=A5B4I6; Match level="QueryCoverage=84%, HitCoverage=39%, E-value=1e-58, Identity=77%"; Hit description =Putative uncharacterized protein
  Pfam annotation: Domain name=KH_1; Domain location=106-158; Score =16.5; E_value=0.012; Accession=PF00013.20; Description=KH domain
MVYEFIYPPVDIDLYVQVKDPKFWRHRPLSEQMVRAAADDVRFLLYIYHQMMEKLNERSLWYLAVRGVLYCRCFCLNSNNFADWPSLPPIPDNLNADGSDPKEEILSVLDIPQGKMGLVIGKRGATILSIKQSCNAEILTGGPKGPPDKVRISASCTM

SEQ ID NO: 112246 - protein, 159 aa, Glycine max
  Coding DNA Sequence Number=SeqID_20561
  Gene Ontology: Mol. function=3'-5' exonuclease activity; Cellular component=intracellular; Biological process=nucleobase, nucleoside, nucleotide and nucleic acid metabolic process
  Homolog annotation: Hit_ID=A5B4I6; Match level="QueryCoverage=86%, HitCoverage=40%, E-value=2e-51, Identity=73%"; Hit description =Putative uncharacterized protein
  Pfam annotation: Domain name=3_5_exonuc; Domain location=37-157; Score=-29.6; E_value=0.013; Accession=PF01612.11; Description=3'-5' exonuclease
MASSSPSHSYLTHLPLHPSHQGDSEKRVEDDESRVPIHIVTAASQLPVEFLEPSPQSKLVIGFDCEGVDLCRKGTLCVMQLAFPDAVYLVDAIEGGEELIIACKPALESNYITKVIHDCKRDSEALYFQFGIKLNNVVDTQFLVYLQYTGRAYQPINFT

SEQ ID NO: 112247 - protein, 124 aa, Glycine max
  Coding DNA Sequence Number=SeqID_20562
MVKVGTSYVPINVSFSPKVGPGLPGINRDTQDLFILRSDLSVTAVPPVQLLTGWCVTAKAPPDISAGKCSGHAARRVPFAIQAAQLLGRAIGAGLFAITPAGERGMCCKAIKLGNARVFPVTTL

SEQ ID NO: 112248 - protein, 488 aa, Glycine max
  Coding DNA Sequence Number=SeqID_20563
  Gene Ontology: Mol. function=solute:hydrogen antiporter activity; Cellular component=integral to membrane; Biological process =regulation of pH
  Homolog annotation: Hit_ID=A7PE99; Match level="QueryCoverage=90%, HitCoverage=95%, E-value=1e-158, Identity=59%"; Hit description =Chromosome chr11 scaffold_13, whole genome shotgun sequence
  Pfam annotation: Domain name=Na_H_Exchanger; Domain location=188-453; Score=72.2; E_value=1.7e-18; Accession=PF00999.12; Description =Sodiumhydrogen exchanger family
MSRARSRSPSPCCGDTHLVLLLPVMLAVFFHSLLLLPHSSLAIRPTESDRIELANATESSSNASLSRPREGTFADMIDRALEHEFTENDQNEEAVLTLCLFFFVLAAPDPGSFNNSVAEQQAVLETVARVTPNKNDTKDEKSFQLHHVFNRAEETPMLIDRKDNVFIISNFKSKYPVLQLDLRLISDLVVAIVSATCGGVAFAFAGQPVITGYLLAGSIVGPGGFNFISEMVQLCGGKASEGVFVGAFLSMSSTAVVLKFLMEKNTTNALHGQVTIGTLILQDCAVGLLFALLPVLGGTSGVFQGVLSMTKLDKLGLSLELGSFAAGVMIATTDLAQHTLEQIEPIRNLFAALFLASIGMLIHVHFLWNHVDILVASVILVIVIKTIIIASVVKGFGYNNKTSILVGMSMAQIGEFAFVLLSRASNLHLVEVTTPLLFKLIPAVVHLGVLLRWFSPDSSVEIGYKLDNLRSDSGKQRIILMDQESHDS

SEQ ID NO: 112249 - protein, 109 aa, Glycine max
  Coding DNA Sequence Number=SeqID_20564
MACKIITKKDENHLQTQFCKCSSNHIENCKKVYLLGGEFANEAKAIKLEEKEQGEELGKEDGVFGKVHGGVGTTIQALTRVVGQLSDVHKTHKLFTRSRYHAHCFFDLG

SEQ ID NO: 112250 - protein, 709 aa, Glycine max
  Coding DNA Sequence Number=SeqID_20565
  Gene Ontology: Mol. function=ATP binding; Cellular component=integral to membrane; Biological process=metal ion transport
  Homolog annotation: Hit_ID=Q8H1Q2; Match level="QueryCoverage=48%, HitCoverage=98%, E-value=1e-153, Identity=76%"; Hit description =Nucleotide-binding protein
  Pfam annotation: Domain name=ArsA_ATPase; Domain location=60-299; Score=-159.2; E_value=0.0076; Accession=PF02374.6; Description=Anion- transporting ATPase
  Pfam annotation: Domain name=CbiA; Domain location=62-278; Score =43.3; E_value=8.8e-10; Accession=PF01656.14; Description=Cobyrinic acid a,c-diamide synthase
  Pfam annotation: Domain name=Zip; Domain location=392-706; Score =326.6; E_value=4.5e-95; Accession=PF02535.13; Description=ZIP Zinc transporter
  Pfam module annotation: Pfam domain module=ArsA_ATPase::CbiA::Zip; Domain location=60-299::62-278::392-706
MENADIPENANEHCPGPQSESAGKSDACEGCPNQQICATAPKGPDPDLVAIAERMATVKHKILVLSGKGGVGKSTFSAQLAFALAARDFQVGLLDVDICGPSIPKMLGLEGQEIHQSNLGWSPVYVESNLGVMSIGFMLPNPDEAVIWRGPRKNALIKQFLKDVYWGELDFLIVDAPPGTSDEHISIVQFLDATGVDGAIIVTTPQQVSLIDVRKEVNFCKKVGVKVLGVVENMSGLCQPITDFKFMKLTDNGEQKDVTQWVWEYMREKAPEMLNLLACTEVFDSSGGGAVKMSNDMGVPFLGNVPLDPQLCKAAEEGSSCFAKKDCVVSAPALNKIIEQLIETNGWSMLDLWSLPRLFSESLNLQSLRESFTSSSCDRTESEQCRDESAAMVLKFVAVASILVAGFGGVSIPLVGKSRRFLRPDGDVFAAAKAFAAGVILATGFVHMLRDSWDALREPCLGTHSRAWAKFPFTGFFAMVSALFTLLVDFLATEYYERREARGRVERGKVVDYDEGCDEALLETGIVEVKDLGRGGRHSHSHDGDDVESSVRHVVVSQVLELGIVSHSMIIGLSLGVSQSPCTMKPLIVALSFHQFFEGFALGGCISQAQFKTLSATIMSCFFALTTPLGVAIGASVASIFNPYSPVALITEGILDALSAGILVYMALVDLIAADFLSKKMRCNFRFQIICYCLLFLGAGLMSSLAIWA

SEQ ID NO: 112251 - protein, 440 aa, Glycine max
  Coding DNA Sequence Number=SeqID_20566
  Gene Ontology: Mol. function=nucleic acid binding; Cellular component= intracellular; Biological process=regulation of transcription
  Homolog annotation: Hit_ID=A7P4L5; Match level="QueryCoverage=84%, HitCoverage=66%, E-value=1e-101, Identity=54%"; Hit description =Chromosome chr4 scaffold_6, whole genome shotgun sequence
  Pfam annotation: Domain name=zf-C2H2; Domain location=146-168; Score =19.0; E_value=0.018; Accession=PF00096.17; Description=Zinc finger, C2H2 type
  Pfam annotation: Domain name=zf-C2H2; Domain location=173-194; Score =16.0; E_value=0.14; Accession=PF00096.17; Description=Zinc finger, C2H2 type
  Pfam annotation: Domain name=zf-C2H2; Domain location=70-92; Score =26.0; E_value=0.00014; Accession=PF00096.17; Description=Zinc finger, C2H2 type
  Pfam module annotation: Pfam domain module=zf-C2H2::zf-C2H2::zf-C2H2; Domain location=146-168::173-194::70-92
MSNLTSASSEISATSGIRNNNGSSLYAQYSSTSISQEPEPKKKRSLPGHPDPEAEVIALTPKTLLATNRFVCEICQKGFQRDQNLQLHRRGHNLPWKLKKKSSKNVRKKVYVCPEATCVHHDPSRALGDLTGIKKHFFRKHGEKKWKCDKCFKRYAVQSDWKAHSKICGTREYKCDCGTLFSRRDSFITHRAFCDALAQESGRTVNPLLDLSTQFRSHGLQLQAPSSLLMKGEHDHHFNLLNPEIPSWLLSSPTVVVEEEALHNSSQTIRSTLDNFSTIPQLLFPTAQHVNNYHSSSLVHHDQNPNPSTTTTTTSSTTLLPSLSTSFHSSSSFPHMSATALLQKASQIGVTVSCSTAAPSSQTMMLVRPHLLLHQQVHVPECSTTTAIATTGTTLGYNNNNNNNNNNNMASSSAVSSGMFVMPSREEIGTTLGFARGLAS

SEQ ID NO: 112252 - protein, 528 aa, Glycine max
  Coding DNA Sequence Number=SeqID_20567
  Gene Ontology: Mol. function=hydrolase activity, hydrolyzing O -glycosyl compounds; Cellular component=extracellular region; Biological process=carbohydrate metabolic process
  Homolog annotation: Hit_ID=Q5ZQK6; Match level="QueryCoverage=97%, HitCoverage=88%, E-value=1e-174, Identity=56%"; Hit description =Fructan 1-exohydrolase
  Pfam annotation: Domain name=Glyco_hydro_32C; Domain location=358 -474; Score=136.8; E_value=6.2e-38; Accession=PF08244.3; Description =Glycosyl hydrolases family 32 C termi
  Pfam annotation: Domain name=Glyco_hydro_32N; Domain location=10-317; Score=497.5; E_value=1.6e-146; Accession=PF00251.11; Description =Glycosyl hydrolases family 32 N termi
  Pfam module annotation: Pfam domain module=Glyco_hydro_32C::Glyco _hydro_32N; Domain location=358-474::10-317
MTSVDLSAAAPMYYKGVYHFFYQHNPYAPTFGEKMVWAHSVSYDLINWIHLNHAIEPSDSYDINSCWSGSATILPGEEEQPVILYTGIDNNKYQVQNMAMPKDLSDPFLREWVKHPQNPAMTPPSGVEVNNFRDPSTAWQGKDGKWRVVIGAQNGDEGKTILYQSEDFVNWRVELNPFFATDNTGVCECPDFFPVSINSTNGVDASVQSQSVRHVLKISYLRRHQDYYFLGKYVYDEGNFVPDVKFTGTSSDLRLDYGKFYASKSFFDHAKNRRILWGWVNECDTRQNDIEKGWAGLQCIPRQVWLDESGKQLMQWPIEEIEKLRDKQISILGEKLVGGSIIEVSGITASQADVEVLFELPELENVEWLDESEVDPHLLCSEEYATRSGTIGPFGLLALASEDQTEHTAVFFRIYRASNRYICFMCSDQSRSSLRQDLDKTTYGTIFDIDPNVKTISLRSLIDRSIIESFGEKGRICITSRVYPSMSIDKNAHLYVFNNGSQSVVISELNAWSMKQAEFGQEESINKQ

SEQ ID NO: 112253 - protein, 171 aa, Glycine max
  Coding DNA Sequence Number=SeqID_20568
MTTNPVSDSSRDDKLNGAKPQITPLSLSQSHPYAITGADLDEFGDEVAGDVEGDEGLEAADGGASDEDGGGAVVGEGEGGDLVVVQFDDGGVDADGGEELLHDVAHAAGGAREDYDGREQEEEKEEEFVLFVVVVVVVVVVVGVERSSWTTSFEQRRRPCIVELSEEKKDK

SEQ ID NO: 112254 - protein, 186 aa, Glycine max
  Coding DNA Sequence Number=SeqID_20569
  Subcellular localization annotation: CTP_CleavageSite=52; ConfidenceScore=5.42e-01
MVEPSNKRKGSSSTITVVGQRHHGTSNDPPAPPLPSFSSPRSLTLFSSDDQRQSQGVPFEGTLVDDRKHVYSSHDALKMASEEDLILLLALQNGWQIDWAHLVRYCMHKALRVNAPLPYPHLITLFLQHFNVLLEDEHFVKVKRSFSIGAGAITSFGYQKDRDGQWVHKQDLPPPIPDERTPSPPP

SEQ ID NO: 112255 - protein, 255 aa, Glycine max
  Coding DNA Sequence Number=SeqID_20570
  Gene Ontology: Cellular component=membrane
  Homolog annotation: Hit_ID=Q8RWH8; Match level="QueryCoverage=99%, HitCoverage=68%, E-value=1e-66, Identity=52%"; Hit description =Putative uncharacterized protein At5g11960
  Pfam annotation: Domain name=Multi_Drug_Res; Domain location=2-73; Score=-20.8; E_value=0.018; Accession=PF00893.10; Description=Small Multidrug Resistance protein
MWVIRSYALNKTWVVGFLIDIFGALLMLRALSLAPVSVIQPVSGCGLAILSIFSHFYLKEVMNAVDWVGITLAGFGTIVSEDLSNEPIFFWSIPLFYYLAADKTKFAMKGVGAGGEEQEVVALSIFHIPGLAFIVFILFVGFKTSLYFLVDGFEYASANEENKRWMSSVISKMGFLFLEQGFPKLLVPMCIMISVCCSGTGIYYQTRGLKHGRAIVVSTCAAVASILTGVLAGMLALGERLPSEPKARLALLLGW

SEQ ID NO: 112256 - protein, 428 aa, Glycine max
  Coding DNA Sequence Number=SeqID_20571
  Gene Ontology: Mol. function=nucleoside-triphosphatase activity; Cellular component=myosin complex; Biological process=regulation of transcription
  Homolog annotation: Hit_ID=A7P4U3; Match level="QueryCoverage=47%, HitCoverage=15%, E-value=1e-50, Identity=53%"; Hit description =Chromosome chr4 scaffold_6, whole genome shotgun sequence
MGASERNGTWEIVERPKDKKAVGCRDTSKPMGSIMRRHLLSGKNEYSQDHHLLSSKHNLVGRCINLMLKMPSYMEAWKKNLLGLGLVGSLKLCYLWGTSKAKVSNEEAKKVEISKLQKMLEALNLELDAAKLAKINECNKNAVLQNQFELSVKEKSALKRELVAVDELRKENAQLKVPLDAFEKKCTTLELELMNAQKGRDETMEKLRESEQKCSQLEQNEKRLEEKLLNLEDENHVLRQKALSTPLKSNRPGFAKSISEESPTPTKLIAPFTLSLPDSRRSNKLTAERQQVDPVAPMFCLKSYTFSFGHPAISEELVEYRGCEEGHKYFLGKQNWTMIWRVETNSRNSIEKYLPPCRIETGVDSSDLAQTRASLGRLASLRRVRNCYSPLFTRIVIAGPQSRSSIVIGRRCLAGPHLRSKLCFTSQR

SEQ ID NO: 112257 - protein, 99 aa, Glycine max
  Coding DNA Sequence Number=SeqID_20572
  Gene Ontology: Mol. function=DNA binding; Cellular component =chromosome; Biological process=nucleosome assembly
  Homolog annotation: Hit_ID=P02310; Match level="QueryCoverage=77%, HitCoverage=74%, E-value=1e-09, Identity=46%"; Hit description =Histone H4, major
MAKRLDWVFISRFITFSKIMASFQEGRKVSERDMRKHSRDNEASDSEIGEKRRCKEDHLENVIHDAVTYTELAKRMTVTAMNVVYALNRQEKTLYGFEF

SEQ ID NO: 112258 - protein, 989 aa, Glycine max
  Coding DNA Sequence Number=SeqID_20573
  Gene Ontology: Mol. function=protein binding; Cellular component =cytoplasm; Biological process=ubiquitin cycle
  Homolog annotation: Hit_ID=A7P4T5; Match level="QueryCoverage=85%, HitCoverage=91%, E-value=0.0, Identity=73%"; Hit description =Chromosome chr4 scaffold_6, whole genome shotgun sequence
  Pfam annotation: Domain name=F-box; Domain location=154-201; Score =35.2; E_value=2.4e-07; Accession=PF00646.24; Description=F-box domain
  Pfam annotation: Domain name=LRR_1; Domain location=244-266; Score =1.5; E_value=1.6e+02; Accession=PF00560.24; Description=Leucine Rich Repeat
  Pfam annotation: Domain name=LRR_1; Domain location=268-296; Score =1.7; E_value=1.5e+02; Accession=PF00560.24; Description=Leucine Rich Repeat
  Pfam annotation: Domain name=LRR_1; Domain location=332-356; Score =0.4; E_value=2.6e+02; Accession=PF00560.24; Description=Leucine Rich Repeat
  Pfam annotation: Domain name=LRR_1; Domain location=358-383; Score =4.5; E_value=45; Accession=PF00560.24; Description=Leucine Rich Repeat
  Pfam annotation: Domain name=LRR_1; Domain location=384-409; Score =6.5; E_value=19; Accession=PF00560.24; Description=Leucine Rich Repeat
  Pfam annotation: Domain name=LRR_1; Domain location=430-452; Score =9.5; E_value=5.3; Accession=PF00560.24; Description=Leucine Rich Repeat
  Pfam annotation: Domain name=LRR_1; Domain location=472-497; Score =1.6; E_value=1.5e+02; Accession=PF00560.24; Description=Leucine Rich Repeat
  Pfam annotation: Domain name=LRR_1; Domain location=514-534; Score =5.6; E_value=29; Accession=PF00560.24; Description=Leucine Rich Repeat
  Pfam annotation: Domain name=LRR_1; Domain location=563-585; Score =10.8; E_value=3.1; Accession=PF00560.24; Description=Leucine Rich Repeat
  Pfam annotation: Domain name=LRR_1; Domain location=605-627; Score =3.6; E_value=65; Accession=PF00560.24; Description=Leucine Rich Repeat
  Pfam annotation: Domain name=LRR_1; Domain location=647-671; Score =0.5; E_value=2.5e+02; Accession=PF00560.24; Description=Leucine Rich Repeat
  Pfam annotation: Domain name=LRR_1; Domain location=698-719; Score =10.7; E_value=3.2; Accession=PF00560.24; Description=Leucine Rich Repeat
  Pfam annotation: Domain name=LRR_1; Domain location=783-806; Score =2.1; E_value=1.3e+02; Accession=PF00560.24; Description=Leucine Rich Repeat
  Pfam annotation: Domain name=LRR_1; Domain location=808-830; Score =0.9; E_value=2.1e+02; Accession=PF00560.24; Description=Leucine Rich Repeat
  Pfam annotation: Domain name=LRR_1; Domain location=860-883; Score =0.9; E_value=2.1e+02; Accession=PF00560.24; Description=Leucine Rich Repeat
  Pfam annotation: Domain name=LRR_1; Domain location=906-923; Score =6.5; E_value=19; Accession=PF00560.24; Description=Leucine Rich Repeat
  Pfam annotation: Domain name=LRR_1; Domain location=927-950; Score =4.4; E_value=48; Accession=PF00560.24; Description=Leucine Rich Repeat
  Pfam annotation: Domain name=LRR_1; Domain location=952-975; Score =6.3; E_value=21; Accession=PF00560.24; Description=Leucine Rich Repeat
  Pfam module annotation: Pfam domain module=F-box::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1; Domain location=154 -201::244-266::268-296::...
  Pfam module annotation: Domain location=332-356::358-383::384 -409::430-452::472-497::514-534::563-585::605-627::647-671::698 -719::783-806::808-830::860-883::906-923::927-950::952-975
MKEGDIIFGNVVVSDDDDGDGDGNDTRGDDKQFAMVRADVLGSWPGESSSTAAAECLDIAAAGESRDLSNKRAKFYADFEEHHFSTGKCSASNEYVDYNFSIKGTLRPNGETCYDAFSLMGVVEENSSGFDSRIVKEGGEGDDSDISKVEEDVEVRMDLTDDLLHMVFSFLDHPNLCKAARVCKQWRGASAHEDFWKSLNFEDRNISVEQFEDMCSRYPNATAVSLSGSAIYLLVMKAICSLRNLEFLTLGRGQIADTFFHALADCSMLRRLNINDSILGNGIQEITINHDRLCHLQLTKCRVMRIAVRCPQLETMSLKRSNMAQVVLNCPLLHELDIGSCHKLPDAAIRAAATSCPQLVSLDMSNCSCVSDETLREIALSCANLSFLDASYCSNISLESVRLPMLTVLKLHSCEGITSASMAAIAHSYMLEVLELDNCSLLTSVSLDLPRLQTIRLVHCRKFADLNMRTMMLSSILVSNCPALHRINITSNSLQKLALQKQDSLTMLALQCQSLQEVDLSECESLTNSICDVFSDGGGCPMLKSLVLDNCESLTSVRFISTSLVSLSLGGCRAITSLELTCPNLEKVILDGCDHLERASFCPVGLRSLNLGICPKLNILSIEAMFMVSLELKGCGVLSEASLNCPLLTSLDASFCSQLTDECLSATTASCPLIESLILMSCPSIGLDGLCSLRWLPNLTLLDLSYTFLVNLQPIFESCSQLKECRCFTLDRIVASIILIRHMHSSSLKPAFGSESVLVLKLQACKYLTDSSLEPLYKGALPVLQELDLSYGTLCQSAIEELLSCCTHLTRVSLNGCANMHDLNWGCSRAHTAELPGVNVLPIASSPENVLELSEQPIRLLQNLNCVGCPNIRKVFIPSTAHCSRLLFLNLSLSANLKEVDVACLNLSWLNLSNCSSLEVLKLECPRLTSLFLQSCNINEEAVEAAISKCTMLETLDVRFCPKISSMSMGRLRAACSSLKRIFSSLSAS

SEQ ID NO: 112259 - protein, 1031 aa, Glycine max
  Coding DNA Sequence Number=SeqID_20574
  Gene Ontology: Mol. function=transferase activity; Biological process= D-ribose metabolic process
  Homolog annotation: Hit_ID=A7P297; Match level="QueryCoverage=7%, HitCoverage=26%, E-value=3e-17, Identity=52%"; Hit description =Chromosome chr19 scaffold_4, whole genome shotgun sequence
MEFHLACHVYFVDFRWYISPLSSKPTCGRKRLSSVKHGWVLFDVESGNLDKCKSCRMDMLLVLQAKLDVLGVCGVRAVLLHTCHSWNGHILEAWCMGKFLLTMSFFLFDSTIGMGCSDFGFDLATPGRPRGQLHRWFLLGGDSCGASNNESSSLERLRVSRRVGRVRKSGGGDVRGSPGVRCSHSVGSLSSPPVVAGFEWVRDDILKYKSSITSMASFVALQCQVKYASPEDSCKLVIQACGIPCFSLDPSQLPLMVVVGSANADIYVEVDQLLGEGETLVARSGQTLVAGKGANPTTCSTKLTRLITAGLRGGGVCLDNLVVVALAPIGHAAVMIQSNNQNSIIYIGVCFPLFSGHNFLSVYGVSLERLLNNSLEVLDLFGVGQLGEHVFPGVALPGYVVHLKAFEVVDESFGDVIVLEQHYFLVQLSVGNLPLDKLRVARLFEALKLNLRACSRVMLLRPSRMIPAPLTFTLDALSTSNSESSTNQATIPPANLGFHKTYLMGAKLTTLSATERYRSSGSPGLGQLTIRGVAMVLFKAEMAYFLGVCMTVHLQYGCAFVGVDFYSMACDHNAQELVSTDFEGFDHHVIDVDLNISSDMLFKDMVHQPLIKRVSGSGCIWSRHLGIIVLGTQTLYRLACRCWVEDDESMADNVGVDSQHDINYVFVLMVIEVPADLYPLLKFRFELQLKEFFNRLWAPIRSITTLPGGRIGCPFQTFRVALSCLVLIFLDNHDLSRQDFKPLECFPIHDINGVTLVDEDLIYHEVGDYDGDNHGIVLMDKVDVDVPDDIEVTLAGLVGLPSVGESTYNGVYYTSDLLRGLVSLFLRRLSFTSLLVVFVSLSYVDPLGPNMFDVVTITVMASSRIVVRLTAGVCNARTRTLLGEVAEVMQCNQLAAYCELKCLTKVSKLSMELRGSPPYQVNATPLRDVGKTQTQDCIVFGGYVNFHNLVDEGVSTSTLPCRTVLLERLRSFRVLTVCRGVLVFVMVARGGLKPSKGVSCLRPDRGLTMREKRGHRVDVAKMRSKISHVER

SEQ ID NO: 112260 - protein, 19 aa, Glycine max
  Coding DNA Sequence Number=SeqID_20575
MAWEMSSMVALRFAYRCWK

SEQ ID NO: 112261 - protein, 901 aa, Glycine max
  Coding DNA Sequence Number=SeqID_20576
  Gene Ontology: Mol. function=hydrolase activity, hydrolyzing O -glycosyl compounds; Cellular component=extracellular region; Biological process=carbohydrate metabolic process
  Homolog annotation: Hit_ID=Q5BMA5; Match level="QueryCoverage=99%, HitCoverage=98%, E-value=0.0, Identity=74%"; Hit description =Putative endo-1,4-beta-xylanase
  Pfam annotation: Domain name=CBM_4_9; Domain location=14-169; Score =82.7; E_value=1.2e-21; Accession=PF02018.8; Description=Carbohydrate binding domain
  Pfam annotation: Domain name=CBM_4_9; Domain location=186-338; Score =70.2; E_value=7.1e-18; Accession=PF02018.8; Description=Carbohydrate binding domain
  Pfam annotation: Domain name=CBM_4_9; Domain location=356-515; Score =94.9; E_value=2.6e-25; Accession=PF02018.8; Description=Carbohydrate binding domain
  Pfam annotation: Domain name=Glyco_hydro_10; Domain location=555-845; Score=220.7; E_value=3.5e-63; Accession=PF00331.11; Description =Glycosyl hydrolase family 10
  Pfam module annotation: Pfam domain module=CBM_4_9::CBM_4_9::CBM_4 _9::Glyco_hydro_10; Domain location=14-169::186-338::356-515::555-845
MAGNISGPSGSKGANILLNHDFSSGLTSWHLNSCTGYVISSKSGTQGGIPMDLDANYAVITDRKECWQGLEQDITNKISIGSTYTVSACVGVSGVSQGSSDVLATLKLEHHDSATRYLFIGRTSVNNDSWEKLEGTFSLSTMPDRVIIYLEGPAPGVDLLIRSVVINCSTPNDNTTSTGCVSAGDDNIIVNPQFDDGLKNWSGRSCKIMLHDSMNDGKIVPKSGKFFASATERTQSWNGIQQEITGRVQRKLAYEVTALVRIFGNNVSTADVRATLWVQTPDLREQYIGIAKLATDKDWITMQGKFLLNGSPSKVVLYLEGPPPGTDILLNNLVLKHAAKTPPSTPPDVKNVAFGVNIIENSNLADSTNGWFPLGNCTLSVKTGSPHIIPPMARDSLGPHELLSGRYILVTNRMQTWMGPAQTITDKVKLFVTYQVSAWVRIGSAGSSGPQNVNVALGVDNQWVNGGQTQVSDDMWHEIGGSFRIEKQPSKVMVYVQGPASGVDLMVAGLQIFPVDRHTRFRYLKIQTDKIRKRDVILKFSGLDSGSYANTSVKVIQTHNDFPIGTCISRTNIDNEDFVNFIVKHFNWAVFGNELKWYWTEPQQGNFNYKDADDMLSLCQKHKIQTRGHCIFWEVDETVQQWIKSLNKNDLMTAVQNRLNGLLTRYKGKFSHYDVNNEMLHGSFYQDRLGKDIRANMFKTASQLDPSATLFVNDYHVEDGCDTRSCPDKYIHHILDLQEQGAPVGGIGIQGHIDCPIGPIVSSSLDKLGILGLPIWFTELDVSSVNEYVRADDLEVMLREAMAHPTVEGLMLWGFWELFMSRDHSHLVNAEGDINEAGKRFLALKQEWLSHSRGHVDEQGQYNFRGFHGTYNVQVVTPSKKISKTFVLDKGDSPLVVSIDL

SEQ ID NO: 112262 - protein, 886 aa, Glycine max
  Coding DNA Sequence Number=SeqID_20577
MPRHKKCNPCKIRVEPNQSIFHACPDKLCWFTYIDNSSYNNISGGNFDFNGDSNSDNDDSSDNNIGDKDHNVSIGCGGDDVGDSSVGSNDNDNDDGANRNGGGGCGNTNIGDSEKESLSNVGKKDNIIFKVSVYEEGVVAMSDFEVAELNICSDYVAMVKEFGTFNDDEGFIGDKIVNNIKAVPRLRILVEVPLIASPHVHRSMSVGSSSSTPAVAGYEWDKDNVLKYKSCLSLIASVTALQRQVKLANPEDSCPGCHFILNRFSVCSTGALECGFFPALLEQLSDGVLATDVMTNGKPLMFNWGEEPYFSFYRQSDPTRFKSNDEDLLSLRNDPLATLDDKCRTLSLPLVKQVRPEGGTMPLFAATLSVGERGQLASEIDLIAIAVEVTPNVHSSIFAKRKRDDIVGSFGCKKSRTPMSLHALRFIGLTTGHLTTRQDMPPAPLEVKALVVVAAAAATPATPVHSPSPTTIIQEVTLADVEDVVLATLVESVVVSSSTVASLLLSVSVVTTGAPTVLSPSLVALPVAILEAMALPSSSSHPCVSLDHLYTFSDVELLWGATYKSEQKTLIGFVSTFEKNLIRSVGVQNATDSVKMFLQRSLTILEENILQHQEAVQKISSLEAEVSKWRAIAQTLWRVELPKVANAIVAFTEVVRENHQLSSKVGGALTKLLHTRLDGDDLFRCCKNLQTEKMDMCGRVESMVAEKDRLAKRIAKLEAWLRESESRLKESELRAAKEIEASKELEEELILYKKVVEQHEKGFQKAVKSHQSLQDVKEGLLLDEKEIDSEEEAADERQGAVEQGDDACLVTRLMGLPSVLWSFSLDGFPPLMIMGSKCELHLIEGLVMQSGVLPNNGVVVRLVELGLLTVVVIVVVCERTKEMPRV

SEQ ID NO: 112263 - protein, 341 aa, Glycine max
  Coding DNA Sequence Number=SeqID_20578
  Gene Ontology: Mol. function=catalytic activity; Cellular component =integral to membrane; Biological process=metabolic process
  Homolog annotation: Hit_ID=A7P4S1; Match level="QueryCoverage=37%, HitCoverage=37%, E-value=5e-60, Identity=85%"; Hit description =Chromosome chr4 scaffold_6, whole genome shotgun sequence
  Pfam annotation: Domain name=FAE1_CUT1_RppA; Domain location=184-341; Score=22.6; E_value=1.6e-16; Accession=PF08392.3; Description =FAE1Type III polyketide synthase-lik
  Pfam annotation: Domain name=Spermine_synth; Domain location=1-139; Score=-87.2; E_value=0.0038; Accession=PF01564.8; Description =Sperminespermidine synthase
  Pfam module annotation: Pfam domain module=FAE1_CUT1_RppA::Spermine _synth; Domain location=184-341::1-139
EVVDFCRKYLIANKEAFSHKKLDLVINDAKAELEKRKEKFDIIVGDLADPLEDGPCYQLYTKSFYEKILKPKLNDNGIFVTQAGPAGIFTHKEVFTSIYNTVKQVFKYVIAYTTHVPSFADTWGWVMCLHEASVEDLLSLVAIIVMLAITLLLMFSVTGSLKLSKLCSHNHQLDTETVVAASAVLLSLAALYVVDFACYKPEKERKISVEGFLKMGEESVGFEEESRQFQRKISTRAGLGDETYFPRRITSCSPKLCMSKARLEVEAVMFGALDALLVITGVVPKDIDISMVNCSLFNPTPSLPAMIVNHYRPRSNIKSYNAHNHTIFGKHYFPQILDVQF

SEQ ID NO: 112264 - protein, 59 aa, Glycine max
  Coding DNA Sequence Number=SeqID_20579
  Gene Ontology: Mol. function=metal ion binding; Cellular component =integral to membrane
  Homolog annotation: Hit_ID=Q06A76; Match level="QueryCoverage=69%, HitCoverage=16%, E-value=3e-16, Identity=97%"; Hit description=PHD4
MDAGYNPRTVEEVFRDFKGRRAALIKALTTDVEEFYQQCDPVVLMYRGLKLRNSVAIFL

SEQ ID NO: 112265 - protein, 136 aa, Glycine max
  Coding DNA Sequence Number=SeqID_20580
  Gene Ontology: Mol. function=protein binding; Cellular component =cytoplasm; Biological process=response to stress
  Homolog annotation: Hit_ID=P05477; Match level="QueryCoverage=98%, HitCoverage=84%, E-value=9e-65, Identity=90%"; Hit description=17.9 kDa class II heat shock protein
  Pfam annotation: Domain name=HSP20; Domain location=53-134; Score =86.6; E_value=8e-23; Accession=PF00011.12; Description=Hsp20alpha crystallin family
MDFRVMSLESPLFHTLQHMMDMPDDSAGDNKTYNAPTRSYVRDAKAMAATPADVKEYSNSYMFEIDMPGLKSGDIKVQVEDDNVLLISGERKRNEEKEGAKYLRIERRVGKLMRKFVLPENANTDAVSAVCQDGGA

SEQ ID NO: 112266 - protein, 204 aa, Glycine max
  Coding DNA Sequence Number=SeqID_20581
  Pfam annotation: Domain name=zf-CCHC; Domain location=28-45; Score =19.1; E_value=0.0019; Accession=PF00098.14; Description=Zinc knuckle
MWKKRNGTIWKGSKKPHRERKDKEKSSIICFECKKPGHFKLECLDLDKSAYKKKYFKSKDKKVLMKTWEELDDTLFDVEIEEEEETNLCLTTNTASKGSDSKSDEEALQKQPQDVVMLHQETEILKETLSKFVGRIEKLNKMLRYNKFPIDEFGNGYKGKKYVHDEENIIFTTMDTPIMVPEQWLLTSHNRRKMYVPMSECSNV

SEQ ID NO: 112267 - protein, 173 aa, Glycine max
  Coding DNA Sequence Number=SeqID_20582
  Gene Ontology: Mol. function=phospholipid-hydroperoxide glutathione peroxidase activity; Cellular component=chloroplast; Biological process=response to oxidative stress
  Homolog annotation: Hit_ID=Q05FZ6; Match level="QueryCoverage=56%, HitCoverage=41%, E-value=7e-49, Identity=90%"; Hit description =Glutathione peroxidase
  Pfam annotation: Domain name=GSHPx; Domain location=3-61; Score=48.9; E_value=1.1e-12; Accession=PF00255.10; Description=Glutathione peroxidase
MGTRQGLEILAFPCNQFGMQEPGSNEDIKQFACTRYKAEFPIFDKVDVNGPFTTPVYQFLKSSAGGFLGDLIKWNFEKFLVDKNGKVIERYPPTTSPFQIEFMLNVVSNLLHAERFKQFSLIFIENHTTIIVNPTLEFDMSNMGLKFHSLPLDPKRFTFGFESCDTYYILGLA

SEQ ID NO: 112268 - protein, 443 aa, Glycine max
  Coding DNA Sequence Number=SeqID_20583
  Gene Ontology: Mol. function=catalytic activity; Cellular component =mitochondrion; Biological process=metabolic process
  Homolog annotation: Hit_ID=Q9SZ48; Match level="QueryCoverage=100%, HitCoverage=62%, E-value=5e-59, Identity=57%"; Hit description=Enoyl- CoA hydratase-like protein
MQRFKALLPQQTRSSLRTLCSHRRAFSAQPNYAKHHDDDSQEQILVEGRAKSRAAILNRPSSLNSLNASMVARLKRLYDSWEENSDIGFVLMKLQIAILNVLKGSGRAFCSGADVVRLYHSLNEASKLLHKHLLGKKIRRKNELNFSQKLKSAFAQVKINLCLVQSCKNDAEGSHFYANALCILSLFIFTYCLECFSSSFLLLISVLINLLFIEKQKYKVNIGFLNHIPTESHCKVVMGGNTDEAEQFFKTLYSFVYLQGTYLKPHVNSGAIIQSQVGESTSVAILEQNDIDLCWSLACSYTSHDQQFSSCTFLAIPVAILDGITMGCGSGISLPGMFRVVTDKTVFSHPEAQIGFHPDAGASYVLSRLPGYLGEYLALTGDKLNGVEMIACRLATHYSLNARLSLLEERLGKLITDEPSVVESSLAQYGDLVYPDRSSVLHR

SEQ ID NO: 112269 - protein, 325 aa, Glycine max
  Coding DNA Sequence Number=SeqID_20584
  Gene Ontology: Mol. function=protein binding; Cellular component =cytoplasmic vesicle; Biological process=endocytosis
  Homolog annotation: Hit_ID=A7P4G8; Match level="QueryCoverage=74%, HitCoverage=42%, E-value=3e-90, Identity=68%"; Hit description =Chromosome chr4 scaffold_6, whole genome shotgun sequence
  Pfam annotation: Domain name=ENTH; Domain location=105-228; Score =234.5; E_value=2.4e-67; Accession=PF01417.11; Description=ENTH domain
MEGLYKVVAEYKEQGGWNLNQIQHLLPENIADIIQSVVGSQAQFIIKSVYDEIHQRGIDNQNPFSNLSSLQIGSDQNPTAMDFMKVFDQTVREIKREVNLKVLKVPEIEQKVLDATDNEPWGPHGTVLAEISQATKKFTECQMIMNVLWTRLGETGKDWRYVYKALAVIEYLVAHGSERAVDDIIEHTFQISALSSFEYVEPSGKDVGLNVRKKAENIVSLLNDKDKIHEVRNKAAANRDKYIGVSSSGITYKSGSASSYGSGSSFQSSGKYGGFGSRDGDRFNDSYRDKGSYEEEKDYQGKSHHATAGDNQENSFKKGSARSAR

SEQ ID NO: 112270 - protein, 84 aa, Glycine max
  Coding DNA Sequence Number=SeqID_20585
MAFAHDFVRKQPMGEFGNQGSSQNLCMYRSQKYLNMHEMAPRKLSAKRSRKDKAAEGTSAAPEYDSHRFRSAEHQQHFEAIKGW

SEQ ID NO: 112271 - protein, 143 aa, Glycine max
  Coding DNA Sequence Number=SeqID_20586
  Gene Ontology: Mol. function=superoxide dismutase activity; Cellular component=mitochondrial matrix; Biological process=superoxide metabolic process
  Homolog annotation: Hit_ID=P66828; Match level="QueryCoverage=100%, HitCoverage=69%, E-value=2e-77, Identity=97%"; Hit description =Superoxide dismutase [Mn]
  Pfam annotation: Domain name=Sod_Fe_C; Domain location=33-139; Score =210.9; E_value=3.1e-60; Accession=PF02777.9; Description =Ironmanganese superoxide dismutases, C-term
LPADKKTVLRNNAGGHANHSLFWKGLKTGTTLQGDLKAAIERDFGSVDNFKAEFEKAAATRFGSGWAWLVLKGDKLAVVSTANQDSPLMGEAISGASGFPILGLDVWEHAYYLKFQNRRPDYIKAFWDVVNWDEAAARFAAKK

SEQ ID NO: 112272 - protein, 62 aa, Glycine max
  Coding DNA Sequence Number=SeqID_20587
  Gene Ontology: Mol. function=nucleic acid binding; Cellular component= nucleus; Biological process=mRNA processing
  Homolog annotation: Hit_ID=Q9FT01; Match level="QueryCoverage=88%, HitCoverage=14%, E-value=6e-19, Identity=85%"; Hit description =Putative splicing factor
MVKPSEAEKNLVQSNASGGAAGVTGPYGAVDRKLYVGNLHFNMTESQLWESFGMFLGLCYIY

SEQ ID NO: 112273 - protein, 107 aa, Glycine max
  Coding DNA Sequence Number=SeqID_20588
VHRVKLKYGSNHLAKIGAKDGSCYIIASSTAKHVEEVQEKMKADMEAMKEQMATMMAMMSMRKIMEANAVAVAATSTVAKVNPMPPSGLNQMNHPTSAMIWEVQMAP

SEQ ID NO: 112274 - protein, 50 aa, Glycine max
  Coding DNA Sequence Number=SeqID_20589
MARTCSPLKARNCSPLKIDCPFERGDNSCNLILSLQISPGTPSECLFCLI

SEQ ID NO: 112275 - protein, 341 aa, Glycine max
  Coding DNA Sequence Number=SeqID_20590
  Gene Ontology: Mol. function=chloramphenicol O-acetyltransferase activity; Cellular component=integral to membrane; Biological process=response to antibiotic
  Homolog annotation: Hit_ID=P62577; Match level="QueryCoverage=63%, HitCoverage=99%, E-value=1e-130, Identity=100%"; Hit description =Chloramphenicol acetyltransferase
  Pfam annotation: Domain name=CAT; Domain location=129-332; Score =528.7; E_value=6.6e-156; Accession=PF00302.9; Description =Chloramphenicol acetyltransferase
PGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRAKEAKMEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQGG

SEQ ID NO: 112276 - protein, 53 aa, Glycine max
  Coding DNA Sequence Number=SeqID_20591
MTIICLRMSSGLPPLDDKRVQNDHNLSLRAIGHDCVPNDHNLSSHVNGLAASG

SEQ ID NO: 112277 - protein, 32 aa, Glycine max
  Coding DNA Sequence Number=SeqID_20592
MDQIGLPLGMANKAPTHRILVGNQREKTTLGH

SEQ ID NO: 112278 - protein, 219 aa, Glycine max
  Coding DNA Sequence Number=SeqID_20593
  Homolog annotation: Hit_ID=Q6WAY6; Match level="QueryCoverage=42%, HitCoverage=17%, E-value=4e-14, Identity=41%"; Hit description =Putative uncharacterized protein
MAEVSIEAIASLAQYYDQPLRCFTFGDFQLSPMVEEFEEILGCLLGGRKPYLFSGFYPSSARISKIVQILTQELDHRKQVENGVVGVPRKCLEAKARILAASKKGASVNWFPRWKEGRTEVLISCGGFPNVPLMGTRGCINYNLVLAITQLGYPMRGAPLEEELTHIIPRGFNNTNAEALQKVRKAWEMVQKKDKELRGSNAIMKMASCECSLLRAKTD

SEQ ID NO: 112279 - protein, 277 aa, Glycine max
  Coding DNA Sequence Number=SeqID_20594
MQQPIPRYPSQPFNIHGITLKGKHDENWGQLLAPMINQWNNWVDFRVDSYPRQEGVLSFNSDYMVWYRRKTKMFVDPKNANTATLAKVGETLQYMLSPQGRNTWTVDDPVSYMEKITILSKEQERITKPVSHGPAIEHEFASQDFNILPSSVETQGIGRRREVVEAEPYLYPQMVERGHGMYYTPAISSQYPAQIYHYPFECHQSDTSATEHSLGGVAETYPNFSWPTMTPSQQHDTQIQTPNAPLGTQWTVPGAITDMNELLGVDLRHQFSTEADQ

SEQ ID NO: 112280 - protein, 50 aa, Glycine max
  Coding DNA Sequence Number=SeqID_20595
MVTLINGAFHPSKVAAKAVTLSIRQQFGQPWSTWGVIPKDHQELFSERFM

SEQ ID NO: 112281 - protein, 63 aa, Glycine max
  Coding DNA Sequence Number=SeqID_20596
IVFYCLTVGIFKIITFGLPLSKNGVLSAIPTEGNCAEQPKAALSPIPTERKCAEHPEDALSGP

SEQ ID NO: 112282 - protein, 157 aa, Glycine max
  Coding DNA Sequence Number=SeqID_20597
  Subcellular localization annotation: CTP_CleavageSite=89; ConfidenceScore=5.46e-01
QNQQQQNNYDLSSSRYGSRLEESSKSKTGKSSTTTTACPAFQNGVGPSKPYVPPPMQQQQQQQQRQQATKAPSQPSLEELTVKNSKNVSAITMRSGKQIEVPPLAAAPAPAPEPVKLHSAPEKEDAIVAQKRKLPDQKGANKNFHASGPYSNNSDLQ

SEQ ID NO: 112283 - protein, 76 aa, Glycine max
  Coding DNA Sequence Number=SeqID_20598
MGLDEWDLNTGAINYLLASTRVLPRLPGLLADDSLLRYRLLHLPLRTSPSASTTARSNAWMPLLDTSSLLPSDHYY

SEQ ID NO: 112284 - protein, 323 aa, Glycine max
  Coding DNA Sequence Number=SeqID_20599
  Homolog annotation: Hit_ID=UPI0000ECBAF8; Match level="QueryCoverage =13%, HitCoverage=50%, E-value=5e-17, Identity=100%"; Hit description= UPI0000ECBAF8 related cluster
  Pfam annotation: Domain name=Transposase_23; Domain location=28-98; Score=1.0; E_value=0.00092; Accession=PF03017.5; Description =TNP1ENSPM transposase
  Pfam annotation: Domain name=zf-CCHC; Domain location=228-245; Score =30.4; E_value=6.4e-06; Accession=PF00098.14; Description=Zinc knuckle
  Pfam module annotation: Pfam domain module=Transposase_23::zf-CCHC; Domain location=28-98::228-245
PVVGPGPSSPRVSTKGICVDPSGNDPETGDSDRCGLYIEADPACLVAIGRVYEGSTVVHNTPLFPGQVKVSVEEVRDADAPVPVPTDEVSLVGQTLHTFLAWPTHLVKSLSQQVVVSPPKPPPKPDTEVDDPLYLMTLTIPELFLRPYQVRWDATVFGVVNPDFPLYIKHEDFSEIAHGGQCLSISVLQLWILHLTETCMRAGNSDIYGFLEPQSIQKIQMMKKTSHSLCYKCNQLGHIKANCPSNEEWPEKSDKKSGRHRGGAPIRPIVSRITIHWPSFYNVVTGKTLALPNLIALQHIPLSPAGVIAKRPAPIALPNSCAA

SEQ ID NO: 112285 - protein, 71 aa, Glycine max
  Coding DNA Sequence Number=SeqID_20600
  Subcellular localization annotation: CTP_CleavageSite=29; ConfidenceScore=5.51e-01
MQSAKGAVALSGPLGSVHIHRFSTLSVTRESGRAQESRLRAKREINSLSETFVFSPAKRMTGAKPKSTYSR

SEQ ID NO: 112286 - protein, 61 aa, Glycine max
  Coding DNA Sequence Number=SeqID_20601
MTSRGCHEPSLLAIGPPHGEEHFNQSRIFKIPLGDLIENGTLNPSFVVSLRFSTPKLTNLF

SEQ ID NO: 112287 - protein, 118 aa, Glycine max
  Coding DNA Sequence Number=SeqID_20602
MTSAVSMTEWGADKNKALAPTILRMRGAESTTYSILVRLEKVSTGRLTSPKGRRMTTLASAAINHTWGHEWQRRSEDRKFVSVVIGPSASGSRNRKGVVDKSEANLLLRILHEELRPT

SEQ ID NO: 112288 - protein, 139 aa, Glycine max
  Coding DNA Sequence Number=SeqID_20603
  Gene Ontology: Biological process=transposition, DNA-mediated
  Homolog annotation: Hit_ID=Q1J7G7; Match level="QueryCoverage=21%, HitCoverage=42%, E-value=2e-10, Identity=100%"; Hit description =Transposase
MPQNVLYDAIGIYPTVVYPVIFFSILASLAPENLDNSKNTPGSDLIFIMVKVGTSYVPINVSFSPKVGPGLPGINRDTRIYLFCEVIFRHRCSQWLLFLSAVPPVQLLTGWCVTAKAPPDISAGKCSGHAARNHHTRRA

SEQ ID NO: 112289 - protein, 35 aa, Glycine max
  Coding DNA Sequence Number=SeqID_20604
VLDLLHQWSPLFLEDQWQRNGEEEKVIGDATSRRR

SEQ ID NO: 112290 - protein, 147 aa, Glycine max
  Coding DNA Sequence Number=SeqID_20605
MASKKLSPKRSRRDAAAEGSSATPEFDSHRFRSTEHQQRFEAIKGWSFHRERRVQLREDEYMDFQEEIARRHWTSLVTPMAKFDPEIVLEFNANAWPTEEGVGDMRSWVRGQWIPFDADALSQFLGDPLVLEEGQQCEFGQRRNRAD

SEQ ID NO: 112291 - protein, 140 aa, Glycine max
  Coding DNA Sequence Number=SeqID_20606
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MGEVGYCRNLPFAGERGEAHGPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 112292 - protein, 56 aa, Glycine max
  Coding DNA Sequence Number=SeqID_20607
MWDRHRLKGALKPGDSQGLHFEESVRGLSINSSPLKGLSINSSPLKGLIVVSLYNP

SEQ ID NO: 112293 - protein, 130 aa, Glycine max
  Coding DNA Sequence Number=SeqID_20608
MRWWRCVYGLRCIITLRLSRCTILLNEGRVIGGRITLLGVTGTPNDWQRPVINAGNPRALDQLSHMDAYPCQDGIHQLTLQQREVGVMIVGQDVAEQQHHPHLSQGGHAGAHDPHPSPGSGLGKILTRNA

SEQ ID NO: 112294 - protein, 86 aa, Glycine max
  Coding DNA Sequence Number=SeqID_20609
MQGITWLPKKKSPSGEEAEVPEESEKVQALKAELERMRVVKEKLKTSVTTIRKECDKLGDVNMTTAEALKKETKRARKEEWGKNKF

SEQ ID NO: 112295 - protein, 199 aa, Glycine max
  Coding DNA Sequence Number=SeqID_20610
  Homolog annotation: Hit_ID=Q2HW90; Match level="QueryCoverage=94%, HitCoverage=44%, E-value=3e-15, Identity=27%"; Hit description =Putative uncharacterized protein
MGPSQTPSLKKRFNQVKVKSLGITSLRELGQLMGQLQRQAFRKTYDKIWDLAMVEVSTEAIASLAQYYDQPLRCFTFGDFQLSPMVEEFEEILGCPLGGRKPYLFSGFYPSLARISKIVQISAQELDRQKQVKNRVVGIPRKYLEAKARILAAINTFLAYHNHKERPVVAMLADLYDTFDRRCGKSNTRIVCCTPALYV

SEQ ID NO: 112296 - protein, 108 aa, Glycine max
  Coding DNA Sequence Number=SeqID_20611
MEELFKRWNEYLDSTRSRVNQPLLIICDFCGGEHYNDNCHLYSMNDSRWEHELSPYNQHEEERTPNLESVFEEFMAYHASSKANQNSMKNHEIHFCKSYSLENFQGGP

SEQ ID NO: 112297 - protein, 189 aa, Glycine max
  Coding DNA Sequence Number=SeqID_20612
MGDGQPCRMAESIAGTPIGGEISGRYISTMTSRLFIKICLDHKYPQLFTISKQQNDLISTMGSFYQTIWRWDLKWRRHLFEHEEGVDVAFLDEISAYPIQSHLKDTVLWKAEPTGLYSTRLIKDRLPTRVNLQRRNVGLHESICPLCHEEQEEAGHLFFHCTQTIVLWWETLRWIKAIGAFPFSPASHF

SEQ ID NO: 112298 - protein, 82 aa, Glycine max
  Coding DNA Sequence Number=SeqID_20613
MTGPLNESISCFLIRVDPWVLVPSPSEGYTPSPSEGYTSSPSKDYTRPRLQRATHPHLQRTTCPLHQSTTRPRLQRAARPCL

SEQ ID NO: 112299 - protein, 89 aa, Glycine max
  Coding DNA Sequence Number=SeqID_20614
MAIAGTVKLLAQGITGQALAFFHHQRMTMQIAVRTDALHQGIHRHNQHTALHGRQLVERRQARGDDLLMRREAVIRQRFPVGQAEHQAI

SEQ ID NO: 112300 - protein, 51 aa, Glycine max
  Coding DNA Sequence Number=SeqID_20615
MDKSLKEGEDEWRERERRSTKFCASNESWCPKIQRLKDPTFLGYPTYIVEP

SEQ ID NO: 112301 - protein, 92 aa, Glycine max
  Coding DNA Sequence Number=SeqID_20616
  Gene Ontology: Biological process=transposition, DNA-mediated
  Homolog annotation: Hit_ID=Q1J7G7; Match level="QueryCoverage=35%, HitCoverage=47%, E-value=1e-11, Identity=96%"; Hit description =Transposase
  Subcellular localization annotation: CTP_CleavageSite=22; ConfidenceScore=5.54e-01
MVKVGTSYVPINVSFSPKSWPRASPVSTGTPRIYLFLRSDLPSQVLQWLLFLSAVPPVQLLTGWCVTAKAPPDISAGKCSGHAARNHHTRRA

SEQ ID NO: 112302 - protein, 99 aa, Glycine max
  Coding DNA Sequence Number=SeqID_20617
SSLSQTGLHFCDCNHIVEFMCVKFVSATYRLRVGIDFGSALWFALRLPGRSSYFSFCPKFVFVTNWAVLPSKKTTKGNGGKQFWKSIVVGFKPPREAIE

SEQ ID NO: 112303 - protein, 158 aa, Glycine max
  Coding DNA Sequence Number=SeqID_20618
  Homolog annotation: Hit_ID=A5AK77; Match level="QueryCoverage=44%, HitCoverage=8%, E-value=2e-09, Identity=42%"; Hit description =Putative uncharacterized protein
MTRGNPGDLQSFDPEIDRTFHRLVRHSVHLDHFVHFEHSEYSVAGNSEYSDFEHSTTNFHTENMAQPPPHERTLREMAALDFTYESLCIQYPDEGVPYVLKTRLIHLLPKFHGLAGEDPHKHLKEFHIVCSTMKPPDVQEDHIFLKAFPLSLEGVAKD

SEQ ID NO: 112304 - protein, 66 aa, Glycine max
  Coding DNA Sequence Number=SeqID_20619
MDSGRFQISIPGNGCPSKTFLEEMHQQFFISRVCLHFPIVHLQEVVFPMQNARVVVVGGTEGPPRC

SEQ ID NO: 112305 - protein, 110 aa, Glycine max
  Coding DNA Sequence Number=SeqID_20620
MTRQMQCTSDDKVWVYMRESTWFLEISSSLISNNVAEGTTNDNASSKRKTLDEVSLSSSESETQHDHRSTSTSYIPMDPEKDTPNTKTSKELYGYKNIKERKGNNTKPKS

SEQ ID NO: 112306 - protein, 107 aa, Glycine max
  Coding DNA Sequence Number=SeqID_20621
MIELVKVVDKSEALAPTYPPMRNSDLLADNRKVSPGATSSWVMVTKSGVVDKSKAFAPTYPPMRNSDLLLASHLKEVSLAIRELLKEVFSKKLLKEVFSRKLLKEAT

SEQ ID NO: 112307 - protein, 162 aa, Glycine max
  Coding DNA Sequence Number=SeqID_20622
  Gene Ontology: Mol. function=transporter activity; Cellular component= integral to membrane; Biological process=transport
  Homolog annotation: Hit_ID=A8GGX3; Match level="QueryCoverage=35%, HitCoverage=16%, E-value=1e-13, Identity=62%"; Hit description=Major facilitator superfamily MFS_1
MTSNLLNLRQQRATRTLFFIAGLGMAAWAPLIPFAKAQLAINDGMLGLLLFCIAAGSIGRAVALRRDQRTDGCQHELSGGDRGARGRGQQDVGLSRLLQSWQHCWRRRGESAAVAAGCAPAGAAAAVCVDCIAAADEPYRPVAPSSHGCKTNARYAARPDAP

SEQ ID NO: 112308 - protein, 196 aa, Glycine max
  Coding DNA Sequence Number=SeqID_20623
RLCETETNMLAIISKYQEELNLATTYEHKVADEYARVYVDKEARGRVIDSLHQEATMWMDRFALTLNGSQELPRLLAKAKAMADAYSTPEEIHGLLSYCQHMIDLMAHIIRNHYKEVQEQLKADMSALKEQMASMMDVMLGMRQLMENNGATAATVSSAAEADPTLPATAHHPIPNVVGRERSTLGHISNPHPGYN

SEQ ID NO: 112309 - protein, 74 aa, Glycine max
  Coding DNA Sequence Number=SeqID_20624
MDRFRLVYGLVTGMDMNIGAIISVNFRGARKVRAQPADVPSSSAPPAPPTSATPTPAAHDSQHFEAMLQSIHQG

SEQ ID NO: 112310 - protein, 212 aa, Glycine max
  Coding DNA Sequence Number=SeqID_20625
ADVATVVERVAVAHARLHQPEGVVMDLPGQRGVGAPTAVGGVVVGLGQRAEGLAVGQQVGRAERVQVGQSGNGPRTARAGVGATHDVQARQRIEVHRLQATLDAPGAVVEPRQPDAIDPRQHAVAPVLDLQIVHALAVGARFPCRRRHRAFALDRDRRELRDTRLRQGLQHEYAGAALARGQAAAGQQAGKAVSHGVFPIQARATALAHQRR

SEQ ID NO: 112311 - protein, 148 aa, Glycine max
  Coding DNA Sequence Number=SeqID_20626
  Gene Ontology: Mol. function=oxidoreductase activity, acting on single donors with incorporation of molecular oxygen, incorporation of two atoms of oxygen
  Homolog annotation: Hit_ID=A4WCD3; Match level="QueryCoverage=95%, HitCoverage=100%, E-value=1e-64, Identity=83%"; Hit description =Glyoxalase/bleomycin resistance protein/dioxygenase
  Pfam annotation: Domain name=Glyoxalase; Domain location=9-130; Score= 65.7; E_value=1.6e-16; Accession=PF00903.16; Description =GlyoxalaseBleomycin resistance proteinDioxygenase superfamily
MQMKDIDVGFTHVAFMVRDLEKSMDFYRRYAGMKVIHTREPDVPAARKVAWLSDHTRPFALVLVQADDVSDTPLGKFGHLGIACASREEIDRKTAMAVAEGVLRKAPEEAGEPVGYYVFFADPDGNTLELSFGQRVGLEAIRTAPGLL

SEQ ID NO: 112312 - protein, 93 aa, Glycine max
  Coding DNA Sequence Number=SeqID_20627
MRGNPLAGDLAPLDLEIEATCRRNNAERRRKILQDRTTQPGSEEAQSSESSSIFPEPREPGVGASEVDIMAEDQPRRITLEDYSSSTVPQFFT

SEQ ID NO: 112313 - protein, 104 aa, Glycine max
  Coding DNA Sequence Number=SeqID_20628
  Gene Ontology: Biological process=transposition, DNA-mediated
  Homolog annotation: Hit_ID=Q1J7G7; Match level="QueryCoverage=31%, HitCoverage=47%, E-value=1e-11, Identity=96%"; Hit description =Transposase
MPQNVLYDAIGIYQRCWNLLRADQRLIFAQKLAQGFPGINRDTRIYLFCEVIFPSQVLQWLLFLSAVPPVQLLTGWCVTAKAPPDISAGKCSGHAARNHHTRRA

SEQ ID NO: 112314 - protein, 161 aa, Glycine max
  Coding DNA Sequence Number=SeqID_20629
  Homolog annotation: Hit_ID=Q84VH5; Match level="QueryCoverage=39%, HitCoverage=9%, E-value=9e-16, Identity=71%"; Hit description =Envelope-like protein
VDIAVSEASNCQGNHCQTSPALAKKGKLSAGKLSVKYAILHRIGAANWVPPAILPLLPQGTHVPDIVSTSGKAAASGAVSKDALIAELKDTCKVLEATIKAITEKKMELERLIKRLTDSGIDDGEAAEEEEEAAKEEEEAAEEEEDAAEDTESDDDSEATP

SEQ ID NO: 112315 - protein, 95 aa, Glycine max
  Coding DNA Sequence Number=SeqID_20630
  Subcellular localization annotation: CTP_CleavageSite=64; ConfidenceScore=5.35e-01
VPPCSATDGVVRNGKKPPPDISAGKCSGPPARNHHTPPRLMRRYRARPIRPFRLRNCWEGRSVRASSLLRQLAKGGCASKAIKLGNARVFPVTTL

SEQ ID NO: 112316 - protein, 94 aa, Glycine max
  Coding DNA Sequence Number=SeqID_20631
MLWNLTDYVIIPFFPSGTLQNFMDCALTLPFNFWHVTELHGLCYNTFLLASGMSWNFTNCLTMGAKYLEVVKRGSHPNNGWSSDEIRELMKHWA

SEQ ID NO: 112317 - protein, 83 aa, Glycine max
  Coding DNA Sequence Number=SeqID_20632
MDLCVICGCGESTCTIVRSPPSTTYDRGQETLGTLGGVLFPKTKLDQSRPNPGIASSWQSTDKRTKTTKQGGLCGGWPAMDLE

SEQ ID NO: 112318 - protein, 140 aa, Glycine max
  Coding DNA Sequence Number=SeqID_20633
  Gene Ontology: Biological process=transposition, DNA-mediated
  Homolog annotation: Hit_ID=Q1J7G7; Match level="QueryCoverage=23%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDKSMRCGTVGNSHEQ

SEQ ID NO: 112319 - protein, 18 aa, Glycine max
  Coding DNA Sequence Number=SeqID_20634
LGIRAGHSVMPFIIQSFV

SEQ ID NO: 112320 - protein, 113 aa, Glycine max
  Coding DNA Sequence Number=SeqID_20635
MAHLELSIPWRGSTEQPHRPTYLNYPEGNFGGNQLLDGIVHHLSGPDRYALTRTLHRRSGSVGGATHRGIPPISFLAPYGVYSPVDSHTCQTPWSVFQDGPNGEPTGRRQERA

SEQ ID NO: 112321 - protein, 137 aa, Glycine max
  Coding DNA Sequence Number=SeqID_20636
SILPPTKSCQGSENLSTRVGPGKAKQKWGSRSTKEVFGRKGQRPWQIKANGLSFIDILALLIFGVVLFPNMEGLVDLAAIDAFLAFHHGKESPIVAILAMYDTFDRGCPSIRYKVTARASKRERRIGTNSWLAWRGV

SEQ ID NO: 112322 - protein, 53 aa, Glycine max
  Coding DNA Sequence Number=SeqID_20637
MGSKIYPKVHENPKAFFINSSPILLEPLAHGSGKRAMKERIREAQRVFEGYIE

SEQ ID NO: 112323 - protein, 43 aa, Glycine max
  Coding DNA Sequence Number=SeqID_20638
MEVWEVNVSLLRLSFLFSPMGVRSKRLWLKLAKINTKRGVKDK

SEQ ID NO: 112324 - protein, 123 aa, Glycine max
  Coding DNA Sequence Number=SeqID_20639
  Homolog annotation: Hit_ID=A5BSZ8; Match level="QueryCoverage=84%, HitCoverage=11%, E-value=7e-11, Identity=36%"; Hit description =Putative uncharacterized protein
MSKSNFTSGGLDHNLAMLEEKFVTIIDASSNAKKVHYKAWERSNRLSLMLMRMTVAGSIKTTLPKIESAKSTLVHEETRFKNQESHLVHYVSHQGNQGVGKRLVKKHDRGKGPLKINDNSMQI

SEQ ID NO: 112325 - protein, 33 aa, Glycine max
  Coding DNA Sequence Number=SeqID_20640
MDPKSTLRLMRTLGPSLSSLAQSSWSLLSNDLE

SEQ ID NO: 112326 - protein, 297 aa, Glycine max
  Coding DNA Sequence Number=SeqID_20641
  Gene Ontology: Mol. function=hydrolase activity, hydrolyzing O -glycosyl compounds; Cellular component=anchored to membrane; Biological process=carbohydrate metabolic process
  Homolog annotation: Hit_ID=A5AZB3; Match level="QueryCoverage=30%, HitCoverage=34%, E-value=8e-41, Identity=82%"; Hit description =Putative uncharacterized protein
  Pfam annotation: Domain name=X8; Domain location=209-293; Score =166.2; E_value=8.8e-47; Accession=PF07983.4; Description=X8 domain
MDSRAYILRVTIAILCISMLASTLFPVCDAINHGRAIRGHKIRRSSPIKSLKKLKIKSLRHLNKYTPFDSFGYSDFDSYGYSNFDDSYGSPSSLPLPPFNSLAPHPQPTPSSSIAPPNLAPPSIGGNSSLPALSPVPSSPHGAVFGPPNPRSMPPPPYPLSPPKHAPSLSPPKSAPSLNPPPLVYLPPVVFPPPPSPSTHRKKPPQYALWCVAKPTVPDPIIQEAMDYACGSGADCKSIQPNGMCFQPNTLLAHASYAFNSYWQNTKIGGGTCDFGGTAMLVTVDPSKYLCHIQKYY

SEQ ID NO: 112327 - protein, 182 aa, Glycine max
  Coding DNA Sequence Number=SeqID_20642
  Homolog annotation: Hit_ID=A7PWY1; Match level="QueryCoverage=46%, HitCoverage=11%, E-value=1e-12, Identity=41%"; Hit description =Chromosome chr12 scaffold_36, whole genome shotgun sequence
MAPSDKNQSAKHDSGTSPATHMHEALTPERLDDTNYVEWSLNAQNKIRGRQKTLGQVLASGLHDEGNQIPLYSLSYDKGHLGHCAANILSQPGCVQENGSSVITYFGKLQRLWLEYDTITNRTMECPKDVEKYNDMINYQRVYVFLAGLDSHLDAVHGHIHAITPLPNVQSVYATVCAEANR

SEQ ID NO: 112328 - protein, 425 aa, Glycine max
  Coding DNA Sequence Number=SeqID_20643
  Gene Ontology: Mol. function=monooxygenase activity
  Homolog annotation: Hit_ID=A8HZ86; Match level="QueryCoverage=74%, HitCoverage=92%, E-value=1e-145, Identity=80%"; Hit description =Putative alkanal monooxygenase
  Pfam annotation: Domain name=Bac_luciferase; Domain location=43-392; Score=-0.4; E_value=4.5e-08; Accession=PF00296.11; Description =Luciferase-like monooxygenase
MRIGQGVVAVMCQVRIPVETIRIPHRQRQHAKQLIKVRQARRMAMNQLMLQRQIPGRQFAAPEPAARQLMHHFALLRTEDVLLQSIDLAVAAEELGADGAYFRVHHFARQLSSPFPLLAAVGAKTSRIEIGTGVIDMRYENPLYMAEDAGAADLIANGRLQLGLSRGSPEQVIEGYRYFGFNPREGETDADMGRRHTEELLEVLRGEGFAKPNPQPMFPNPPGLLRLEPYSEGLRERIWWGSGSNATSIWAAQLGMNLQSSTLKDDETGEPFHVQQAKQIRAYKEAWQAAGHQRAPRVSVSRSIFALMNDTDRAYFGRGGQEQDSVGFLDEKTRAIFGRSYAAEPEQLIKQLAQDEAIAEADTLLLTIPNQLGVDYCAHVIDSILTHVAPELGWPINPRPAPTTAYPAHNNGRAAPLAGSSRAST

SEQ ID NO: 112329 - protein, 146 aa, Glycine max
  Coding DNA Sequence Number=SeqID_20644
  Pfam annotation: Domain name=G-patch; Domain location=26-70; Score =16.8; E_value=0.0018; Accession=PF01585.14; Description=G-patch domain
MSFQALEVVSNAYVESPPVQPRSSGATLMVASVMLGHGYEPRMGLGRNDNGMASLVEFTGNRGRFGLGYEPTHIDVRRIALERRVRSMGQRQRLQVKGVPLCHINESFVSMGWMCKGWVTMIHKETPQEQPNWVRPCPLEFELGNW

SEQ ID NO: 112330 - protein, 145 aa, Glycine max
  Coding DNA Sequence Number=SeqID_20645
  Homolog annotation: Hit_ID=O52175; Match level="QueryCoverage=56%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGVGSSLQAGLYARTPRSVRPLRLIRVTIRLESNPERTCKSTLAAATGN

SEQ ID NO: 112331 - protein, 128 aa, Glycine max
  Coding DNA Sequence Number=SeqID_20646
  Subcellular localization annotation: CTP_CleavageSite=48; ConfidenceScore=5.04e-01
MDRAMLIFGLVSRMDMNIEALISGQMTSIAQSSTSRVGFPALITALCRARGVVSNSLTFERLSPIINLAYIRKSCWNPKDLTVSIRGARRVRVVAPTRSIPSVEQFLKSVAWPGTQPSLHREDEGPTT

SEQ ID NO: 112332 - protein, 62 aa, Glycine max
  Coding DNA Sequence Number=SeqID_20647
  Homolog annotation: Hit_ID=A7NZK0; Match level="QueryCoverage=56%, HitCoverage=38%, E-value=2e-09, Identity=80%"; Hit description =Chromosome chr6 scaffold_3, whole genome shotgun sequence
MVQSSCPLSSLFSSVHRDKNISLQHNIGHRKDLEDPPTHESRDLSENGFLFEGCITAWISSH

SEQ ID NO: 112333 - protein, 187 aa, Glycine max
  Coding DNA Sequence Number=SeqID_20648
TKIGQSAPLYHPEPPGPMIRGDTLRVAFCTLVSSRGGGPDDKQRPKTKIGHSAPLYHPEAAGPMIRGDTLRLFAPFCHPEAAGPMTSRDQVWSFCTLVSSRGGGPDDTRRYLMVIRTLLSSRGGGPDDKQRPKAAGPMTSRDQVWSFCTLVSSRGGGPDDTRRYLTVIRTLLSSRGGGPDDKQRPSL

SEQ ID NO: 112334 - protein, 115 aa, Glycine max
  Coding DNA Sequence Number=SeqID_20649
  Homolog annotation: Hit_ID=Q5NRP4; Match level="QueryCoverage=86%, HitCoverage=7%, E-value=4e-07, Identity=31%"; Hit description =Putative gag-pol polyprotein, identical
MEVRDKVELLPYRDLVDLVQLCIRVEQQLKRKPTSKSYGSHSYIKKDQGQGILGAAPSKPKDDKGKTIEKQPPKASIGHIASQCPFEKTMIMRGQDIYSSQDEIVVHVAIVVAQD

SEQ ID NO: 112335 - protein, 120 aa, Glycine max
  Coding DNA Sequence Number=SeqID_20650
MVHDISVKVKLEVTRTSTILNMFGSRRSSDVTRFIFCPNFARRDAYAMHDMNAFYGHESPENYLFLLAHFAVQCPMCTIKKVIWTFRLPVTKDETNIQCMLEIKCGSDLIRTDFWSKNVG

SEQ ID NO: 112336 - protein, 77 aa, Glycine max
  Coding DNA Sequence Number=SeqID_20651
MAPHFYSKLQGEAIFGVVKHTSMLWDFEFQVEKWEILRVREAKFGVSGNWSLKWLDSSLKCQLGLVGKLGRANEKNE

SEQ ID NO: 112337 - protein, 162 aa, Glycine max
  Coding DNA Sequence Number=SeqID_20652
  Gene Ontology: Mol. function=N-acetyltransferase activity; Cellular component=ribosome; Biological process=metabolic process
  Homolog annotation: Hit_ID=Q5PM16; Match level="QueryCoverage=100%, HitCoverage=100%, E-value=2e-82, Identity=88%"; Hit description =Putative acetyltransferase
  Pfam annotation: Domain name=Acetyltransf_1; Domain location=54-137; Score=76.0; E_value=1.3e-19; Accession=PF00583.15; Description =Acetyltransferase (GNAT) family
MSEIVIRHAEPKDYDAIRQIHAQPEVYHNTLQVPHPSLEMWQMRLGDQPGIKQLVACIDDIVVGHLTIDVAQRPRRSHVADFGICVGAQWHNRGVASALIRTMIDMCDNWLRVDRIELTVFVDNEPAIAVYKKHGFEIEGTGKRYALRNGEYVDAYYMARMK

SEQ ID NO: 112338 - protein, 201 aa, Glycine max
  Coding DNA Sequence Number=SeqID_20653
MGEVEEIQEKMKADMEAIKEKMATMMEAMMSVKKIMEANAVAIAATSVVAKVNPTSPSGINQMNHPTSDMVGKDLGSMGGPHDVQIQNEHTFPPYGLPLNYTPPNVAYTPNKNTHEIPHHNLADFEPWLGYATEGQAVGGIPLENTSEGPQYHPQLHLLHSTTSKNPRAMAEMEKLDHLEERLRAIEGGEDYAFANLKSCS

SEQ ID NO: 112339 - protein, 67 aa, Glycine max
  Coding DNA Sequence Number=SeqID_20654
  Gene Ontology: Biological process=transposition, DNA-mediated
  Homolog annotation: Hit_ID=Q1J7G7; Match level="QueryCoverage=44%, HitCoverage=42%, E-value=6e-10, Identity=96%"; Hit description =Transposase
LPGIQQGTPRIYLFCEVIFRHKWLLFLSAVPPVQLLTGWCVTAKAPPDISAGKCSGHAARNHHTRRA

SEQ ID NO: 112340 - protein, 38 aa, Glycine max
  Coding DNA Sequence Number=SeqID_20655
MAQERTWMSCVLLEQICQDSYHQTFLAMVVCKESVDCC

SEQ ID NO: 112341 - protein, 242 aa, Glycine max
  Coding DNA Sequence Number=SeqID_20656
MAKFDPDIVLEFYVNAWPTEEGVWDMRSWGDPLVLEEGQECEFSQRRNRVDRFDEEAIAQLLCILGQDFARIAAEKRVQIMRTIMTTLTQMWMTLLLSNVLPSDHNSNLPLSKCQLVYAILTRMSVHGPGVSSIDHGPLPVIQGFPSHLGDAPQAADAPPPPHQADPVGSFGMERYLQHLVRQQAANHRGQVQIHECLYQLSLNQQSQGFAPFACLTPDQFRAEAGEAPAEAPGDAEEARMD

SEQ ID NO: 112342 - protein, 40 aa, Glycine max
  Coding DNA Sequence Number=SeqID_20657
MESSTVTTCPFTGEQGEAHGSTKAGLLLLRTLIEEENRPT

SEQ ID NO: 112343 - protein, 108 aa, Glycine max
  Coding DNA Sequence Number=SeqID_20658
MTSTRCVRVVSSKKWRLRKPSRVYGYHCIIEWTWNQVNIGHRNLGEFYRFFFAAKLISWRVFLDCAKGMAFVDNWAVGKEKVPLELPGLSTFGRILLKDSCPLFAHVL

SEQ ID NO: 112344 - protein, 84 aa, Glycine max
  Coding DNA Sequence Number=SeqID_20659
MGIAPTKTLNGPKEVQQALGFPALVTGLCRPYRAPVPPNKDCARKTPSGPEEGQQGLELPALNTGLCRHRAKHHSSIGMAGSGQ

SEQ ID NO: 112345 - protein, 189 aa, Glycine max
  Coding DNA Sequence Number=SeqID_20660
MGSRLPGLCGVDYNGKKHHIRVRKFSNRVYIADGLKHFRRDMGIYEGVMITFAAPDKNWKFDIHFSPPLHAQTCGRPVHSAREYVFTVDVDNRMIVRLYPLVLPLDVVGYVNAGDGYVTVLGVCGHCHFWKLSMHNGLKCFADPWFQFLTENDLMAGDEVVFYFRPNQLLWEVIARKQTVWDEDEDDSP

SEQ ID NO: 112346 - protein, 230 aa, Glycine max
  Coding DNA Sequence Number=SeqID_20661
  Homolog annotation: Hit_ID=Q84VI1; Match level="QueryCoverage=68%, HitCoverage=27%, E-value=3e-66, Identity=73%"; Hit description =Envelope-like protein
IKLPKEITAKRVQHWPKKGKLSAGKLSVKYAILHRIGAANWVPTNHTSTVATESFAIKLPIAFPTVLCGIMLSQHPNMLNYTDSVMKRESPLSLHYKLFEGTHVPDIVSTSVSTSGKAAASGAVSKDALIAELKDTCKVLEATIKATTEKKMELELLIKGSQRVALIMKKQLRKKEKQLKKKKKLLRKRKMQQKRQNPMMILKPPHDHQTFNFGELYEYEFEGETAADDD

SEQ ID NO: 112347 - protein, 219 aa, Glycine max
  Coding DNA Sequence Number=SeqID_20662
MPGRSFDSCGSRISFFTYWVTLCLLTKSATNVHVVYLEALRDLSMTERYAWGVAALVDCDEEDREEHSHDVVQGAPRLTPDSECLLDPLWGASGGPGLPRQIMLFRVVRQFGYTQTIPAPPVDSWVSYDDIHDRWMHYEDHMVLVGEVCVVSVACSSDYIDWFFRISHPFMTPGHTLDPLPHGHALHPRVIPQAPQTDIPPVPEPGALSTSVEDPRHAV

SEQ ID NO: 112348 - protein, 81 aa, Glycine max
  Coding DNA Sequence Number=SeqID_20663
  Homolog annotation: Hit_ID=Q3E8F7; Match level="QueryCoverage=34%, HitCoverage=6%, E-value=2e-07, Identity=96%"; Hit description =Uncharacterized protein At5g46630.2
MPVAASAIYFLNLRGDVLINRLYRDDVGRETCRASCINESANARGEAVCVLALAECILAYYVGTDEGVSEVLHVAEKKAAP

SEQ ID NO: 112349 - protein, 162 aa, Glycine max
  Coding DNA Sequence Number=SeqID_20664
VLSYSNLALTSHTSDLTVDRARLILGLVIQLDMNVGALISGQITSMAQSNSSRLKFPALITALCRRPRARLAEVPSTSAAPHPTSTSAAPPPAHSIPTVEQFNEWVVWPGTQPPLHREDEDPTAQEAAATSEKSLEATPEPSTLVADTTSPQQAADPSMHED

SEQ ID NO: 112350 - protein, 122 aa, Glycine max
  Coding DNA Sequence Number=SeqID_20665
LRRWTSNHLTRSTKAGFLLLRILHRRGNQTYVVLANAVKLHVDFMLFERSMLTDKSKEDRLRHWTLSQCALLRVSEARLTGVLSKGGKMRGVGTNVYLWKTSEKPKETGQNENSKFGSCIYA

SEQ ID NO: 112351 - protein, 101 aa, Glycine max
  Coding DNA Sequence Number=SeqID_20666
MLGKLGRIDGDPMLRETRIWATWEYVSSVGGGQQGMVGLCAIYGMWKICCAPSPDRHLVPHVMEWYLEICRGGQETLGTSGGCYCPKPSLTIPTNPGIVGQ

SEQ ID NO: 112352 - protein, 230 aa, Glycine max
  Coding DNA Sequence Number=SeqID_20667
  Homolog annotation: Hit_ID=Q2HW90; Match level="QueryCoverage=90%, HitCoverage=39%, E-value=1e-23, Identity=36%"; Hit description =Putative uncharacterized protein
MDILALLIFGVVLFPNVDGLVDRAAIDAFLAFYDLKESPVVAILADLYDTFDRRCEKNNARIVCCTSALYIWLVSHFFCQEMRHVCPLEGHRSCIEKKEANWDRLLASKEGESVNWFPQWKEGRTKILISCGKFPNVPLKGTRDCIIYNPVLAIRQLGYPMRGAPSEEGLIPFITRGFNSTNTGVLQRVHKAWEMSQRKDKELRGVATGPSAVTIVVESLRTRSRLGSRV

SEQ ID NO: 112353 - protein, 64 aa, Glycine max
  Coding DNA Sequence Number=SeqID_20668
MGLSSSKREIVEAMPSKVILMMPKNQELRKFQRFKNQVSRIKIQDSRLKIQESRIKRRLNQDKY

SEQ ID NO: 112354 - protein, 174 aa, Glycine max
  Coding DNA Sequence Number=SeqID_20669
  Homolog annotation: Hit_ID=UPI000069F178; Match level="QueryCoverage =57%, HitCoverage=22%, E-value=9e-07, Identity=36%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
  Subcellular localization annotation: CTP_CleavageSite=66; ConfidenceScore=5.44e-01
MLVRMIRTRLFAAARVKSCPSMHSSSVIASLSSVLAQCASSNIRGWPRNPSDGEDVVVLSRRGRVVLSTVRARTCSPLMVRACSPLMVRTRSPLRRGRVVLSTVRVRACSPLMVRTCSPLKARTCSPLNGEGRVALSRPGRVVLSTVRVRACSPLMVRTCSPLKARTCSPLNGE

SEQ ID NO: 112355 - protein, 81 aa, Glycine max
  Coding DNA Sequence Number=SeqID_20670
MEQYLRHLFAAGSNYRAHSQGFASFSCPTPDQFRAEVAWPRDWPEAQAGEAPPEAPGDGEEAHEDEEMADLLDFLGGSGAT

SEQ ID NO: 112356 - protein, 58 aa, Glycine max
  Coding DNA Sequence Number=SeqID_20671
MYTERRLALSTLISSKLNEPGIVIYCHYLPVSGLGNLRAAAFLGCGSRFSGSLSGIEP

SEQ ID NO: 112357 - protein, 368 aa, Glycine max
  Coding DNA Sequence Number=SeqID_20672
  Gene Ontology: Mol. function=unspecific monooxygenase activity
  Homolog annotation: Hit_ID=Q9AVH2; Match level="QueryCoverage=53%, HitCoverage=75%, E-value=1e-56, Identity=56%"; Hit description =Putative senescence-associated protein
LGKPLVEILPPGQLRGFCPLLAWLGSAVLGYGPVLSFGLVGPLLPPVISFVARILPTLACAPLAKSVPRWQNEREPTNGSLFWPNIVEEERDTGLIGEGRIKATRAESQWIVAARPLCHLQYPVAYLSRLQRILPAARWELRFKASRRANPPHEGHQRHVPLGGRGPLLLGKTNLSHDGLNPAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLD

SEQ ID NO: 112358 - protein, 202 aa, Glycine max
  Coding DNA Sequence Number=SeqID_20673
  Homolog annotation: Hit_ID=Q2HW90; Match level="QueryCoverage=37%, HitCoverage=14%, E-value=4e-09, Identity=46%"; Hit description =Putative uncharacterized protein
MELKTPLREFERDHHEYMACPSWGIRKLYLCSSPRGVSSLTLEAGVKHASICGRQTHGVVRTVADNTSRRQGRDMASQEKWVPFADILALLIFGVVLFPNIDGLVDLAAIDAFLAYHHSKESAVVAILADLFDTFDRRSEKNSARIVCCLPALCVWLISHLFQQDEAAQSIGFLDGRKEGGVLFLMWGLPYVPLIGTRVVLL

SEQ ID NO: 112359 - protein, 59 aa, Glycine max
  Coding DNA Sequence Number=SeqID_20674
GLSGPGSAKHQSLTGFECLEAKRILQKIVVLQKALSVACCTKPQMLTGLYNFKLGLAQG

SEQ ID NO: 112360 - protein, 302 aa, Glycine max
  Coding DNA Sequence Number=SeqID_20675
RVRGHLVKIDADCLNTFLETPVVLAKDYREIEAALCIPGRGFILNVEGHPGRILRKDLTTLAQVWSVLSYSNLAPTSHTYDLTVDRSRLIFGLVSRIDMNIGALISGQMTSIAQSNTSRLGFPALITALCRAKGFLSKGLRGRGLGQLSFLPHLQLLLQHPLQQVVAPPGSIPSIEQFKEMVAWPGTQPYLHREDEGPTSQVPQHVEDESSKATIPEPFDLGEEAGETQVRHVVAATPERSLEATSEPPAPVVDLPSPQHTTVPSTPILEVPKEPTTPVLAMDTSPPTTPVLHLTDEEDVQT

SEQ ID NO: 112361 - protein, 206 aa, Glycine max
  Coding DNA Sequence Number=SeqID_20676
  Gene Ontology: Biological process=transposition, DNA-mediated
  Homolog annotation: Hit_ID=Q6UUU1; Match level="QueryCoverage=29%, HitCoverage=40%, E-value=2e-18, Identity=78%"; Hit description =Putative uncharacterized protein
VLQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112362 - protein, 183 aa, Glycine max
  Coding DNA Sequence Number=SeqID_20677
MDASAGGKIKLKTPEEAMDLIENMAASDIAILRDRAHIPTKKSLLELTSQDALLAQNKLLFMQLEALIETLRCTICGGAHESGCYIPIEEQTTHEGQWRNHPRNQFNRDQGGPSTRPRQQGPSLYDRTVKLEETLAQFIQVSMSNQKSTDSAIKNLEVQVGQLAKQLADRSLFGRDKCTRSRK

SEQ ID NO: 112363 - protein, 84 aa, Glycine max
  Coding DNA Sequence Number=SeqID_20678
MDSPDLPEDNVDPLPDVDSLENIMPASEADSTEESGPGGTTNSLISSSHLRIRRSKSPTFVDHPKRSLMVQRLNVSLLSEPRDR

SEQ ID NO: 112364 - protein, 113 aa, Glycine max
  Coding DNA Sequence Number=SeqID_20679
HELEIYLKAYENPRAFPWISSPIYLESSIQCPCGAHENLRAFSCIFGPIFLESSIQCPWGVAWPRAQPSPSGGGGASAAQEPTSKEPAAVAAEGEDELTPPKLFCFDADAHIA

SEQ ID NO: 112365 - protein, 227 aa, Glycine max
  Coding DNA Sequence Number=SeqID_20680
  Homolog annotation: Hit_ID=Q84VH5; Match level="QueryCoverage=82%, HitCoverage=31%, E-value=5e-94, Identity=83%"; Hit description =Envelope-like protein
ILPAVINKYLDRPTDGVVDIAVSEHQIAKEITAKQVQHWPKKGKLSAGKLSVKYAILHRIGAANWVPTNHTSTVATESFAIKLPIAFPTVLCGIMLSQHPNMLNYTDSVMKRESPLSLHYKLFEGTHVPDIVSTSGKAATSGAVSKDALIAELKDTCKVLEATIKATTEKKMELERLIKRLSESGIDDGEAVEEEVEAAEEEEDAAAEEEEDAAEDTESDDDSEATP

SEQ ID NO: 112366 - protein, 84 aa, Glycine max
  Coding DNA Sequence Number=SeqID_20681
MASGNRLPRVGNRLQGLKSEDRKLRWPLIVMAAQLIHDRVEMECLEGAWETLEGNTRCRFRGMIHLRPLHWCIQMNPRARFSVL

SEQ ID NO: 112367 - protein, 49 aa, Glycine max
  Coding DNA Sequence Number=SeqID_20682
MKMFLIPHDVAPLELVAKWRRRRVERRRHFKEKMSQEEAHHHRKPWIRA

SEQ ID NO: 112368 - protein, 195 aa, Glycine max
  Coding DNA Sequence Number=SeqID_20683
  Gene Ontology: Mol. function=transcription activator activity; Cellular component=intracellular; Biological process=regulation of transcription, DNA-dependent
  Homolog annotation: Hit_ID=A6T9N6; Match level="QueryCoverage=92%, HitCoverage=61%, E-value=8e-91, Identity=95%"; Hit description =Putative transcriptional regulator
  Pfam annotation: Domain name=HTH_11; Domain location=26-79; Score =4.8; E_value=0.063; Accession=PF08279.3; Description=HTH domain
  Pfam annotation: Domain name=HTH_IclR; Domain location=23-110; Score =91.6; E_value=2.5e-24; Accession=PF09339.1; Description=IclR helix -turn-helix domain
  Pfam annotation: Domain name=Rrf2; Domain location=21-121; Score= -36.1; E_value=0.058; Accession=PF02082.11; Description =Transcriptional regulator
  Pfam module annotation: Pfam domain module=HTH_11::HTH_IclR::Rrf2; Domain location=26-79::23-110::21-121
MSDNTHTTLSARQAEHDPNFMLSLARGLEVLNAFTPQRQRLTISQLSQKTQISRAAVRRCLYTLAALGMVHSPDGRSYELLPRVLAVGHAYLAGTPLAKVAQTALDNLGKTLGESCSAATLDGDNVLYIARAAVNNLLSVDLGRGSRLPAWTTSMGRVLLSALPEEQLEVTLSRAHLMRYTRIPCATPRHNARNS

SEQ ID NO: 112369 - protein, 44 aa, Glycine max
  Coding DNA Sequence Number=SeqID_20684
MVIFSHEVEAEDKGEKMNGSEMEKEERKEMPLQGEDESRRSSPP

SEQ ID NO: 112370 - protein, 32 aa, Glycine max
  Coding DNA Sequence Number=SeqID_20685
MADGKLIEMKGRINLGLKGFEKPNLDLVVIGG

SEQ ID NO: 112371 - protein, 228 aa, Glycine max
  Coding DNA Sequence Number=SeqID_20686
  Homolog annotation: Hit_ID=A4W649; Match level="QueryCoverage=94%, HitCoverage=57%, E-value=1e-122, Identity=93%"; Hit description =Cupin 4 family protein
  Pfam annotation: Domain name=Cupin_4; Domain location=1-228; Score =269.2; E_value=8.6e-78; Accession=PF08007.3; Description=Cupin superfamily protein
  Pfam annotation: Domain name=JmjC; Domain location=48-138; Score= -21.1; E_value=0.05; Accession=PF02373.13; Description=JmjC domain
  Pfam module annotation: Pfam domain module=Cupin_4::JmjC; Domain location=1-228::48-138
MGPFEHFDDLGETGWSLLAQAVNHWHMPAAELVRPFRVLPDWRLDDLMISFSVPGGGVGPHIDQYDVFIIQGMGSRRWRVGDKLPMRQFCPHPALLHVDPFEPIIDEDLAPGDILYIPPGFPHDGFTHETALNYSVGFRGPNGRDLISSFADYALENDLGGEHYSDPDLTCREHPGCVEQYELDRIRQMMIDMIGKPDDFTKWFGSFVSTPRHELDIAAAEPPYAPEE

SEQ ID NO: 112372 - protein, 158 aa, Glycine max
  Coding DNA Sequence Number=SeqID_20687
  Pfam annotation: Domain name=Transposase_23; Domain location=51-121; Score=6.6; E_value=0.00023; Accession=PF03017.5; Description =TNP1ENSPM transposase
  Subcellular localization annotation: CTP_CleavageSite=34; ConfidenceScore=5.29e-01
MASFNHMQSQFQSQMQSQGLAVPPEPLVGPSGPRMSTKGSCVDPSGNDPETGDSDRCGLYIEADPARLVAIGRVYEGSTVVHNTPLLPGQVKVSVEEVTDVDAPVPVPTDEVSLVRQALHTFLAWPTHLVKSLSQQVVCVSGKTTFEARSGGSMIRFI

SEQ ID NO: 112373 - protein, 94 aa, Glycine max
  Coding DNA Sequence Number=SeqID_20688
TLVSTATPLGLEVIPQVKELLDEGVPTDPKRIKVIPDWPTPPTPLIELVRNNVPLWEDVHERGVEGRSPEYDEPRDLRSNPFQGGGDDAILPPK

SEQ ID NO: 112374 - protein, 91 aa, Glycine max
  Coding DNA Sequence Number=SeqID_20689
MAPTRHPLDPDKSNRALGFPALITGLCQSFGVPVALSRFKEEVAWPGDWPEARAGEAPTEAPAEAPDEANEARKDEEMADLFDFLGGSGAT

SEQ ID NO: 112375 - protein, 91 aa, Glycine max
  Coding DNA Sequence Number=SeqID_20690
MSARVQPIVFLCFLRTDNNFSSCSSAREADIITGKLLLSSKLQFWCGRLDSGGRGWFLSLYLIKKVRGKTPPPGMQSISLSDSLSASNSDI

SEQ ID NO: 112376 - protein, 99 aa, Glycine max
  Coding DNA Sequence Number=SeqID_20691
  Subcellular localization annotation: CTP_CleavageSite=81; ConfidenceScore=5.12e-01
MPISPCKSISWVCVVPTWGSHPQDTQWTRKVQQGPGVSSSGYEPLSVLQGARTPPARSCHPDIVLRSACRPNKVIRPRINRAFIKKYCAPRRAQGETPQ

SEQ ID NO: 112377 - protein, 69 aa, Glycine max
  Coding DNA Sequence Number=SeqID_20692
LSLSQQSQGFAPFACPNLDHFRAEVAWPRDWPEAQVGEAPVEAPGDAEEARTDEEMIDLLGFLGGSGAM

SEQ ID NO: 112378 - protein, 135 aa, Glycine max
  Coding DNA Sequence Number=SeqID_20693
MITRGQDIYSSQEETTFSPSSSGSEDEVRGEESSEEVYPHEEGDLLMVRRLLGVSKLNLTIIPHPKPYKLQWLNEQGEMIVNQQVKVAKDQLTMKDKRDEEEKLEKQKKKKDSKALSSKAKGEEKEEKRFLQEDC

SEQ ID NO: 112379 - protein, 206 aa, Glycine max
  Coding DNA Sequence Number=SeqID_20694
  Homolog annotation: Hit_ID=A6N1H4; Match level="QueryCoverage=17%, HitCoverage=33%, E-value=2e-13, Identity=100%"; Hit description =Retrotransposon protein
MGDKLHRREGNSPDHQLRPLNDRSVIKEVGVQRQPGSALAPKMNGLSDLPKLWDVKKIGRGAFRLRGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSREPTTEAPVNGGRNYNGPKVAKFLV

SEQ ID NO: 112380 - protein, 316 aa, Glycine max
  Coding DNA Sequence Number=SeqID_20695
  Homolog annotation: Hit_ID=Q84VH5; Match level="QueryCoverage=100%, HitCoverage=52%, E-value=3e-93, Identity=57%"; Hit description =Envelope-like protein
MTTSPKETAASGSPAVPSSPHQEQPEFNIQPIQIIPGQASVPEKLVPRRQQGVKIAENPSLATSPREVDTEMDKKIRGCSDILRSNAEALPSPSEEESTEEEDQASEETPAPRAPEPAPGDLIDLEEVESDEEPIANRLAPGIAERLQSRKAKTPIKRSGRIKTMAQKKSTPITPTTSRRSKVAIPSKKRKEISSSDSDDDVELDVSTSKRAKKSGRKVPGNVPDAPLDNISFHSIGNVEKWKYVYQRRLAVERELGRDALDCKETMDLIKAAGLLKTVTKLGDCYEGLVREFIVNIPSDISNRKSDDYQRVFVRG

SEQ ID NO: 112381 - protein, 150 aa, Glycine max
  Coding DNA Sequence Number=SeqID_20696
MTLLLSNILPSDYNSDLPLPKCQLVYAILTQMSVHVAQLIADAIYLFVGMPPTRHPLDLDKSNRALGFPALITGLCQSFGVPVTPNKSQGFAPFACPTPDQFRAEVACPGDWPEAQAGEAPVEAPGDTEEARMDEEMTDLLDFLGGSGAT

SEQ ID NO: 112382 - protein, 62 aa, Glycine max
  Coding DNA Sequence Number=SeqID_20697
MDGILISSVAGVVLAEVLLADSRFTRPGYGFSPNKLNFVPSDADERHSMFPFACMPLVMWGV

SEQ ID NO: 112383 - protein, 97 aa, Glycine max
  Coding DNA Sequence Number=SeqID_20698
MVMGGFHQQTLLPRSEFLNGGYVGERASLLSTTPPFVAMTQELVIRGDPLQLSAPRHSVTPSVIDEQRPIWSFAPFPEMSTSSGGDFFKSHKLSRTT

SEQ ID NO: 112384 - protein, 85 aa, Glycine max
  Coding DNA Sequence Number=SeqID_20699
WIASGGSNPARLGELSGNLFSLFPINRLKGAVLRGPDPPGDDSTVLGKKIVFVKNPSRGLPYAPRVSNNPEISTVSSFFVRLRFQ

SEQ ID NO: 112385 - protein, 42 aa, Glycine max
  Coding DNA Sequence Number=SeqID_20700
MTDMENPPLRSFMALLVCNEIMVLDQESIEGDTIGNGVRKSW

SEQ ID NO: 112386 - protein, 69 aa, Glycine max
  Coding DNA Sequence Number=SeqID_20701
MSHPIRALCLDVLQQKEYITRHTTQWVCQATMFCENAPTIWDQHRLKGALKPGDPQGLHSEESIRVSPS

SEQ ID NO: 112387 - protein, 88 aa, Glycine max
  Coding DNA Sequence Number=SeqID_20702
ELNTADMIRCYIAERSVPVLIDGDRHEGQSFRLSEFPSTMPEMFSDALRSGVEKYGSDREVNLLCQGTKLSALSDTELDAAKVPTLAQ

SEQ ID NO: 112388 - protein, 169 aa, Glycine max
  Coding DNA Sequence Number=SeqID_20703
  Homolog annotation: Hit_ID=UPI00006A2D9E; Match level="QueryCoverage =84%, HitCoverage=85%, E-value=1e-16, Identity=18%"; Hit description =UPI00006A2D9E related cluster
MTKDKNWYLKALHWGREDKPWHFRGLHVLTFRGLHALAFEGLHILAIGGLHALTFRGLHVLTFRGLHVLAFRGLHALAFREQHVLAFKGLHALTFRGLHALTFRGLHALTFRGLHALSFRGLQGLAFRGLHVLAFRGLHALTFRGLHALTFRGLHVFAFRGLHVLAFRG

SEQ ID NO: 112389 - protein, 132 aa, Glycine max
  Coding DNA Sequence Number=SeqID_20704
MATAEALERETKKARKEEHDELKAYLRSKRNLSQQLSETEGNMWAVIDECKEKLNLAATHEQRLEDEYAKISAEREARERVIDSLHQEATMWMDRFALTLNGSQELPRLLAKAKAMADTYSAPEEIHGLLGY

SEQ ID NO: 112390 - protein, 194 aa, Glycine max
  Coding DNA Sequence Number=SeqID_20705
  Subcellular localization annotation: CTP_CleavageSite=54; ConfidenceScore=5.32e-01
WSNPSQQQQQQPYFQNAASPSRPYVPPPIQQQQQPQKQQTVKAPPQPSLEELVRQMTMQNMQFQQETRASIQSLTNQMGQLATQLNQQQSQNSDRLPLQSVQNPKNVSAIALRSGKQCQGPQPATSSSSANEPAQLHSTPEKDDDKNLKSKLPNNFYAGESKEKQHIPPPFPPRAISNKKMEETEKEIWKHLEK

SEQ ID NO: 112391 - protein, 91 aa, Glycine max
  Coding DNA Sequence Number=SeqID_20706
GESDLSTNPSQEGENDEDMTKSKGKDPLEGLGGPMTRARARKAKEALQQVLSILFEYKPKFQGEKSKVGPIGNLGINLLGDQMVAGLMAVG

SEQ ID NO: 112392 - protein, 126 aa, Glycine max
  Coding DNA Sequence Number=SeqID_20707
  Homolog annotation: Hit_ID=Q5QJQ3; Match level="QueryCoverage=60%, HitCoverage=89%, E-value=5e-28, Identity=59%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPTRKDMQKHHWQQPLVIDLEELVLKSCAGKG

SEQ ID NO: 112393 - protein, 267 aa, Glycine max
  Coding DNA Sequence Number=SeqID_20708
  Homolog annotation: Hit_ID=Q2HW90; Match level="QueryCoverage=80%, HitCoverage=41%, E-value=6e-23, Identity=33%"; Hit description =Putative uncharacterized protein
MVNQEEWVPFVDVLALLIFGVVLFPNVDGLVDLAAIDAFLAYHHSKESPVVAILADLFDTFDRRCEKSSAQIICCLPALCVWLVSHLFHQDIRHPCPLRSHHLCVEKRRVDWDQYLAGIGGRTINWFPRWKEGKEGVLFSCGDYPNILLIGTMGCINYNPALAIRQLGYPMRGALAEESLSPFLVRDFGTQSFKIIQRVHKAWESPLRKDKELRGIRNGIIGGYHEWLPRSYTRTFGKSVSSYEKEMQIPQEPLNKKPRGLARKSTT

SEQ ID NO: 112394 - protein, 112 aa, Glycine max
  Coding DNA Sequence Number=SeqID_20709
  Homolog annotation: Hit_ID=A2Q1D6; Match level="QueryCoverage=67%, HitCoverage=12%, E-value=4e-07, Identity=40%"; Hit description =Ovarian tumour, otubain, related
MNEDQWTYYSAMSAEVDMDFRDEEDCGVNEAHIDCSDAFNTSQVFATREDVLKWAQTVAHENDFVAVIMRSDTYTGSRGRTSFVLIGCERSGKYKCRKKEFVRRDTGTRKCG

SEQ ID NO: 112395 - protein, 172 aa, Glycine max
  Coding DNA Sequence Number=SeqID_20710
METCLAVEDLLQQMIDRGRLEVGNEGSEEQHICIQSVEEGSFGRPKPLVVFLTKGAAPQRPDTLQYHTVPWRYAPPSERKEEATDISSLSAKVTNIMGLSSVTRSSHVFAPPDLPTQPTNAKGKAKIAEEQNDKAIPAPDEDIPMKSPSEKKDGCGKKEVSLEEAGEFLHII

SEQ ID NO: 112396 - protein, 231 aa, Glycine max
  Coding DNA Sequence Number=SeqID_20711
IRNGIIGGYHEWLKVHIRGLDWLAKLKVVSKESFEAPEEDEEVQALKSELGKAKLAKEKFKLAATHVRKECAGLREENAITARALEQETKRARKEEYGRNKFRGALWGSNSELKLRKEERDQSSKRSLSQRLCETETNMLAIIAKYQEELGLAAAHEHRIADEYAQVYAEKEARGRVIDSLHQEATMWMDRFALTLNGSQELPRLLAKAKAMADTYSAPEEIHGLLGYVSI

SEQ ID NO: 112397 - protein, 123 aa, Glycine max
  Coding DNA Sequence Number=SeqID_20712
MGIAPTRHPVDPEKSNRALGFPALVTGLYQSYRVPVPPGKGIAPARHPVDPKESPKQGLGGCQALITGLCQFYGVPVTSSKGIRPPTNRAFIKKYCAPDRRRAKHHSSIGMVGSGKQTHRHHL

SEQ ID NO: 112398 - protein, 101 aa, Glycine max
  Coding DNA Sequence Number=SeqID_20713
HPEQLAHTLQQPVEWILPTPTPCRLVELVQVIEVSSSEGDLEEDPEELPPEPAMDAPDLPEDDEDPVPDVDSPEDIMSASKANSTEESGPGGIAISDNSSS

SEQ ID NO: 112399 - protein, 70 aa, Glycine max
  Coding DNA Sequence Number=SeqID_20714
MSWDPISCGKETSLSTVIPLKFEVIPQVKELLDEGLVCIMRHRIPMIGGIMNVLVVQPSFVKSLMHPASS

SEQ ID NO: 112400 - protein, 211 aa, Glycine max
  Coding DNA Sequence Number=SeqID_20715
  Pfam annotation: Domain name=zf-CCHC; Domain location=44-61; Score =19.6; E_value=0.0017; Accession=PF00098.14; Description=Zinc knuckle
LGTKDYNNQGIQESSYNDDGSSLRKSKERKFSKSSKKIENNNNYTCFKCGKKSHIKSECPIYLRKHGEKKGKKDIKQKKAYRAWEDGVSTTSNSSSDEEIANIYLMAKFMNDPSTNEETKLKSELKLSSTPGEMNELKQENEKLVSKCKATTCDDTSTSLNMDAPLELVGLSSSSMNSFASWKMNGSGMEKEEREEMPLQGEDESRRSSPP

SEQ ID NO: 112401 - protein, 34 aa, Glycine max
  Coding DNA Sequence Number=SeqID_20716
GIGKEDWCHPLKNLSQEARGQPVTTRLVATISPL

SEQ ID NO: 112402 - protein, 75 aa, Glycine max
  Coding DNA Sequence Number=SeqID_20717
MGEVEEVQEQMKADMEAMKEKMATKMEAMMSMKKIMEANVVAVVATSAVAKVAWPGDQSSSSRRGGGLCIPRAYD

SEQ ID NO: 112403 - protein, 78 aa, Glycine max
  Coding DNA Sequence Number=SeqID_20718
  Homolog annotation: Hit_ID=A5BKB8; Match level="QueryCoverage=43%, HitCoverage=9%, E-value=6e-11, Identity=91%"; Hit description =Putative uncharacterized protein
MGGGAWPFLVGGAICLVNSVNERDLSLLNSYVEVCDALRCSGPHARYTDVFNESIALADSSRWLPFVGSLSFCLPGAN

SEQ ID NO: 112404 - protein, 164 aa, Glycine max
  Coding DNA Sequence Number=SeqID_20719
  Homolog annotation: Hit_ID=Q949K7; Match level="QueryCoverage=24%, HitCoverage=45%, E-value=7e-08, Identity=62%"; Hit description =Putative gag polyprotein
MACLPNYTPPNVAYIPNEDVNNSTPILIKSQQPQSDHAHVSRPMEETHGMPHHNLADFEPCLGYATEGQAVCGIPLQNTLEGPQCHPQPQPSHSTTVKNPHAMAEMGKRKGSGPLKRVVLVPNIITPPKFKVLDFDKYKGTTCPKNHPKMYCRKIRAYAKMRNC

SEQ ID NO: 112405 - protein, 111 aa, Glycine max
  Coding DNA Sequence Number=SeqID_20720
MGDIDKVQEQMKADMEALKDQMTSMMEAILGMKRMMESNMAVVAATSVVTEADQTHPSAINQANQPIPAMVGQGGEVLDSTDGGTREEPQDHAQVDFEPYPIFATKEPACS

SEQ ID NO: 112406 - protein, 256 aa, Glycine max
  Coding DNA Sequence Number=SeqID_20721
  Gene Ontology: Mol. function=D-arabinono-1,4-lactone oxidase activity; Cellular component=membrane; Biological process =biosynthetic process
  Homolog annotation: Hit_ID=Q22YW5; Match level="QueryCoverage=87%, HitCoverage=49%, E-value=9e-50, Identity=41%"; Hit description=FAD binding domain containing protein
MDRMLASSPGVIAVQTLAGALATGTHGQGLAQSSLADEALHIRMVLADGSVREFQRDDADFPAAMVSLGALGIVTAITLRTQPFRLFTCHKFAASADSLEQDLLTWNEQHELSKAWWFVDDNLMHVWNADVASAEDSQAWHDHQREVIEHGDQADSSLNDTIDQTLEHMHRDTQIHGKGGKQFRTVTRFRDFTDISGDIYQLFCRGIAVPQINVEIGVPLAKTPEISARSKPGTHRIVRTCTIPSSCAAPALHRRG

SEQ ID NO: 112407 - protein, 273 aa, Glycine max
  Coding DNA Sequence Number=SeqID_20722
  Gene Ontology: Mol. function=2-dehydropantoate 2-reductase activity; Cellular component=cytoplasm; Biological process=pantothenate metabolic process
  Homolog annotation: Hit_ID=A5NSY8; Match level="QueryCoverage=93%, HitCoverage=82%, E-value=8e-53, Identity=43%"; Hit description=2 -dehydropantoate 2-reductase
  Pfam annotation: Domain name=ApbA; Domain location=3-151; Score =179.7; E_value=7.6e-51; Accession=PF02558.7; Description =Ketopantoate reductase PanEApbA
  Pfam annotation: Domain name=ApbA_C; Domain location=176-272; Score =7.3; E_value=1.9e-05; Accession=PF08546.2; Description=Ketopantoate reductase PanEApbA C ter
  Pfam annotation: Domain name=F420_oxidored; Domain location=2-189; Score=-59.2; E_value=0.069; Accession=PF03807.8; Description=NADP oxidoreductase coenzyme F420-dependent
  Pfam module annotation: Pfam domain module=ApbA::ApbA_C::F420 _oxidored; Domain location=3-151::176-272::2-189
MRILIVGAGATGGYFGARLAQAGRDVTFLVRERRQQQLQQTGLVLQTPEGSTVLQPQLALASTLTGDYDLIILTVKSFALEQAMEDIAPAVGAQTLIMPILNGMRHIDTLRARFGDKMIGGLCKIHATLGEHGEVMQLSPLHVLYYGALDGNNDARLQRVDAALRDAQFDSVFADNIISELWEKWLLLSTLGAVCCLARGNTQHILRSAGGEALLQGIFAEVLAVITADGYQQRPAVTAKIYETLNNPDAAMTSSMCICRRGDRSGAWRAWCA

SEQ ID NO: 112408 - protein, 101 aa, Glycine max
  Coding DNA Sequence Number=SeqID_20723
MHIMRCTEESGGGWLLRGKNVMLYCRERETTITLYREIMTYLIFVIFIDLSMLLPNNHNYHPLRINNVFNRILDARMKLIQHWNIPSDGSLLVGLLWRLDL

SEQ ID NO: 112409 - protein, 172 aa, Glycine max
  Coding DNA Sequence Number=SeqID_20724
  Homolog annotation: Hit_ID=Q6WAY3; Match level="QueryCoverage=93%, HitCoverage=5%, E-value=1e-07, Identity=29%"; Hit description =Gag/pol polyprotein
  Pfam annotation: Domain name=G-patch; Domain location=43-82; Score =22.6; E_value=0.00035; Accession=PF01585.14; Description=G-patch domain
MPYVEATEESLETAFQSFEVVSISSVDSFSGQPCLSDVAVMMARVMLGNGYEPGMGLGKDNGDITSLINAKGNRGKYGLGYKATQADIKRSIAGRKSGSQSSRLRQEGEGSPPCHISRSFISAGLGDEGQVVAICEDDVPSTLDLVRPCPPGFQLGNWRMEERPDIYAMSIM

SEQ ID NO: 112410 - protein, 167 aa, Glycine max
  Coding DNA Sequence Number=SeqID_20725
  Homolog annotation: Hit_ID=A5B939; Match level="QueryCoverage=23%, HitCoverage=24%, E-value=5e-07, Identity=69%"; Hit description =Putative uncharacterized protein
TGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQNCALNVKVKKFKPSAGKRRDETTAKGTGLAESAGKEDPVELDSSPTL

SEQ ID NO: 112411 - protein, 75 aa, Glycine max
  Coding DNA Sequence Number=SeqID_20726
MSLHVLYLYVFSRYPPGIPRLLYLSLQSFKEGQDHLELPSGVETKHEQQEPIKVHRDGCEWGWGHDRLIVAPSLR

SEQ ID NO: 112412 - protein, 129 aa, Glycine max
  Coding DNA Sequence Number=SeqID_20727
MKDKRDKEEKLEKQKKKKDSKALSSKAKGKKKEEKDSSKKIVKKENHFATKGDIKKALLLKQSFYLLLSRETSLSTAIPLELKVIPQVKELLDEGLVHKSLSPCALLVPKIGIIRHQIVEASFMMLNQD

SEQ ID NO: 112413 - protein, 101 aa, Glycine max
  Coding DNA Sequence Number=SeqID_20728
MKKAYITWDDNDMESSEDSENEEINLCLMAKSYESDEEENKDVSPIRLEWDINLKNNKNFIKTSLLPHKNIILVISLVFTVEEKGMAYLLATLRKTTTTLK

SEQ ID NO: 112414 - protein, 103 aa, Glycine max
  Coding DNA Sequence Number=SeqID_20729
  Subcellular localization annotation: CTP_CleavageSite=34; ConfidenceScore=5.06e-01
MKQQARFSNRSIATLMTGRKRGTTREGRIGYAVSAESKTPTCPGVPSIAHQLPSSTTATTPKVVGLLLIAILPEIRRELVVDKYRIGPGVVELVGEHNHGWSE

SEQ ID NO: 112415 - protein, 93 aa, Glycine max
  Coding DNA Sequence Number=SeqID_20730
  Subcellular localization annotation: CTP_CleavageSite=56; ConfidenceScore=5.09e-01
MDPVKYIFEKPALTRQIARWQVLTTRTTWPSMRRAPLGSKWKLTSRSSYSREENQMADAVATLVSMFQLTPHGDFPYIEFRCRGKPAYCCLIE

SEQ ID NO: 112416 - protein, 120 aa, Glycine max
  Coding DNA Sequence Number=SeqID_20731
  Gene Ontology: Biological process=transposition, DNA-mediated
  Homolog annotation: Hit_ID=Q1J7G7; Match level="QueryCoverage=38%, HitCoverage=78%, E-value=1e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDVGIEECKS

SEQ ID NO: 112417 - protein, 85 aa, Glycine max
  Coding DNA Sequence Number=SeqID_20732
  Subcellular localization annotation: CTP_CleavageSite=36; ConfidenceScore=5.44e-01
MKENKAKLAVLSARISICGKGKLSLGLTRFKSWMSRASSSSAFVVPGNTQDLECRNLPFGGRATRDSRDACSTKGIRAESPPTFI

SEQ ID NO: 112418 - protein, 122 aa, Glycine max
  Coding DNA Sequence Number=SeqID_20733
MSTSDHAILRDKTHQPTKKSLLVLTSHDALLAQNKLLSKKLEILTETLGCTICGEAHEIGQCIPTNDNTQEIHFMGNQQRQGYTQGGFSGFQQGPYNQQGQWRTHPGNQFNKDQGGSSNEPI

SEQ ID NO: 112419 - protein, 203 aa, Glycine max
  Coding DNA Sequence Number=SeqID_20734
  Gene Ontology: Mol. function=indole-3-glycerol-phosphate synthase activity; Cellular component=chloroplast; Biological process =tryptophan metabolic process
  Homolog annotation: Hit_ID=Q1GYF7; Match level="QueryCoverage=99%, HitCoverage=74%, E-value=4e-78, Identity=75%"; Hit description =Indole-3-glycerol phosphate synthase
  Pfam annotation: Domain name=IGPS; Domain location=1-201; Score =321.4; E_value=1.6e-93; Accession=PF00218.12; Description=Indole-3 -glycerol phosphate synthase
MLQASPSKGVIREDFRPAEIAASYEQGGAACLSVLTDEQYFQGSADYLKQARAACSLPVLRKDFMIDAYQVFEARAMGADCILLIAAALTLAQMQQLEAVAHGLGMAVLVEVHNGEELEQAIQLTTPLLGINNRNLRTFEVTLDTTLGLLEKISGDKIVVTESGIFTAEDVKLMRDHAVHTFLVGEAFMRQDNPGAELAKVFA

SEQ ID NO: 112420 - protein, 516 aa, Glycine max
  Coding DNA Sequence Number=SeqID_20735
  Gene Ontology: Mol. function=hydrolase activity; Cellular component =extracellular space; Biological process=metabolic process
  Homolog annotation: Hit_ID=Q1H2M9; Match level="QueryCoverage=46%, HitCoverage=91%, E-value=2e-70, Identity=55%"; Hit description=HAD -superfamily subfamily IIA hydrolase, hypothetical 2
  Pfam annotation: Domain name=Cons_hypoth95; Domain location=64-268; Score=-59.6; E_value=0.0094; Accession=PF03602.6; Description =Conserved hypothetical protein 95
  Pfam annotation: Domain name=Hydrolase; Domain location=198-480; Score=23.1; E_value=0.00067; Accession=PF00702.17; Description =haloacid dehalogenase-like hydrolase
  Pfam annotation: Domain name=MTS; Domain location=76-253; Score=14.0; E_value=5.8e-10; Accession=PF05175.5; Description=Methyltransferase small domain
  Pfam annotation: Domain name=Methyltransf_11; Domain location=108 -230; Score=11.9; E_value=0.0065; Accession=PF08241.3; Description =Methyltransferase domain
  Pfam annotation: Domain name=Methyltransf_12; Domain location=108 -228; Score=23.8; E_value=0.00065; Accession=PF08242.3; Description =Methyltransferase domain
  Pfam module annotation: Pfam domain module=Cons_hypoth95::Hydrolase::M TS::Methyltransf_11::Methyltransf_12; Domain location=64-268::198 -480::76-253::108-230::108-228
MARQQLAQLVPQDEAGIEARLLLMHVLEVNHAWLLTHATDTPAEIHAQTFQRHVQRRLQGEPVAYILGYREFFGLKLRVTPDTLIPRPDTEILVETALAKVTPGMQVLDLGTGTGAIALAIAQQAPRVLVTAVDASQDALSVAESNLKYLQLHNVSLCLSHWFDALPQRVFDLIVSNPPYIEDSDPHLNQGDLRFEPPSALASGADGLQDIRHIVAHATNHLHPGGWLMLEHGYNQADAVQQLLNTHGFRAVETIKDLGGQPRLTIGQWPGRKPLIPGALSAVAQLRKAGIAVRFVTNTSTLSLDSLQQKLNDLGFNTVPEEIMSAPQATIQYLKKQANPVCKLLLADDVKKDFACFDQSATAANYVVIGDIGDQWSYELLNEVFHCLVNGAQLIAIHKNRFWQTETGLQMDIGAFVTGLEYASNTQAMLMGKPSRHFFNQVVDTLRLKPSDIVMVGDDIDADVGGAQDAGLHGILVKTGKYRETYTRLSAVEPDAIIQSVADLPALLGCLSIPAH

SEQ ID NO: 112421 - protein, 105 aa, Glycine max
  Coding DNA Sequence Number=SeqID_20736
MMQSYPAIALDRRLQVDWTRDAREGPRFLMSLRIKVSLFLGVEAMSSKVILMMPKNQESSKIQRFKNQVSRIKIQDSRFKNNQDQDSRLKGRLNQDKYKKAFPKH

SEQ ID NO: 112422 - protein, 141 aa, Glycine max
  Coding DNA Sequence Number=SeqID_20737
  Subcellular localization annotation: CTP_CleavageSite=33; ConfidenceScore=5.10e-01
MRRTRLLLRTLLLATTIFFQMDFSLDISSGCVRRSGGVNTRPLRVTLLSPVILVTLADNELMLVASSFLSLGGAYLQGTAWLFRYGNGTGLTTEGYQGFLGAASLVKYTTKGLGLPKLLSSTNCIHICCSSLPSSPTSSQP

SEQ ID NO: 112423 - protein, 203 aa, Glycine max
  Coding DNA Sequence Number=SeqID_20738
PTKGVGRLRQQDGGHGSRNPLRRRGGRCKTQGASPGGAVVGADLGGTGEARLIALCARTPKGNRPAHPGNGSAGGRVQRLEEHRTSRGVREVGKWIRNLGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 112424 - protein, 71 aa, Glycine max
  Coding DNA Sequence Number=SeqID_20739
MDTSEPYTGAMKGTMQKPQSNLGQIISSHPIGSLLQGHDERQRLVPSYKVMTKDNNWYLKALHWGNEGHRA

SEQ ID NO: 112425 - protein, 167 aa, Glycine max
  Coding DNA Sequence Number=SeqID_20740
  Subcellular localization annotation: CTP_CleavageSite=19; ConfidenceScore=5.13e-01
MGSPPASTTPPPPPTSDASASTSTPPGVERPVVHVDPAIGKVDGPYKKKLRTYLGIVARDRWTSPTRLEGGPYCSEGPDLGGYSDLMRKWALAADQDGVEDTVCDKYDISKEKWAQFCQTRRDPSWEDVRSKAQAIQKQNIAPHVLSRGGYDYLEQKLLAEKTKKKL

SEQ ID NO: 112426 - protein, 101 aa, Glycine max
  Coding DNA Sequence Number=SeqID_20741
MAIVKEFYANLYDPDDKSPKQVMVRGHLVKFDEVTLNTFLKTPVVLEEGENLCTYFRFALLRPDPQELAGKLCIPGRGFELNANGQPLKILRKNMTTLAQI

SEQ ID NO: 112427 - protein, 83 aa, Glycine max
  Coding DNA Sequence Number=SeqID_20742
MCGWFHTFFSKEVGPSIRYKVTARTLKKERGCINYNPGLAIRQLGYPMRGVPSDESITPFIARGFSDHNARVLQGVCKAWDAA

SEQ ID NO: 112428 - protein, 68 aa, Glycine max
  Coding DNA Sequence Number=SeqID_20743
MFLQKAVASGGSNLARLGELGSKLLPHFTINTGRREEQKCSTLLVSEIHLKLVRKIVSVKKIQAEALP

SEQ ID NO: 112429 - protein, 79 aa, Glycine max
  Coding DNA Sequence Number=SeqID_20744
  Subcellular localization annotation: CTP_CleavageSite=52; ConfidenceScore=5.01e-01
MSSEYWRSKLPFLGLPSSCFLKKVHQVKVMYGSNQLANRGKDESSYIATLFNANTFRTVDVPVTSSFTLTKMSWTMLKI

SEQ ID NO: 112430 - protein, 87 aa, Glycine max
  Coding DNA Sequence Number=SeqID_20745
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=50%, HitCoverage=5%, E-value=4e-18, Identity=95%"; Hit description =Photosystem I P700 chlorophyll a apoprotein A1
MQSDVWGSISDQGIVNHITGGNFAQSSITINGWLRDFLWAQASQPRALSIVQGRAVGSNTLPSRWNCHNMGILLSKNYCSRIIARRI

SEQ ID NO: 112431 - protein, 22 aa, Glycine max
  Coding DNA Sequence Number=SeqID_20746
MQEQEKMSQEQAHHHRKQWIRA

SEQ ID NO: 112432 - protein, 96 aa, Glycine max
  Coding DNA Sequence Number=SeqID_20747
MWKRIRRVELVLWMRCWLRNDELLKPKRRRMNPYISIGEIKRKLKKKKIASYGSRFDEEMNKIGWFEGLGMEERRKGEEAAQRFLKNVIFIDQDAL

SEQ ID NO: 112433 - protein, 48 aa, Glycine max
  Coding DNA Sequence Number=SeqID_20748
  Homolog annotation: Hit_ID=A5AFY1; Match level="QueryCoverage=97%, HitCoverage=20%, E-value=1e-07, Identity=59%"; Hit description =Putative uncharacterized protein
MAGDKSKLSDFVSKDGGYVTFGDNNKGKITGEENIGNQHKIQIKNVLY

SEQ ID NO: 112434 - protein, 241 aa, Glycine max
  Coding DNA Sequence Number=SeqID_20749
  Homolog annotation: Hit_ID=Q84VI1; Match level="QueryCoverage=51%, HitCoverage=18%, E-value=2e-60, Identity=93%"; Hit description =Envelope-like protein
LALERELGRAAMDCKEIMDLIKAAGLLKTVSKLGDCYEGLVREFIVNIPSDISNRKSDDYQRVFVRGKCVRFSPAVINKDLGRPTDGVIDIDVSEHQIAKEITAKRVQHWPKKGKLSAGKLSVKVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEILNR

SEQ ID NO: 112435 - protein, 91 aa, Glycine max
  Coding DNA Sequence Number=SeqID_20750
VPPVQLLTGWCVTAKAPPDISAGKCSGHAARRVPFAIQAAQLLGRAIGAGLFAITPAGERGMCCKAIKLGIRSLGNNVHGAPKKGENGGLP

SEQ ID NO: 112436 - protein, 56 aa, Glycine max
  Coding DNA Sequence Number=SeqID_20751
MAHHPPMCWDKEFSGGEGKNQKNSQAVSPLNSLGREKRDTKEFRRLVLVFFWQREK

SEQ ID NO: 112437 - protein, 33 aa, Glycine max
  Coding DNA Sequence Number=SeqID_20752
MAVVEVEVVQYNQRASMGDKLLAAVCPGCLHLS

SEQ ID NO: 112438 - protein, 360 aa, Glycine max
  Coding DNA Sequence Number=SeqID_20753
  Gene Ontology: Mol. function=sequence-specific DNA binding; Cellular component=nucleus; Biological process=regulation of transcription, DNA-dependent
  Homolog annotation: Hit_ID=A7LHF8; Match level="QueryCoverage=76%, HitCoverage=94%, E-value=1e-153, Identity=94%"; Hit description=WRKY9
  Pfam annotation: Domain name=FLYWCH; Domain location=227-295; Score =4.9; E_value=0.022; Accession=PF04500.7; Description=FLYWCH zinc finger domain
  Pfam annotation: Domain name=WRKY; Domain location=238-297; Score =154.9; E_value=2.2e-43; Accession=PF03106.6; Description=WRKY DNA -binding domain
  Pfam annotation: Domain name=WRKY; Domain location=70-128; Score =145.5; E_value=1.5e-40; Accession=PF03106.6; Description=WRKY DNA -binding domain
  Pfam module annotation: Pfam domain module=FLYWCH::WRKY::WRKY; Domain location=227-295::238-297::70-128
  Subcellular localization annotation: CTP_CleavageSite=22; ConfidenceScore=5.10e-01
VSAQASQANSNMHIQAEHSLTQAPAAASNTTQQLMPPLTSDSWAAMTESIDHSHSEQRLQSSLLNVDKPADDGYNWRKYGQKQVKGSEFPRSYYKCTNPNCPVKKKVERSLEGHVTAIIYKGEHNHQCPHPNKCSKDTMTSNENSNMQGNVDSTYQGTSTNSMSKMDPESSQATADRLSGTSDSEEVADHETEVDEKNVEPEPKRRKAEVSQSDPPSSHRTVTEPRIIVQTTSEVDLLDDGYRWRKYGQKVVKGNPYPRSYYKCTTQGCNVRKHVERASTDPKAVITTYEGKHNHDVPAAKTNSHTMASNTASQLKSHNTNPEKHNFGSRGMGGNEQQPVLDDDVLLVPFVYIESVSYVV

SEQ ID NO: 112439 - protein, 138 aa, Glycine max
  Coding DNA Sequence Number=SeqID_20754
  Homolog annotation: Hit_ID=Q6UUU1; Match level="QueryCoverage=47%, HitCoverage=52%, E-value=1e-17, Identity=63%"; Hit description =Putative uncharacterized protein
MAYERGGDFLEDARKILNREVRGPRQSRFSIGSAPLTSITKSDAQISGGETRQDYKDTRAFPPGGLPRALSCSCLSVYRAVRSKLDCMHEPPVQVPTAAPYPETIVLSPTRKDLQSTTGSSHWELIRGVSLEVMRRLG

SEQ ID NO: 112440 - protein, 135 aa, Glycine max
  Coding DNA Sequence Number=SeqID_20755
MDNEEGVQEQMKADLSALKNQMASIMEAMLKLQKAIEDNAMAAASNTAREAEPVLQPVLNLGRDRNTTVFGSEDPTPHELPQPDIVRHVPSPPAPVKEFVPFAKDKGKIDLLEERLRALEGLDNYPFSDLADLCL

SEQ ID NO: 112441 - protein, 197 aa, Glycine max
  Coding DNA Sequence Number=SeqID_20756
  Gene Ontology: Biological process=transposition, DNA-mediated
  Homolog annotation: Hit_ID=Q1J7G7; Match level="QueryCoverage=15%, HitCoverage=42%, E-value=4e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLVQAWVMVWCMDSLSLSPYTIQKIDVLNVNITSKHGLRNPIKLIDTVDLEGGPVGKPVVPAALMNRPTRGERRFAYWALAECILAYYVGTDEGVSEVLHVAGEKRLH

SEQ ID NO: 112442 - protein, 81 aa, Glycine max
  Coding DNA Sequence Number=SeqID_20757
MMIGCGITWMLLKLGRIDGDPALKGAGVRATWEYVSSVGGGQQGMVEWYLEICRGGQETLGTSGGVLLPKPILSNPDPTRA

SEQ ID NO: 112443 - protein, 202 aa, Glycine max
  Coding DNA Sequence Number=SeqID_20758
  Homolog annotation: Hit_ID=A2Q5X7; Match level="QueryCoverage=32%, HitCoverage=6%, E-value=2e-07, Identity=41%"; Hit description =Ovarian tumour, otubain, putative
MDAWESLVDCPSKHQFDDCLKKFEIVCSSWPMFVDYANQTWIIPHKEKFVEAWMNKVMHLGNTTTTHRLSFSDQGLSEPQVTITEEMEILSKQFEEFDVCGKVTQKSKLQKIVYPDLNFMCPPPEKVNTKGAQKKPMTKYQRSTKRDPFYWEYVDALHSMQNSNSSIKRSASSSDQAIPRRTMSMLDQFHPFIHDSIENIVD

SEQ ID NO: 112444 - protein, 93 aa, Glycine max
  Coding DNA Sequence Number=SeqID_20759
  Homolog annotation: Hit_ID=Q2A9Z4; Match level="QueryCoverage=91%, HitCoverage=14%, E-value=8e-08, Identity=39%"; Hit description=Zinc knuckle family protein
MTIEESIHVSFDESNAILPRKDFLDDISDSLEDTHIHGNDSKEKDEGSNEDSQDNGARGNNELPREWKASRDHPLDNIIGDISKGKNLKIILS

SEQ ID NO: 112445 - protein, 123 aa, Glycine max
  Coding DNA Sequence Number=SeqID_20760
MVKYDPEIVMEFYANAWPTEEGVRDKCSWVRGQWIPFDKDAINQFLGHPLVLEEGQHCEAGLFPKHSGEIGANHAHQHDHPNVDLDALLLSNILPSDHNSDFPLPKCQLVYAILTQGSRLLDI

SEQ ID NO: 112446 - protein, 301 aa, Glycine max
  Coding DNA Sequence Number=SeqID_20761
MKREKYASYSSHNSCNSLSEELRDYYEGRHRSHLRPHSHRREKERKPQEANINLPYFHRKDNVEANLDWEIRVEQQLKKKSMSKSYGSHSYPKKNQGQGILGVTPSKPKDDKGKTIEKQAPKAKDTLLSQCPTTKTMIMRGQDIYSSQDEATTSPSSSESEEAKREESSEEIYPQEDGQPLVVKEKCKEVSVSSKTLAKKETHFTIKTNIKETFPLRQPPHFLFCKKTLASIATPLGLEFFPQIKKLLDEGLVRKSLNPCAFLVPKIGIIRHQVPKIGGMMNVLSGATLFCKITRTPNIFM

SEQ ID NO: 112447 - protein, 145 aa, Glycine max
  Coding DNA Sequence Number=SeqID_20762
MGLLEYRKENAELRDINVATTKALEQETKRACREEHDWNKSKRNLSQWLCETETNMLAIVSRYQEELNLATTHEHRVADEYAQVYAEKEARGRVIDSLHQEATMWMDLFALTLNGSQELPRLLAKAKAMADTYSATEEIHELLGY

SEQ ID NO: 112448 - protein, 50 aa, Glycine max
  Coding DNA Sequence Number=SeqID_20763
  Homolog annotation: Hit_ID=A5BCI2; Match level="QueryCoverage=88%, HitCoverage=3%, E-value=2e-09, Identity=59%"; Hit description =Putative uncharacterized protein
MIISSERCVTSEEAKGILWHYHNSPCGGHYGGDKTAAKVLQSGFFWPTHF

SEQ ID NO: 112449 - protein, 123 aa, Glycine max
  Coding DNA Sequence Number=SeqID_20764
  Homolog annotation: Hit_ID=Q6UUU1; Match level="QueryCoverage=48%, HitCoverage=40%, E-value=9e-19, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNSLQAGLYARTPVSPTLRLI

SEQ ID NO: 112450 - protein, 61 aa, Glycine max
  Coding DNA Sequence Number=SeqID_20765
MSDMPFRGLKSARKRAAFSGKRDELAKRACCAKRRAYCAKRVHPLRMNTHPLAELPMAKRG

SEQ ID NO: 112451 - protein, 153 aa, Glycine max
  Coding DNA Sequence Number=SeqID_20766
  Homolog annotation: Hit_ID=A0PAV3; Match level="QueryCoverage=18%, HitCoverage=14%, E-value=6e-07, Identity=89%"; Hit description =Restriction endonuclease
MFFTMPLGYINGVGTSYVPINVSFSPKVGPGLPGINRDTRIYLFCEVIFRHSCPSCSATDGVVRNGKKHRRTSALASVAVTLRVTTTPAALNAPLQGASHSPFRLRNCWEGRSVRASSLLRQLAKGGCAARRLSWVTPGFSQSRRCKTTASEL

SEQ ID NO: 112452 - protein, 110 aa, Glycine max
  Coding DNA Sequence Number=SeqID_20767
  Homolog annotation: Hit_ID=Q86AI8; Match level="QueryCoverage=59%, HitCoverage=9%, E-value=8e-07, Identity=40%"; Hit description =Similar to Homo sapiens (Human). Mucin 2
MDPWVLVPSSSEGCSPPPSEDYMSSPSEDYTSSPSEGYMPSPTEDYTSSPLEGYTPSPSEGCTPLPSEGCMSSPSEGCMPSPLEGCTPLPLEDYTSSRLEDTCPRHQRIT

SEQ ID NO: 112453 - protein, 116 aa, Glycine max
  Coding DNA Sequence Number=SeqID_20768
  Homolog annotation: Hit_ID=A0PAV3; Match level="QueryCoverage=32%, HitCoverage=17%, E-value=5e-07, Identity=76%"; Hit description =Restriction endonuclease
  Pfam annotation: Domain name=Ins_element1; Domain location=48-109; Score=-23.7; E_value=0.028; Accession=PF03811.4; Description =Insertion element protein
MVKVGTSYVPINVSFSPKVGPGLPGINRDTRIYLFCEVIFPSQWLLFLSAVPPCSATDGVVRNGKSTAGHQRWQAAQLLGRAIGAGLFAITPAGERGMCCKAIKLGNARVFPVTTL

SEQ ID NO: 112454 - protein, 311 aa, Glycine max
  Coding DNA Sequence Number=SeqID_20769
MGFVTWWEKYYSTRSVGDTTIMISRLESGFIQPTVENIRSNLQARGKTIMTKKSAETSRADVRPKKPTGVKIQEWKQEEKEEEERPLIRKRKLPATSTKSTEQTEAGNSQAQMPKKKKKVKQVEPEPSVAVEGGEPIKKKKKKTKPSKEQGDNQPVDVQPPSTDIDGTEVEATPSIAEMGNPVDQPDSLQEQPAVEVQQNVSVEEIPSHARTSPAPETDTVNVEEQGEGQGIGSSSPHGSSQQSSSEENFSDEEAIKEAEAGGSDIYPASSTSKLSASIGIAEDTFIQMQDEDPAAALRILLNTSQANTSR

SEQ ID NO: 112455 - protein, 88 aa, Glycine max
  Coding DNA Sequence Number=SeqID_20770
MKSSTLFALFLLSAIFTSYLPSATAGDLVDTDGLMATLLKMEEHTNYVAVHFDQFRNRRFVVIEVQEHGLWVMFQKLEYASGLTLSSA

SEQ ID NO: 112456 - protein, 382 aa, Glycine max
  Coding DNA Sequence Number=SeqID_20771
  Gene Ontology: Mol. function=enoyl-[acyl-carrier-protein] reductase (NADH) activity; Cellular component=chloroplast; Biological process =metabolic process
  Homolog annotation: Hit_ID=A7NZZ8; Match level="QueryCoverage=99%, HitCoverage=99%, E-value=1e-154, Identity=73%"; Hit description =Chromosome chr6 scaffold_3, whole genome shotgun sequence
  Subcellular localization annotation: CTP_CleavageSite=34; ConfidenceScore=5.62e-01
MATTVSNLPTAMSRPKIPSSQRIANVGPALLGARSKVGSCYKLASVCHVASAQPFQQGLTMTSGAVKYDKIITKAMSESSSNKEVAGLPIDLKGKRAFIAGVADDNGYGWAIAKSLAAAGAEILVGTWVPALNIFESSLRRGKFDESRKNSSFFRLQDGSLMEIAKVYPLDAVYDSPEDVPEDVKANKRYAGATNWTVQEVAESVKKDFGTIDILVHSLANGPEVSKLLSETSRKGYLAALSASNGSAISLTYIASERIIPGYGGGMSSAKAALESDTRVLAFEAGRKKRIRVNTISAGPLGSRAAKAIGFIDMMIDYSFTNAPLQKELHAEEVGNTAAFLSSPLASAITGAVIYVDNGLNAMGVGVDSPIFKELDIPKEHH

SEQ ID NO: 112457 - protein, 279 aa, Glycine max
  Coding DNA Sequence Number=SeqID_20772
  Gene Ontology: Mol. function=protein binding
  Homolog annotation: Hit_ID=A7R1Y2; Match level="QueryCoverage=94%, HitCoverage=84%, E-value=2e-50, Identity=43%"; Hit description =Chromosome undetermined scaffold_384, whole genome shotgun sequence
  Pfam annotation: Domain name=DUF506; Domain location=37-241; Score =211.6; E_value=1.8e-60; Accession=PF04720.3; Description=Protein of unknown function (DUF506)
MKRVTDPFDHQARARLVGTDHRQITSAAQGDSDSLSLSCLIHGFLEQDTTNDDSDSVIHDSDWDPVDSVDDSPDSPSNSPSLSFLHSNNADPYRNLLIAHVSEALESLAFLRERNASLFRRSVAAFLRERRHDAAVCETARDSSGGSHEFIDVVQTGSATCRYFVDLDFRAQFEIARPTRRFSEALAAVPGVFVGGAEELKRTVSTACDAARRCFRSRGLPVPPWRKNRFMQNKWFGPCRRTARDTSMGFNGGVSCRVVGFDDVVSEAGRGGGVVVRTR

SEQ ID NO: 112458 - protein, 879 aa, Glycine max
  Coding DNA Sequence Number=SeqID_20773
  Gene Ontology: Mol. function=DNA binding; Cellular component=nucleus
  Homolog annotation: Hit_ID=A2Q342; Match level="QueryCoverage=91%, HitCoverage=98%, E-value=0.0, Identity=54%"; Hit description =Homeodomain-like
MESIQQNYNDDSMEHSSSSPPGSPDISDVVGALQLDPRVGEEYQVEVPGIIKESERLQLLMNPADSEVMLDSSLSFAIGLPISVTWIRNEVEDSGHERNLADVDGGKNSGQLGKSKNYVLVPGTLSNSWSEADAKSFLLGLFIFGKNFIKIKKFLENKGMGEILSFYYGKFFKSEEYHRWSDCRKIKGRKCIIGQKLLNGQRQHELLSRLIPHVSEESKDTLLQVSQSYVEGRTSVEEYILSIKSIVGLGVLVEAVGIGKEKEDLTSLAVELGKNNRVFSVPTCKAWASLGPSDIIKYLTGGLRLSKAKSNDLFWEAVWPRLLARGWHSEQPKNQGYVHSKDHLVFLIPGVKKFSRRKLVKGDHYFDSVSDVLSKVVAEPNLLVLEEETKVGSCNDEEPEKGLNKDDQFDYHRQCYLKPQASTTDHIKFMVIDTSLVHGGKSSDLMEFKSAPFKSVSKVEVNAAGITSKGAKHTRKVNHCKDMPDNIDKKLTKFTVIDTSRLYEGKLLKVRELTCLPVELENASKMTVLSRESKDSSSDEDSSSMVTCDKKNISNTNSQKGISDSDATNQKEANDKPDNNAKKRVESQKNQKTRVTDDNQLKRTIKHQFRRRARSDHCNPMVLPIKRRRLTACAKAETSRAIENSSGGLESEKVAFSQLSSFPDSHQNVCDSVSSRPNGSSIASLADRSVEVNNEEIILNEICQSRSKSCVEVEKCESQSAVTFNTPQVLLKSEDGEMVATVEEDGQCKKANDPCLSTDTQGVVEKPQRSSCDVGSMEQQPTNINPRRQSTRNRPLTVKAMESLGNEFLHVQRRRKKKDILSHIDAFSPCRKARTSKTKLHRHSSDHGTAVLVKEKHLSGDHKMEIVELVECFQATKLN

SEQ ID NO: 112459 - protein, 364 aa, Glycine max
  Coding DNA Sequence Number=SeqID_20774
  Gene Ontology: Biological process=response to UV-B
  Homolog annotation: Hit_ID=Q2R4Y3; Match level="QueryCoverage=90%, HitCoverage=83%, E-value=9e-64, Identity=42%"; Hit description =Expressed protein
  Pfam annotation: Domain name=DUF760; Domain location=7-361; Score =396.3; E_value=4.8e-116; Accession=PF05542.2; Description=Protein of unknown function (DUF760)
  Subcellular localization annotation: CTP_CleavageSite=24; ConfidenceScore=5.31e-01
MITLPQPSSLKPNLRVCPKVMRVRASAGRRHCEFSSQNAPLEPRSLAGKFLSGVLQNRRQLFHVLAKEELKMLSDDRDSAIARMRLSHHSDEALLHRRIAQVKENESMIAIEDVMYLLILYKFSEIRVHLVPKLSSCIYNGRLEILPSKDWDLESIHSMEVLDIIRKHVSTVTGLRSNPSVRESWETTPIRQFWLARVYVASILYGYFLKSVSLRYNLERSLSLSDHDLHHGHKTGPSFQDMYRSGPKDVMLGNKSDIRSVWHGLIGQEEEIEDLTCYVTGFHPGSFERCAKLRSKEAVHLVESHSNALFGDGKSGLSQHDDVIVTSFSSLRRLVLEAVAFGSFLWETEDYIDNVYKLKDQVVE

SEQ ID NO: 112460 - protein, 289 aa, Glycine max
  Coding DNA Sequence Number=SeqID_20775
  Gene Ontology: Mol. function=kinase activity
  Homolog annotation: Hit_ID=Q7XIR9; Match level="QueryCoverage=58%, HitCoverage=34%, E-value=2e-12, Identity=30%"; Hit description =Putative RING3 protein
  Pfam annotation: Domain name=Bromodomain; Domain location=172-262; Score=12.2; E_value=0.00016; Accession=PF00439.16; Description =Bromodomain
MATTEHPRRKLIIKIYFPRSQKHEAASEVSDSCCGEKRSTVTSSNPPSHGTNTPNDSRSASKVCELKNKKGYYATATWVNIENPSSESSAIDSRISRTGSEVCELKNKKEGVRVGCKNTDKKRKVVYSPRSENPEAPSDEKRRKTSSSNPLSEDSRTVRVECKKKRILMDRCKKMQCWAMLKRLMVGRDAWALKKDILDPKVLCVLHKSEAIRKPKGLEDIESKLKNWDYSETDEFVDDVKLVLSYALQYPQRSEVHRTARRISEGFEISWKTMKAKWMRDEQDLQEKR

SEQ ID NO: 112461 - protein, 285 aa, Glycine max
  Coding DNA Sequence Number=SeqID_20776
  Gene Ontology: Mol. function=transferase activity, transferring glycosyl groups; Cellular component=integral to membrane; Biological process=metabolic process
  Homolog annotation: Hit_ID=Q5IFH8; Match level="QueryCoverage=80%, HitCoverage=48%, E-value=2e-56, Identity=48%"; Hit description =Triterpene UDP-glucosyl transferase UGT73K1
MYFSQTPSELLDDGLKKQFRKRNPKMEDLEAKISDSKPDDSSPLKLYLLPFLAPGHMIPQINLAQVFAFRGHHVTILTTPSNAKLIPKHLNVHILNFPSEEVGLPSGLENISLAKDNNTAYKIWKASKLLKPEIENFLNHNPPHALIIDIMYTWRSTLNNSIPTFVYSPMPVFALCVVEAINRHPQTLASDSSLPYVVPGGLPHNVTLNFNPSSTSFDNMARTLLHAKENNKHGVIVNTFPELEDGYTQYYEKLTRVKVWHLGMLSLMVDYFDKRGKPQEDQVSE

SEQ ID NO: 112462 - protein, 138 aa, Glycine max
  Coding DNA Sequence Number=SeqID_20777
  Homolog annotation: Hit_ID=A5ADV4; Match level="QueryCoverage=50%, HitCoverage=8%, E-value=5e-20, Identity=67%"; Hit description =Putative uncharacterized protein
MANGTACSAGGAGWPEWLADRASTAGGDVLGYKCEVKSHIGFPYVVTRGPQMYPSNLPNNCLEEAVGAMTLKEGKVKIEKFDGRDFSFWKMQIEDYLYQKKLYQPLSGVKPEDMKQEEWNLLDRQTLGVIRLTLTKNV

SEQ ID NO: 112463 - protein, 100 aa, Glycine max
  Coding DNA Sequence Number=SeqID_20778
  Homolog annotation: Hit_ID=A7R5N2; Match level="QueryCoverage=92%, HitCoverage=15%, E-value=8e-15, Identity=48%"; Hit description =Chromosome undetermined scaffold_1009, whole genome shotgun sequence
  Subcellular localization annotation: CTP_CleavageSite=31; ConfidenceScore=5.10e-01
MVFLQGVSKSERMKAAIFTGKAQAMATITATASTAAVPNGAFGTGFLIHRNLLLTTHANLPSVVAADTAEIRLHNGVAATLVPQRLDRVDSLVEGKAPVA

SEQ ID NO: 112464 - protein, 272 aa, Glycine max
  Coding DNA Sequence Number=SeqID_20779
  Gene Ontology: Mol. function=zinc ion binding; Biological process =response to stress
  Homolog annotation: Hit_ID=Q2HUI7; Match level="QueryCoverage=84%, HitCoverage=46%, E-value=3e-26, Identity=35%"; Hit description =Cyclin-like F-box; FBD; Zinc finger, FYVE/PHD-type
  Pfam annotation: Domain name=F-box; Domain location=5-52; Score=40.3; E_value=6.9e-09; Accession=PF00646.24; Description=F-box domain
METQDKISALPDEVLGHILSFLSTQEAISTSLVSKRWQPLWLSIPILDLDDITFIQNGKSYSSFFNFAFGSLLARNVQQPLKLARLRFNSCGYDNNFPYSHFKIWVNAVIQRGLEHLQIEMPRPFELPNIILNCKTLVVLKLYRFRVNALGLVHLPALKTLHLDNFTMLETWHLAKVLHECPILEDLRANNMFFYNKSDVVEFQIMPKLVKAEIKVNFRFEIPLKVASNVEYLRFFIKGHRFGHGDHRPDHRGCTSSHRDCEPGDLVVWVGR

SEQ ID NO: 112465 - protein, 222 aa, Glycine max
  Coding DNA Sequence Number=SeqID_20780
MEEVVLVSAHAGVEVEVRDGVGGVARENGDVGERQEGGVGFVVLEKRFIVEVEGGDGMPQRLPALGEKARGNGFVSWEKEGNASFFFSSVNLLLLLFSVNLLLLCEARQGCLLLLREQDSNLRVEDESRRRRKKWEKGLTAEASGRTCSGNFPEEVFFRKLLLIPELLRPILKISSRNSFLLGPPNLQIRNTYFTGPPNLQSYTAWKAIARKRKKATKDGAQ

SEQ ID NO: 112466 - protein, 161 aa, Glycine max
  Coding DNA Sequence Number=SeqID_20781
  Gene Ontology: Cellular component=endoplasmic reticulum; Biological process=intracellular protein transport
  Homolog annotation: Hit_ID=A9PGI3; Match level="QueryCoverage=59%, HitCoverage=44%, E-value=6e-36, Identity=82%"; Hit description =Putative uncharacterized protein
MIQLLFLVIFVEGVLAFLLLVKIGPLRDLVIKSLDQLKMGKGPATVKTIAGTMSVILLSSLMSIIKIQNKGAKLGTMSPMDQVLWRSHLLEASLMGKKLRRFNKFIEDDETLSSGCSVFGFRGEMVARGLGFWQGRFAGEKPVTDGWWRVRRAGPTRCFFC

SEQ ID NO: 112467 - protein, 83 aa, Glycine max
  Coding DNA Sequence Number=SeqID_20782
  Homolog annotation: Hit_ID=A7QN56; Match level="QueryCoverage=95%, HitCoverage=40%, E-value=2e-23, Identity=72%"; Hit description =Chromosome undetermined scaffold_130, whole genome shotgun sequence
  Pfam annotation: Domain name=SAM_1; Domain location=21-82; Score =60.2; E_value=6.9e-15; Accession=PF00536.21; Description=SAM domain (Sterile alpha motif)
  Pfam annotation: Domain name=SAM_2; Domain location=20-83; Score =30.0; E_value=8.7e-06; Accession=PF07647.8; Description=SAM domain (Sterile alpha motif)
  Pfam module annotation: Pfam domain module=SAM_1::SAM_2; Domain location=21-82::20-83
MEETRILIILDIPSHSEEPLGNGADASLDDFLQSLGLEKYLIGFQAEEVDMTALNHMTDEDLKAMGIPMGPRKKILLALESKG

SEQ ID NO: 112468 - protein, 395 aa, Glycine max
  Coding DNA Sequence Number=SeqID_20783
  Homolog annotation: Hit_ID=Q2HS67; Match level="QueryCoverage=97%, HitCoverage=98%, E-value=7e-54, Identity=35%"; Hit description =Cyclin-like F-box; F-box protein interaction domain
  Pfam annotation: Domain name=F-box; Domain location=5-52; Score=53.0; E_value=1e-12; Accession=PF00646.24; Description=F-box domain
  Pfam annotation: Domain name=FBA_1; Domain location=223-388; Score= -48.7; E_value=0.054; Accession=PF07734.4; Description=F-box associated
  Pfam module annotation: Pfam domain module=F-box::FBA_1; Domain location=5-52::223-388
MSLAEYLSYVPDDLIVEILSRLPVKDLMRFRCVCKTWKSIIFDPSFVKKHLERSSKKIHLIITREEVLYDGFDYDYGDAYAIPYSINQLFENPSSDVDEDDYYQLNGYWIIGSCNGLVCLGGYHGEEDTIYEYWVQFWNPATRMKSRKSPRLHVNPCCQGFDPSNSIGFGFLYDDLSAIYKVVSVLSNCRSKKTEVWVYNLGGNCWTNIFSCPNFPILRQNGRLVNGTINWLAIDMSSSHYEERNDIIDPLVIFSVDLQKDTYKYLLLPKGLDQIPDNDQLRIVELRDRLCLYHDRNATHFVVWQMKEFGVEKSWTLLMKVTYNHLQIPYPPDRPLLPFCISENGEVLMLVNNDVLNMTFYNRRNNRVEVIPIPNNNAWWQATNYIPSLVSPFQN

SEQ ID NO: 112469 - protein, 241 aa, Glycine max
  Coding DNA Sequence Number=SeqID_20784
  Gene Ontology: Mol. function=hydrogen ion transporting ATPase activity, rotational mechanism; Cellular component=cytoplasm; Biological process=protein modification process
  Homolog annotation: Hit_ID=A7QZ01; Match level="QueryCoverage=45%, HitCoverage=96%, E-value=4e-41, Identity=79%"; Hit description =Chromosome undetermined scaffold_260, whole genome shotgun sequence
  Pfam annotation: Domain name=ubiquitin; Domain location=26-108; Score= 18.4; E_value=0.0037; Accession=PF00240.14; Description=Ubiquitin family
MSASGGRGSQEEEKKPSDQGAHINLKVKGQDGNEVFFRIKRSTQLKKLMNAYCDRQSVDFNSIAFLFDGRRLRAEQTPDEFWSGGQGLKTERLEMEDGDEIDAMLHQTGGGHNKFKRESSSLTIVTIKYELIFKSFCVGAVDEGEVNGEKDLEGTIGVHKGIIVDKPDESEEEAEKVIPSTTFATAPLGSCNPHGLWRPWRLMVVASQVINGDYGYEEEGGTRERRINLKKKKTKQKSLNH

SEQ ID NO: 112470 - protein, 95 aa, Glycine max
  Coding DNA Sequence Number=SeqID_20785
VQIAKENVYYAKQANKQRKELVLVPGDDPGHLRTNVFQEGRNDENHETGQIQAKVMRIMKLAKYRLKAQVEKDKGLSGEGQSPRVEKDEGPSGEG

SEQ ID NO: 112471 - protein, 162 aa, Glycine max
  Coding DNA Sequence Number=SeqID_20786
  Pfam annotation: Domain name=4F5; Domain location=99-155; Score=61.6; E_value=2.6e-15; Accession=PF04419.5; Description=4F5 protein family
MTKKSHTSYPIYVQKLNIAKNFEWNHNRSSMDTGSDQLAQCFKLCLNSSHIIFNFIIKFIATFIRKCRNRAKCVGFKKLREFKCKILTSILVLFFLSISARGSQRDRDRERAQARTGAKGKQKDDGLTPEQRRERDAKALQEKAAKKAAQGAGGNNAAGSKK

SEQ ID NO: 112472 - protein, 1173 aa, Glycine max
  Coding DNA Sequence Number=SeqID_20787
  Gene Ontology: Mol. function=DNA binding; Cellular component=nucleus; Biological process=chromatin modification
  Homolog annotation: Hit_ID=A5B9Z2; Match level="QueryCoverage=95%, HitCoverage=50%, E-value=0.0, Identity=51%"; Hit description =Putative uncharacterized protein
  Pfam annotation: Domain name=HSA; Domain location=630-696; Score =43.2; E_value=9.5e-10; Accession=PF07529.4; Description=HSA
MGAVRVLNDGANWEVMFVLCIVLEWNVYGFVSVNGGGASNLKCKCVVGDSGMHGCNSGSALLVNAEVDSMGGVVDGGVGIGLKTSPRRAAIEKAQAELRLEYDAREERRRELQFLEKGGNPLDFKLGNGASVSVQSTSLTDQHQEQFVTSEAKGSFVLTASPHGDSVDSSARPGVPSLSEPNTADNLLLFDGDNELLEGEKRSLHSNKRNNIAPSEQSSRIGGNQNAKETEDSAIFRPYARRNRSKPNHGPRGGSRDLKGIISDTNKQKDHNVLSVSKPKPTSSNGEVLSKDPTSNNPLGNELVGVRACQTASGSASVPEDKLDIVMNKNFKEDQRIVPSQDDIVQNSVVLASREAKAVGERDLGTSGDLEPSPCAVTKQPGNESCSGQPNGFGNIKLDRVGVPNGDQNCSAALGMKNYSEFSCAQTSLARDVNNNNNNMCSNTKNIDANGNTVEQTSEFDQKLNLTGCGVVKESSNTNAGESGVTSNNQHATGYENHFGSGNMVKSEEDIHINSSGMLNKVKDSPNIKGLHNNGSSISNADKEKSVGLMDHPNCIMEDSCERLQVPMDVSFSTTQTAPVEKVTTTTASDCQPCSTHNLKLPDKALEDSILEEAKIIEVKRKRIAELSVRTLPSQIHRKSHWGFVLEEMTWLANDFAQERLWKITAAAQLSHQASFTSRLRFEKQSEHLGVKILSHNMAKAVMQFWNSIELLLDNDVPGRNCIDGSVESGNIDSDEASGNRRSNSKMVLATSKYLDGQNPRKQVVFKVHSYALRFLKDSRSLGISSQAEAPTTPDKISDSGIVDMSWDDHLTEENLFYTVPPTAMEAYRKSIESHFLQYEKTGSSIQEEVETSMYDAAAEVAYDEDEGENSTYYLPGVYEGSRSSKSFQKKHKNRIKSYTHKSSEIGIDLPYGRYSTGAQPSVLFGRRPASLNVGSIPTKRMRTASRQRVVSPFAVISGTVQAHAKTDASSGDTNSFQDDQSTLNVGSQIQKSLEVESVGDFEKQVAYDCGETSVKTKKKKSKNLGSSYDQGWQLDSVVLSEQRDHAKKRLDSHHFEPNGSSGLYGQHSVKKLKTTKQSLDNFDNVAPIANSIPSPAASQMSNMSSPSKFIRIISGGRDRGRKAKALKVSVGQPGSGSPWSLFEDQALVVLVHDMGPNWELVSDAINSTIQFK

SEQ ID NO: 112473 - protein, 15 aa, Glycine max
  Coding DNA Sequence Number=SeqID_20788
PNDVPQSQTVFLEED

SEQ ID NO: 112474 - protein, 162 aa, Glycine max
  Coding DNA Sequence Number=SeqID_20789
MDEKEKGSTRRELVLEYMKTLRFEHRSLVKHLKYKSVVALVMGYDEGGWWRLGRQQLHGQLWMTSGVVGAKVVRRHAAMLVGVAPTLLKVQGCMCSEAESDLEVEAACNIGGGWWGWCVMLMECGKVGEQRRRREAGLMRNAFSFGSLSLFQIWFEISFFLL

SEQ ID NO: 112475 - protein, 321 aa, Glycine max
  Coding DNA Sequence Number=SeqID_20790
MTSIEQQVNLVVVAQPINAIKDADILERLWNDFEDQLRKAKTIASEHLRLGGDSSVAPIFPMPETNASDNADETSRKTLRKRGRKTTSKVLFQVPFSFQPPEFCLKENINLEIVLLNRFKNESSWGNHVPKFSVEERLKNWVIEKRKRMQSKDKEKPEAKMQDYYYIHSASQKTLRSHNEVLEFLLDVEIPRKGGSKKAKVVGAVDNQVSGSASHESSRRKEMSFASQIVNKMNSSNEEEHKGGMESMYKMKSSDEKGSNELDNKVMSDELKNKMKDLEKEIMPWDDDEMGLYKMVDINEIENELMIQELLNQPGELLFNL

SEQ ID NO: 112476 - protein, 179 aa, Glycine max
  Coding DNA Sequence Number=SeqID_20791
  Subcellular localization annotation: CTP_CleavageSite=41; ConfidenceScore=5.53e-01
MATPSTPSSHPPPSELATPSSSTSNKTRKTTRLRSLANKLVGAKKPVIHVDPVTGKVDGPHRKKLRTYLGIVARDKDVLTVIIGRPEHPSRVRVVGADVTIKQYFGPTSRSSCTSTSMAPEDMQSQGLTLPPELEASPSTPHVSTKGSCIDPSGVFEGSTTVHNVPLGNDQVKVSVEEV

SEQ ID NO: 112477 - protein, 76 aa, Glycine max
  Coding DNA Sequence Number=SeqID_20792
MSLKSQSQISLRSQMIQPGGLRCDRREVGASLSLGLVTPGTSTHEVIKECLKITRSVTQDRIVYVRSQHRRRMNQP

SEQ ID NO: 112478 - protein, 112 aa, Glycine max
  Coding DNA Sequence Number=SeqID_20793
  Homolog annotation: Hit_ID=A5ACV8; Match level="QueryCoverage=43%, HitCoverage=6%, E-value=7e-11, Identity=69%"; Hit description =Putative uncharacterized protein
MEIFQCWNLPFVKEIFFGDLGKISRGKMFMHCLINQVHIGATKRFLRYIRGTTDCGREYHAIREAEKSKEINLEHCNLENQIAEIMTKALSKGKFEVLRSKLEVLKIPKDEC

SEQ ID NO: 112479 - protein, 239 aa, Glycine max
  Coding DNA Sequence Number=SeqID_20794
  Homolog annotation: Hit_ID=A5BTA1; Match level="QueryCoverage=85%, HitCoverage=37%, E-value=2e-25, Identity=40%"; Hit description =Putative uncharacterized protein
MAECVASAFCVKLVTQRRPVRERGFSRQITNLKTFQRKYSRSGCKFVHFSTWKTFDLSVFGTTHLKFTPRLQELPLKCIGLGALVDFNGAKASDLVPVVGQMLLMGSIFLTYMAGVIPVEKSYASYQKTISDKNVFPESSDISGSSAKQNSGFESKYVLNVVREKLLNSLNALANKDYSGDIIVQSAKRPLSLSAVARGPKLSLESRVLTNWNRGPGLEFKCCYQRSKVKAALGCFSAS

SEQ ID NO: 112480 - protein, 113 aa, Glycine max
  Coding DNA Sequence Number=SeqID_20795
MVGRQPIEGSKKRPKLKSLVIITRESTNTPHAQILKVGIDCNIFEIVANYTPVLVQDLYPQQQRNDHKCEPIEAIIDECCGHTSRKVRDTIPDRVVPSFVDAIRGEESPHIKS

SEQ ID NO: 112481 - protein, 215 aa, Glycine max
  Coding DNA Sequence Number=SeqID_20796
  Homolog annotation: Hit_ID=A7PE92; Match level="QueryCoverage=30%, HitCoverage=61%, E-value=5e-26, Identity=80%"; Hit description =Chromosome chr11 scaffold_13, whole genome shotgun sequence
MVEPYRRPKSFTPLVTIYMAAFYSGVIGAAITEQLYKEKYWEEHPGKAVPLMRPKFYGGPWRVMGGTRVVDIVSYASIISDKWVAIATDQFDQQHPKENKDRKALSLFGVAMIIALLIFMLGTTTYRFNIQGSPDKSHFLRIGRVFIAAIRNRSSSLEQSSGQFKNYSMIKSRMSSEAWVLLSIIVVGSFQLSNFSDTFTGYLLDSVSWDWILHL

SEQ ID NO: 112482 - protein, 297 aa, Glycine max
  Coding DNA Sequence Number=SeqID_20797
  Gene Ontology: Mol. function=binding
  Homolog annotation: Hit_ID=A9PJG6; Match level="QueryCoverage=93%, HitCoverage=95%, E-value=1e-106, Identity=68%"; Hit description =Putative uncharacterized protein
  Pfam annotation: Domain name=TPR_1; Domain location=160-193; Score =22.6; E_value=0.0014; Accession=PF00515.19; Description =Tetratricopeptide repeat
  Pfam annotation: Domain name=TPR_2; Domain location=160-193; Score =16.2; E_value=0.13; Accession=PF07719.8; Description=Tetratricopeptid e repeat
  Pfam annotation: Domain name=TPR_2; Domain location=64-97; Score=1.9; E_value=17; Accession=PF07719.8; Description=Tetratricopeptide repeat
  Pfam module annotation: Pfam domain module=TPR_1::TPR_2::TPR_2; Domain location=160-193::160-193::64-97
MEGISVCKKSSKLGKKDDLYHVIHKVPYGDSPYVKAKHAQLVDKDPEAAIVLFWKAINCGDKVDSALKDMAVVMKQLDRSEEAIEAIKSFRGLCSKHSQESLDNVLLDLYKKCGKIEEQIELLKRKLRLIYQGEAFNGRTTRTARSHGKKFQVSIKQETARLLGNLGWAYMQKENYMMAEVVFKKAQMVDADANKACNLGLCLMRQSRYKEAYYILEEVLMGIIPGSDEIKSRKRAEELLEELNANLPQPEFMDALGLDDDFVKGIDDLLDAWNTNNRPRRLPIFEEISSFRDQLAC

SEQ ID NO: 112483 - protein, 164 aa, Glycine max
  Coding DNA Sequence Number=SeqID_20798
  Gene Ontology: Mol. function=binding; Cellular component=cytoplasm; Biological process=protein folding
  Homolog annotation: Hit_ID=Q7XD86; Match level="QueryCoverage=73%, HitCoverage=49%, E-value=6e-41, Identity=68%"; Hit description=TPR Domain containing protein, expressed
  Pfam annotation: Domain name=TPR_1; Domain location=63-96; Score =35.1; E_value=2.5e-07; Accession=PF00515.19; Description =Tetratricopeptide repeat
  Pfam annotation: Domain name=TPR_2; Domain location=63-96; Score =34.4; E_value=4e-07; Accession=PF07719.8; Description=Tetratricopepti de repeat
  Pfam module annotation: Pfam domain module=TPR_1::TPR_2; Domain location=63-96::63-96
MDDGIFLCWSWLKNLERVLEFTLINGRCSNLRIDTNLRKLAWEKYDNTIKECTKALELNPVYVKALVRRGEAHEKLEHFDKAIDDMKKILEIDPSNDQARKTIRRLETLAAEKREKMIDREVFLDAAQVKDMGNSFLRYLGLKENNFKAVKDPNTGSYSISFQR

SEQ ID NO: 112484 - protein, 404 aa, Glycine max
  Coding DNA Sequence Number=SeqID_20799
MEEWYYKKSQVPAFGSWDWNDNLPFTQCFESARQAGLLRCSNYSESEERDLYVTGDLYENNVVTPAMIVVPRRRANVVDQHEKETKLKNWISDDVDSESPSPTPLPRPTSKPVDEDLYKISPGLVYAKAKKEYETLRMKNGEAILKVLVPCTGPDTLRAETLRYYENLFVSHESVATNPLQNPVVQSFHNKFTNVNGGKHLNVDVDQLSNYVPPTDEDNNMSTPNVHCISAQATPLWRNGLVDKSVLHKACELSPQETPASAINAPKKLQLQPLIHKNFINVNGGSSLNVEDEDQLSNHITPASDGDNNKSTPNVQHISPQDFGSKIPSRKRSRVVYLTPLKECMEELWKLHRNYGRHAEERILEDNVNNFIPENEIAGLGAILLKTDHDVAASADTCESSTDD

SEQ ID NO: 112485 - protein, 136 aa, Glycine max
  Coding DNA Sequence Number=SeqID_20800
MGLNGVLLGNRAALAVRVASEADLAVRCVPTDLVVGSELAGGYVVGAEEITGDGSACRRVVVEDTGRESTEKKEGRSRFDTKVKPDEQSALQRENCTAAADGEDIEERIPEFHNLTYIEFIYFDNVEYGLLMFYKC

SEQ ID NO: 112486 - protein, 79 aa, Glycine max
  Coding DNA Sequence Number=SeqID_20801
MAEMIKLGDKMRRMSYENEERMETMRKENKDSLGRIHKSREALSVRIENIGQRKKDRSSNSSRAEDEGHEEDEGGKRNK

SEQ ID NO: 112487 - protein, 71 aa, Glycine max
  Coding DNA Sequence Number=SeqID_20802
MWTTTGEELATQLAQASKVASSRSNSLLEEESGRPKWLSKKLRKLTDCAKTPLFYFRHITEFHGSRKLASL

SEQ ID NO: 112488 - protein, 146 aa, Glycine max
  Coding DNA Sequence Number=SeqID_20803
  Homolog annotation: Hit_ID=Q6WAY4; Match level="QueryCoverage=96%, HitCoverage=25%, E-value=4e-16, Identity=34%"; Hit description =Putative uncharacterized protein
MGQLQRQAFNKAYGKIWDLTMVDVSTEAIPSLAQYYDQPLRCFTFGDFQLTSTVEEFEEILGCPLRGRKPYLFLGFYPSLARIAKIVKISTQKLDHGKQVENEVVGVPRKCLEAKARVLASQDEWAPFIDILALLIFGVVLFPNVD

SEQ ID NO: 112489 - protein, 130 aa, Glycine max
  Coding DNA Sequence Number=SeqID_20804
MAYERGGDFLEDARKILNREAFPPGGSLVRSPVPAFRFTGVIPLLWPRLSHSTPDTQFRVGSSLQAGLYARTPRSVRPLRLIRGVSLEVMRRLKAKTERTSFGDCAPPSQLPRFKELVAQRTLRKTALQG

SEQ ID NO: 112490 - protein, 140 aa, Glycine max
  Coding DNA Sequence Number=SeqID_20805
  Homolog annotation: Hit_ID=A5BTL1; Match level="QueryCoverage=79%, HitCoverage=59%, E-value=2e-20, Identity=56%"; Hit description =Putative uncharacterized protein
MGVSLAARKHPVLTTLRDTKAQIPHPTKSLTRERENSHYRWKASRAVSAVGTGFPKSQPPGRGRHRMKGDGPNVVVLAKPTSWVAGGEERTWGLRPGRSVTKRAIPFRARQKTGRTLDVDRRHFSRKVYLYRKSEPLTVW

SEQ ID NO: 112491 - protein, 87 aa, Glycine max
  Coding DNA Sequence Number=SeqID_20806
  Pfam annotation: Domain name=Ins_element1; Domain location=23-80; Score=-25.5; E_value=0.042; Accession=PF03811.4; Description =Insertion element protein
  Subcellular localization annotation: CTP_CleavageSite=72; ConfidenceScore=5.19e-01
ETSYVPINVSFSPKVGQAFPLSPPCSATDGVVRNGKSTAGHQRWQAAQLLGRAIGAGLFAITPAGERGMCCKAIKLGNARVFPVTTL

SEQ ID NO: 112492 - protein, 83 aa, Glycine max
  Coding DNA Sequence Number=SeqID_20807
GVVLAEVLLADSRFTRPDMGFHPTKLNFVPSDADEAPLDVSICLHAFGIVGCGSFSGVKSCEREGADDWVPVLPTYQTVFVVA

SEQ ID NO: 112493 - protein, 70 aa, Glycine max
  Coding DNA Sequence Number=SeqID_20808
EKEGEACHPARPGELGCFLLKAPPSGELPGRPSGHGLGSSSSMDSFASWKMNGSGMEKGRERGDATSRRR

SEQ ID NO: 112494 - protein, 221 aa, Glycine max
  Coding DNA Sequence Number=SeqID_20809
  Homolog annotation: Hit_ID=Q2HW90; Match level="QueryCoverage=74%, HitCoverage=44%, E-value=2e-13, Identity=27%"; Hit description =Putative uncharacterized protein
MGTNQTSKRFYQVKVKSLNTTSIKELGRLMEPLQMQAFRKTYGKILELTIAEVSIEAIVSLTQYYDQSLRCFTFGDFQLVPTIEEFEEILGCPLGGRKPYLSSGCLPSLSRIATVVKDSARDLAAIDAFLAYHHSKESPVVAVLADLFDTFDRRCEKSSARIICCLPALCVWLVSHLFQQDTRHPCPLLSHRSCTEKRRIDWDQLLAGIGGRTISWFPRWK

SEQ ID NO: 112495 - protein, 85 aa, Glycine max
  Coding DNA Sequence Number=SeqID_20810
  Gene Ontology: Biological process=transposition, DNA-mediated
  Homolog annotation: Hit_ID=Q1J7G7; Match level="QueryCoverage=38%, HitCoverage=47%, E-value=1e-11, Identity=96%"; Hit description =Transposase
LTLRADQRLISPKLAQGFPVSTGHQDLFILRSDLPSQVLQWLLFLSAVPPVQLLTGWCVTAKAPPDISAGKCSGHAARNHHTRRA

SEQ ID NO: 112496 - protein, 92 aa, Glycine max
  Coding DNA Sequence Number=SeqID_20811
MAFFCGALRGNETSSQDILKHLMLLVLSSGTSLRGDFSMVLPLIFPWVLKGMCLFLRALLMIIPILYWRIPMNPSFPNKGSPPIEGIPLKAK

SEQ ID NO: 112497 - protein, 100 aa, Glycine max
  Coding DNA Sequence Number=SeqID_20812
MAPTRHPLDPDKSNRALGFPALITGLWQSFGVPVTPSKVIRPPITRAFIEKYCTQRQVQGDAPQAADVPPPHQAGPAGSFNTEQYLRHLVRQQAANHRAH

SEQ ID NO: 112498 - protein, 76 aa, Glycine max
  Coding DNA Sequence Number=SeqID_20813
  Gene Ontology: Cellular component=endoplasmic reticulum
  Homolog annotation: Hit_ID=Q9T0D9; Match level="QueryCoverage=55%, HitCoverage=6%, E-value=6e-10, Identity=80%"; Hit description =Putative uncharacterized protein AT4g11720
MALRSAITLIIIFILSSFHVVGIQIISKSKLEKCEKNSNSEDNLNCTTKIVLNMAVPSGSVNRSYSHYAPHCVPVC

SEQ ID NO: 112499 - protein, 116 aa, Glycine max
  Coding DNA Sequence Number=SeqID_20814
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=84%, HitCoverage=75%, E-value=3e-25, Identity=66%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAVWWLRAA

SEQ ID NO: 112500 - protein, 155 aa, Glycine max
  Coding DNA Sequence Number=SeqID_20815
  Homolog annotation: Hit_ID=Q6UUU1; Match level="QueryCoverage=38%, HitCoverage=40%, E-value=1e-18, Identity=78%"; Hit description =Putative uncharacterized protein
REPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPELVFEVMRRLRAKLKGQGFGDCAPPSQLP

SEQ ID NO: 112501 - protein, 66 aa, Glycine max
  Coding DNA Sequence Number=SeqID_20816
MATMMEAMMSMKKIMEVNAVAVAATSAVAEVDPTPPSGLNQINHAVLDMVGKRGKELGSTGGPHFA

SEQ ID NO: 112502 - protein, 60 aa, Glycine max
  Coding DNA Sequence Number=SeqID_20817
MEKGMKDSWGFPVEYWNDLKSTLRKRHHSRYYERSLWTSSKDLARGMSVEEYRPTRNYSF

SEQ ID NO: 112503 - protein, 120 aa, Glycine max
  Coding DNA Sequence Number=SeqID_20818
ALGFPALITGLCQSFGVPVTPSKVIRPPITRTFIEKYCTQRQVQGDAPQAADAPPPHQAGPVGLFDTEQYLRHLVRQQAANHRAHAGEAPVGAPAEAPDEVDEAREDEEMTDLLDFLGGS

SEQ ID NO: 112504 - protein, 110 aa, Glycine max
  Coding DNA Sequence Number=SeqID_20819
  Subcellular localization annotation: CTP_CleavageSite=41; ConfidenceScore=5.07e-01
MTLLGERAPGRTDRGPMLPNSNVIHVRVVMLVRMVRTRLFAAARGKSCLGMHSRCVIASLSGCARTVGRRPISGGTLKMRTRSPLKVRTCSPLQARMCSPLMARTYGPLK

SEQ ID NO: 112505 - protein, 133 aa, Glycine max
  Coding DNA Sequence Number=SeqID_20820
MASPTRFLSSTMTRKLFLNLYPSEKLYDQVKVQIAKKNESYAKQANKKRKEVVLEPGDDPGHLRANVFQEGGIDENPETGQIQAKGPSGKGRRAQVEKDKAPEWRKMKAQVEKDEGQVAETLSRLLIVTEGPN

SEQ ID NO: 112506 - protein, 170 aa, Glycine max
  Coding DNA Sequence Number=SeqID_20821
  Homolog annotation: Hit_ID=A5BGH9; Match level="QueryCoverage=73%, HitCoverage=25%, E-value=3e-14, Identity=34%"; Hit description =Putative uncharacterized protein
MTRGNPSDLQPFDPEIDKTFHKLVRHHLVPFEHPEHSVIGDFEHPDLEHYNFEHSENMTQPPPRERTLREMAAPDFTYESLCIQYPDEDVPYVLKIGLIHLLPKFHGLVGEDPHKHLKEFHIVCSTMKPPDVQEDHIFLKAFSHSLEGVTKDWLYYLAPRSITSWDDLRR

SEQ ID NO: 112507 - protein, 38 aa, Glycine max
  Coding DNA Sequence Number=SeqID_20822
MEYLLAGDVLRLSSAGKRRRSVSHDPILHLRPFLSTYK

SEQ ID NO: 112508 - protein, 186 aa, Glycine max
  Coding DNA Sequence Number=SeqID_20823
MGLNQAHAFKESFIKSRKECALRCPHRMHARARVMSEEKDKVQEQIKADIEALKEQMATMMEAMMSMKKIMEVNAATVAATSVVAEVDPTPPSGLNQINHLISDMVGQRGKELGSTGGPHFLQVQNKHAFPPYGLPPNYTPPNVAHTPNENVNNSTPILIESQQPQSDHAPIPQPMGGHMKYPTTI

SEQ ID NO: 112509 - protein, 178 aa, Glycine max
  Coding DNA Sequence Number=SeqID_20824
VGPDDTRRYLMVIRTLLSSRVVGPDGQAETKFGHSAPLYHPEASGPMIRGDTLRLSAPFCHPEASGPMTSRDQVWSFCTLVSSRGGGPDDTRKYPSEADTVFCTFCSSGNNKSFTCGNFMVTRDSRAWHPSLGNCSNFGNDKSWSPATLVSYPNFVWGPLLDDMRPFFGPCEVLGTHH

SEQ ID NO: 112510 - protein, 667 aa, Glycine max
  Coding DNA Sequence Number=SeqID_20825
  Gene Ontology: Mol. function=nucleoside-triphosphatase activity; Cellular component=integral to membrane; Biological process=transport
  Homolog annotation: Hit_ID=P63390; Match level="QueryCoverage=92%, HitCoverage=96%, E-value=0.0, Identity=82%"; Hit description =Uncharacterized ABC transporter ATP-binding protein yheS
  Pfam annotation: Domain name=ABC_tran; Domain location=389-554; Score= 155.5; E_value=1.4e-43; Accession=PF00005.18; Description=ABC transporter
  Pfam annotation: Domain name=ABC_tran; Domain location=78-273; Score =165.9; E_value=1.1e-46; Accession=PF00005.18; Description=ABC transporter
  Pfam module annotation: Pfam domain module=ABC_tran::ABC_tran; Domain location=389-554::78-273
MGVKQQYFGRLRHRSPPKRRHRGGIPLPCSTQQTLSNYVADKLTYSDDTALMIVFSALQIRRGTNVLLDNATATINPGQKVGLVGKNGCGKSTLLSLLKGEISSDAGNVTFPGNWALAWVNQETPALSKAALEYVIDGDREYRQLESELAAANARDDGNAIALLHGKLDAIQAWSIHARAASLLHGLGFSQEQLMRPVSDFSGGWRMRLNLAQALVCRSDLLLLDEPTNHLDLDAVIWLERWLKSYTGTLILISHDRDFLDPVVDKIIHIEQQTMFEYTGNYSSFERQRVAKLAQQQALYQSQQEKVTHLQKYIDRFRAQATKAKQAQSRIKMLERMELIAPAHVDNPFSFSFRAPESLPNPILKMEQVSAGYGERVILDAIKLNLVPGSRIGLLGRNGAGKSTLIKLLAGELEPLAGKVGLAKGIKLGYFAQHQLEYLRADESPLQHLARIAPKTLEQQLRDYLGGFGFQGDKVSEATERFSGGEKARLVLALIVWQRPNLLLLDEPTNHLDLDMRQALTEALIDFEGALVVVSHDRHLLRSTTDDLYLVHDRKVDVFEGDLDDYQQWLSDLQKQETQQDAAPKQDNANSAQSRKDQKRRDAELRAQTQPLRKEIEKLEKQMAKWQTQLSEAEAQLADSAIYEQSRKADLTAALQRQAESKSALEE

SEQ ID NO: 112511 - protein, 100 aa, Glycine max
  Coding DNA Sequence Number=SeqID_20826
MHIVVVKQGQDHLGLPSGVETKHERQKPIKVLKDGCKWGMGSRPTDCCPFSARNKQRMSLQGSPVSFVFCSFLLLFVCFKKVSSPGRAGRAWASDPCTKL

SEQ ID NO: 112512 - protein, 243 aa, Glycine max
  Coding DNA Sequence Number=SeqID_20827
  Gene Ontology: Biological process=transposition, DNA-mediated
  Homolog annotation: Hit_ID=Q1J7G7; Match level="QueryCoverage=16%, HitCoverage=71%, E-value=7e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMEKILDVSANSRFILIRGARYQLLFPLVRVNFELGVIMVIAVSFGKPVVPAALMNRPTRGERRFAYWALAECILAYYVGTDEGVSEVLHVAGEKRLH

SEQ ID NO: 112513 - protein, 145 aa, Glycine max
  Coding DNA Sequence Number=SeqID_20828
  Homolog annotation: Hit_ID=Q6UUU1; Match level="QueryCoverage=41%, HitCoverage=40%, E-value=1e-18, Identity=78%"; Hit description =Putative uncharacterized protein
MGQCVVLSGTFGCFPNVAIGRVDVQVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112514 - protein, 87 aa, Glycine max
  Coding DNA Sequence Number=SeqID_20829
  Homolog annotation: Hit_ID=A5C7C5; Match level="QueryCoverage=55%, HitCoverage=7%, E-value=9e-07, Identity=47%"; Hit description =Putative uncharacterized protein
MESSEDSENEEINLCLMAKSYESDEEVSLRKKWYIDSGCSKHMTGDASKFTHISPKKSGHALSTTCLALVNYATKAILYHLILRNVL

SEQ ID NO: 112515 - protein, 113 aa, Glycine max
  Coding DNA Sequence Number=SeqID_20830
ALLGKWGWELANNHNQPWARILISKYGGWKELITGGKSKFHSQWWQDLKGIFQQQHTNCFVDNLKWREAHDNANEDRVLKIMWSLKIPPRASAFSWRLFKNRLPTRDNLRRRQ

SEQ ID NO: 112516 - protein, 146 aa, Glycine max
  Coding DNA Sequence Number=SeqID_20831
  Pfam annotation: Domain name=G-patch; Domain location=24-68; Score =23.6; E_value=0.00027; Accession=PF01585.14; Description=G-patch domain
EEDVLVSCPPSMPYVEATEESLETAFQSFEVMLGHGYEPGMGLGKNNGGRTSLVSNRGNRVKFGLGYKPTQADIRKNISERKNKGQGPWSGQRAKEAPPCHINRSFVSAGLRREGQVTVICDDDSPRRSDLDKEDEDVGLPPELER

SEQ ID NO: 112517 - protein, 60 aa, Glycine max
  Coding DNA Sequence Number=SeqID_20832
MLNGMPRGSSMISTRCVRVVSSEKWRLRNLVGVMATIELLSGYGIKWSFVIGSAVDRLCG

SEQ ID NO: 112518 - protein, 41 aa, Glycine max
  Coding DNA Sequence Number=SeqID_20833
VRTFDRPLCSLEAHARCPSLPQCKALRFLHGAFRCPSVGLN

SEQ ID NO: 112519 - protein, 44 aa, Glycine max
  Coding DNA Sequence Number=SeqID_20834
MANPVSIAPYRMSPVELAEVKAQVQDLLVNICSPKRITWERGLL

SEQ ID NO: 112520 - protein, 143 aa, Glycine max
  Coding DNA Sequence Number=SeqID_20835
MKRWWAMHPQSFADLVFASERIDVGPKRGKFDHPTRTTEKTGANEEGEKEGETHAVTAIPIRPSFPPTQQCHYSANNKPPPYPPPSYPQRALGHSIEHCMTLKRKDFQVQAIGQFAQATCAPEFGLPRPFNQRLLVLHVGGVA

SEQ ID NO: 112521 - protein, 104 aa, Glycine max
  Coding DNA Sequence Number=SeqID_20836
  Gene Ontology: Biological process=transposition, DNA-mediated
  Homolog annotation: Hit_ID=Q1J7G7; Match level="QueryCoverage=45%, HitCoverage=80%, E-value=8e-16, Identity=75%"; Hit description =Transposase
ASGDAAQLTDLVYDGVFEVLQWLLFLSAVPPVQLLTGWCVTAKAPPDISAGKCSGRVPFAIQAAQLLGRAIGAGLFAITPAGERGMCCKAIKLGNARVFPVTTL

SEQ ID NO: 112522 - protein, 78 aa, Glycine max
  Coding DNA Sequence Number=SeqID_20837
MGLRLRFDGGGCTNSARQSIRGAPDSMAINSWGSGLDGGGCMNINQFMGLRLRFDGGGCTNNARESIRGAPDSMVEDA

SEQ ID NO: 112523 - protein, 202 aa, Glycine max
  Coding DNA Sequence Number=SeqID_20838
  Homolog annotation: Hit_ID=Q5XM22; Match level="QueryCoverage=50%, HitCoverage=57%, E-value=1e-22, Identity=57%"; Hit description =Resistance-like protein HAAS-2
  Pfam annotation: Domain name=DUF1723; Domain location=43-97; Score =7.0; E_value=0.078; Accession=PF08330.1; Description=Protein of unknown function (DUF1723)
ERPALKLSFHGKKVEKFGRPAPEIEGLVAATRLSPLIACSLNIGDQGLISAFAERWHKETSSFHLLVGEAFHNFEALHVDEVVLLLVELLEVSSEEAKAKTIQCHGAYVRLSWLRDIYRSKCDAAQWTVVARAYLLHLVGCTLFANKSDTHVHVVFLDIFHDLTAASGSYTWGDAALVHMYKNLNDASKSTARQLAGYIKLL

SEQ ID NO: 112524 - protein, 154 aa, Glycine max
  Coding DNA Sequence Number=SeqID_20839
  Subcellular localization annotation: CTP_CleavageSite=38; ConfidenceScore=5.21e-01
VPQQEGGWRSHDSEIGLRGYMRRSFSRRVSGPFRRSLVFAMKSTIQMDLRMRSQTALPGLTARKLPENEPGHVLPCISLEPQKVSPRSSLLWLNTSLTYAKESSSENKHPGWKLGKGFQAVVQEAKVVCLAFKLTCLILLGESPITAIPVYPVL

SEQ ID NO: 112525 - protein, 99 aa, Glycine max
  Coding DNA Sequence Number=SeqID_20840
MGEVDEVQERIKDDMEAMKEQMATMIEVMMSMKKIMEVNAAVVATTSAIAKNKHAFLPYGLPPNYTPPNIVYTPDKNVNNSTPILVESQQPQSNHAHVS

SEQ ID NO: 112526 - protein, 236 aa, Glycine max
  Coding DNA Sequence Number=SeqID_20841
MWGAPTEESLSPFLVRDLGAQGLKVIQRIHKAWRSLLRKDKELRGIRNGVIGGYHGWLRIHTRGLDWLSKLKVIDEENFEAPEEDEEVRALKLELGKARLAKEKFKSAATHIRKECTELQEENAATARALEQETKRARKEEHGREKFRGALWGSNNELKLRREERDRSRAHGMILKEELVACARSKRSLAQHLEAMEQSMLAIIGQYKEELNQSMAHEHKLVEDLHKCMPKRSRGR

SEQ ID NO: 112527 - protein, 223 aa, Glycine max
  Coding DNA Sequence Number=SeqID_20842
LHRLHKLGHPMRGAPSEEIKSPFIVRGFNETNARILQRIRKAWNIVEGKDKEIRGSSNGIIDGYHKWLKSRTQGITWLPKLKGLSGKEAKVLEESEEVQALKVELKKMRVVKEKIKTIVTRVRKKNKFRGALWGSTNELKLRRVERDGSRVESMVLEDKLKACQRLKKSLTEQLSRMEENMLKIIDQYKEKDELAKVSALQVEREARERVIESLHREAMKWMD

SEQ ID NO: 112528 - protein, 167 aa, Glycine max
  Coding DNA Sequence Number=SeqID_20843
  Homolog annotation: Hit_ID=Q5XM22; Match level="QueryCoverage=50%, HitCoverage=62%, E-value=3e-26, Identity=59%"; Hit description =Resistance-like protein HAAS-2
SATYVHVVHLDAFRDLAHSGGYAWGVAALVHMYDQLDEACRTTTRQLAGYLTLFQCWIYEHFPSVHQCVTDDTYQETSPRASRWLTSKAHMKGITGAPYRARCDGLTVTDVSWLPYTEHRGVRRFRRFHRSRVSADYIGVGFFRISHPFMTPTQAADQQRDAPSCRP

SEQ ID NO: 112529 - protein, 131 aa, Glycine max
  Coding DNA Sequence Number=SeqID_20844
  Subcellular localization annotation: CTP_CleavageSite=43; ConfidenceScore=5.30e-01
MSIPPCGSISWSVSFRRKNCTHKDTQWTWRSPTGPWGFQLGLRASVGPTGCPSPQQGITPQDTQWTRRSPTGSTECPSPLARSCHHGIGIAPARHPVDPKKSHRVLGFPALITGLCQFYGVPVAPSKVMPS

SEQ ID NO: 112530 - protein, 118 aa, Glycine max
  Coding DNA Sequence Number=SeqID_20845
MAEEFVKSFVHQDGVIVITLDHPKECFSKLDCFWRKQPSSLGRAGWQPPPHFSYKKAKGGCSKGPGSPWLCISAVLGEKNCFREENSSRGASVMLPRCFHKQIREGFPPFFTVLRSTT

SEQ ID NO: 112531 - protein, 110 aa, Glycine max
  Coding DNA Sequence Number=SeqID_20846
LHLTNAFSTLSLSERFAKWESRLVFQGQLLSGARAKQESRLGFFLKHTVATYPSAGGRRVTRGMRVPRKEYARSRHQRLFEENVGKTGKDAIYELLSERLGSCIYARGRY

SEQ ID NO: 112532 - protein, 157 aa, Glycine max
  Coding DNA Sequence Number=SeqID_20847
GGGCRLTRPSELGCFHPKAPPSVGTPWQVQVAQQCFLSTPDMSRNFMDCLTMGVKYLEAVKRSGTSFGRVNILASGTFAIALDRPCPAEKNFVRRWARMFPDDESNPACHLTSRVRTTKGAGDDDSLYASTGSFAPGARDDASLYASTGSFAPGRRK

SEQ ID NO: 112533 - protein, 97 aa, Glycine max
  Coding DNA Sequence Number=SeqID_20848
  Subcellular localization annotation: CTP_CleavageSite=59; ConfidenceScore=5.18e-01
MRSDFLVQFFILNLFRSPMNYVFVHVSSIFEFGAMRSDCLVQFSILNLFRSPMNCVFVHASSTQEKEEGVETRFVITERAGRTKSVSYLCFPLISDK

SEQ ID NO: 112534 - protein, 103 aa, Glycine max
  Coding DNA Sequence Number=SeqID_20849
IAFPDDELERLAIPPIGETEGSTISAAGESGGAAASSDDASKMTIRGGDGGTASSSGEKGGFTTGDCGLAGSEFTCTVTDRGVGVDDEGMSSVLALFLDSICN

SEQ ID NO: 112535 - protein, 30 aa, Glycine max
  Coding DNA Sequence Number=SeqID_20850
MWDVEAGDDFGKSLDDYEPELRVSILFHYP

SEQ ID NO: 112536 - protein, 157 aa, Glycine max
  Coding DNA Sequence Number=SeqID_20851
  Gene Ontology: Cellular component=chloroplast
  Homolog annotation: Hit_ID=Q49KT9; Match level="QueryCoverage=54%, HitCoverage=92%, E-value=1e-25, Identity=63%"; Hit description =Putative uncharacterized protein ORF113
MDGGVKKGKRGMGFLLLLAYRAPSVGPHDGLLAQWALSHMDSLMCSSAPDPEMWIIQGTLAWRTSPVRSNVDPTFSSLVGSGRSGGDHHGSSLLENSYIPYQYMDSYLSSTGLGLASMEKNGAPNNVSSQTKNYEIAPFILGDQEIGSSHKKNRMLG

SEQ ID NO: 112537 - protein, 62 aa, Glycine max
  Coding DNA Sequence Number=SeqID_20852
  Homolog annotation: Hit_ID=Q6Y1E8; Match level="QueryCoverage=59%, HitCoverage=12%, E-value=3e-07, Identity=70%"; Hit description =Cysteine protease 1
  Subcellular localization annotation: CTP_CleavageSite=24; ConfidenceScore=5.10e-01
MCSSIIRITTFKFENVTATPSTVDCRQKGAVTPSRTKVNVDVFGRFPLLQQLKEFMRCELEN

SEQ ID NO: 112538 - protein, 211 aa, Glycine max
  Coding DNA Sequence Number=SeqID_20853
  Homolog annotation: Hit_ID=Q6WAY6; Match level="QueryCoverage=27%, HitCoverage=10%, E-value=4e-10, Identity=51%"; Hit description =Putative uncharacterized protein
MGSSQKPSLKKRFYQVKIKSLEVTSLRELGQLMGQLQRQAFRKAYGKIWDLARVEVSMEPIASLSQYYDQPLRCFMRRIRILSSCEGFPNVPLMGARGCINYNPVLAIRQLGYPMRGAPLDESITPFITRGFSDPNAKDRELRGSSNGIIGGYHKWLRVRTQGLDWLPNLKTVRDDEVKASEESDEVQALKAELERAWVVKEKFKSIAIKV

SEQ ID NO: 112539 - protein, 85 aa, Glycine max
  Coding DNA Sequence Number=SeqID_20854
  Subcellular localization annotation: CTP_CleavageSite=48; ConfidenceScore=5.23e-01
CPDIVSDIVDPATSMLLATPVFSGRCPGHCIRHRGSCSFNAFSNSNVKEALLEGNLELATKKLSAKQSRKGTIEEGSSVAPQADT

SEQ ID NO: 112540 - protein, 191 aa, Glycine max
  Coding DNA Sequence Number=SeqID_20855
MRGVPSDESITPFIAWGFSDHNARDRELRGSSNRIIGGYHKWLRVRTQGLDWLPNLKTVRDNEVKASKKLMRAAIVSSSSEKVKGIITGQRHDLEGRAKGNMWAIIDECKEKLNLAATHEQRLEDEYAKISAEREARERVIDSLHQEATMRMDQFALTLNRSQELPRLLAKAKAMADTYSAPKEIHGLLSY

SEQ ID NO: 112541 - protein, 144 aa, Glycine max
  Coding DNA Sequence Number=SeqID_20856
MVKREMITVMVDTLPVFYYEKLVGYMPSSFADLVFAGERIEVGLKRGMFDYVSSTSTNARRIRATRAKWKEGDTHVVTSAPAWVNPPQTSHGTHQYAQHHLSFLARAGNSSNLAPIQPRAPAPIQREAPQASAPTTTRPAGNAH

SEQ ID NO: 112542 - protein, 202 aa, Glycine max
  Coding DNA Sequence Number=SeqID_20857
  Gene Ontology: Mol. function=sulfuric ester hydrolase activity; Cellular component=extracellular region; Biological process =metabolic process
  Homolog annotation: Hit_ID=A6X475; Match level="QueryCoverage=97%, HitCoverage=39%, E-value=1e-105, Identity=93%"; Hit description =Sulfatase
  Pfam annotation: Domain name=Sulfatase; Domain location=1-202; Score=- 48.9; E_value=0.0063; Accession=PF00884.14; Description=Sulfatase
FRRNNHQLEYDDEVAYQAEAKLYDLARGHDQRPWCLTVSFTHPHDPYVARKRFFDLYADIPELDPKIGPLDESGIDPHTERLLRACKAEDYDLTREQVRAARQAYFANISYVDEKIGALLDVIERCGMADDTIVVFTSDHGDMLGERGLWFKMSFFEGSARVPLMIAAPQLQAGRVDAPVSTLDVLPTLADLAGIDLKGIMP

SEQ ID NO: 112543 - protein, 96 aa, Glycine max
  Coding DNA Sequence Number=SeqID_20858
  Subcellular localization annotation: CTP_CleavageSite=70; ConfidenceScore=5.06e-01
MNKRFIAISSYAVCPRPFHLGFAQTTPRVNDFLLLCPGLLIVMQRKIVTSLISRKNRREKAPFHRLAAERAMPASSTRNASNQPKRDSCTQSKQPG

SEQ ID NO: 112544 - protein, 174 aa, Glycine max
  Coding DNA Sequence Number=SeqID_20859
  Homolog annotation: Hit_ID=A5BEV8; Match level="QueryCoverage=68%, HitCoverage=19%, E-value=4e-12, Identity=31%"; Hit description =Putative uncharacterized protein
MTKHQRSTKRDPSYWEYVDALYFVQNSNSSIKHSASSSDQTIPRRIMPMLDQFHQFIHDFIENIVNVKDDDNCGYHAIVVLLDKFEELKMSLLVDGLSMVTMDKWMDITDMGYVIALRYNVILVSLSLQQSMTFFPLRSQPPTDSSVHRVICIGHVYDNLFVQYIYDTVVPYRL

SEQ ID NO: 112545 - protein, 73 aa, Glycine max
  Coding DNA Sequence Number=SeqID_20860
RAFAKRETQWLSARKNPKEGKLSCSLSAPLQIIKCTASAHPLSERSAQSQNPLMCAKRFRFALSTRARTNPPI

SEQ ID NO: 112546 - protein, 358 aa, Glycine max
  Coding DNA Sequence Number=SeqID_20861
  Homolog annotation: Hit_ID=Q6WAY6; Match level="QueryCoverage=91%, HitCoverage=54%, E-value=1e-38, Identity=32%"; Hit description =Putative uncharacterized protein
MASIAQYYDQPLRCFTFGDFQLSPMVEEFEEILGCPLGGRKPYLFSGFYPSLARISKIVQISAQELDHRKQVENWVVGILRKYLEAKARISAGKGEWAPFIDILALLIFGGVLFPNVDGLVDLAAIDAFLAYHNHKESSVVAMLADLYDTFDRRCEKSNTRIACCTLALYVWLVSHLFRQEVRHACPLESHCSCTEKGGANWDRLLSSKEGASINWFPQWKEGRTGILISCGGFPNVPLMGTRGCISYNPVLAIRQIGYPMRGAPLEDELTPIVSRGFNKTNVETLQKVHKAWEVLRKKDKELRGSNNGPIGGYRKWLKAHVQGLIWLPSLRTTKREEVEAPEGDEEVQALRVELEQA

SEQ ID NO: 112547 - protein, 71 aa, Glycine max
  Coding DNA Sequence Number=SeqID_20862
MEVWYLLEAPNTLPIFVTKFASNEVLHSPIVLKVVGPLLLDSNSSRDDNNPHFQFPIWSLTNKETKDQNMK

SEQ ID NO: 112548 - protein, 204 aa, Glycine max
  Coding DNA Sequence Number=SeqID_20863
MAFKIVETDASDIGYGGILKQQVHGQEHVIAYTSNTGILHIKNISRALPTLYLTTSPVNFYRKFPMPPKVSSSSGRGGRSSTKGKEVLLALPEPITKKATTTSSGSPTQTGSSTQKGKLEGSLTQTTTVKPESSTQESPKPTTTKQTVADYAWSIQTLLALEDIGLTKIPKLAKKTWAEMASESDEDSETDLQKQIQKAKQTKT

SEQ ID NO: 112549 - protein, 68 aa, Glycine max
  Coding DNA Sequence Number=SeqID_20864
MDLSKICFYRMTVGILKTITSGLPISKNGVLSAIPTEGNYAERPKVLLSPIPTEGNCVERPKGALSKP

SEQ ID NO: 112550 - protein, 153 aa, Glycine max
  Coding DNA Sequence Number=SeqID_20865
  Homolog annotation: Hit_ID=A5BZH4; Match level="QueryCoverage=54%, HitCoverage=13%, E-value=5e-09, Identity=41%"; Hit description =Putative uncharacterized protein
  Pfam annotation: Domain name=zf-CCHC; Domain location=86-103; Score =21.5; E_value=0.00084; Accession=PF00098.14; Description=Zinc knuckle
PQEAKINLPYFYGKDNVEANLDWEIRVEQQIKRKSTSKSYGSHSYPKKDQGQVILGVTPSKSNDDKGKTIEKQPLKASMQEKTSSMKCFKCLGRGHITSQCPTKKTMIMRGQDIYVEAMSSKIILMMPKNQELRSSKELGVKKLQESRFKNNQ

SEQ ID NO: 112551 - protein, 142 aa, Glycine max
  Coding DNA Sequence Number=SeqID_20866
  Homolog annotation: Hit_ID=A0ST23; Match level="QueryCoverage=19%, HitCoverage=55%, E-value=2e-08, Identity=100%"; Hit description =Putative reverse transcriptase
  Subcellular localization annotation: CTP_CleavageSite=58; ConfidenceScore=5.47e-01
MDAWGANTFPVRKYNSRTFHLKVRRSRLFRFFRRFPQINVGGDSARIPFVEHTSRESRVALPPKGRLRQLATPLGIKLIDTVDLEGGPVGKPVVPAALMNRPTRGERRFAYWALAECILAYYVGTDEGVSEVLHVAGEKRLH

SEQ ID NO: 112552 - protein, 189 aa, Glycine max
  Coding DNA Sequence Number=SeqID_20867
MSHHSSSVNGKGTSHKDPLSRILDELSSLKLWKEKLERKEKGKERVKINQDEREQIREEERRKILKELRKEKHASYSSHNSCKSLSEELRDYYKGRHRSHLRPHSHMREKERKPQEANINLPYFHGKDNVEANLDWEIRVEQQLKRKSTSKSYGSHSYPKQDQGQGILGVTPSKPKDDKGKTIEKQPIK

SEQ ID NO: 112553 - protein, 40 aa, Glycine max
  Coding DNA Sequence Number=SeqID_20868
ENCPGNPLSSEILKREFGASSQKGNKHPEKSSPSMDSNRK

SEQ ID NO: 112554 - protein, 171 aa, Glycine max
  Coding DNA Sequence Number=SeqID_20869
  Subcellular localization annotation: CTP_CleavageSite=52; ConfidenceScore=5.21e-01
MSFDHHYFSLPFVIQRKSSPMTHRDQRGRLHPSSKTQCLSTETTEVSPRHPEASEPIDTQRPTWSSAPFVEDSMSIDRDYFSLSILSSIDNQVRRHVETNVRQPSLMAYGDHNGHSLSFFRDYQCLLIIQRQASPMFPLLSGDDQVRWHAETNIVVCFPCRKTQMSIDQSY

SEQ ID NO: 112555 - protein, 292 aa, Glycine max
  Coding DNA Sequence Number=SeqID_20870
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIKGQPYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112556 - protein, 64 aa, Glycine max
  Coding DNA Sequence Number=SeqID_20871
TVESTCSDDKSDEQNDGDNDEVYFVEAFGKRQHFAAGDGHVDYKLGVAEGGVEGAEAGNGNLNK

SEQ ID NO: 112557 - protein, 180 aa, Glycine max
  Coding DNA Sequence Number=SeqID_20872
MHTGQDFTQRPQCQSPPTEVSVGLCHDDIGKDRAHKTPSGPGEVQQGPGVSSSGYRPLSVLLGARPPSKVTLSVRIAPARHPVDPEKSNRVLGFPALITGLCQFYGVPVAPIKVIRTPINRAFIKKYCAPQAGAGRDTTAAWGWPAVGNRRTAATSRAPQLIYNPWPTNRRPSPKPKIYI

SEQ ID NO: 112558 - protein, 95 aa, Glycine max
  Coding DNA Sequence Number=SeqID_20873
MASKKRKTPSTPTQTKFDRSRFTSQEAWERYTDIVLPRKLLPERNVVIYYTEFDEFKEELERRHWDEKLTDFSNNNIDIAIVKEFYANLYDPEVT

SEQ ID NO: 112559 - protein, 123 aa, Glycine max
  Coding DNA Sequence Number=SeqID_20874
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQASYLGSKSCSLREPSKTALQG

SEQ ID NO: 112560 - protein, 143 aa, Glycine max
  Coding DNA Sequence Number=SeqID_20875
LFLDGGKGYNSAVECHLDVVEVISSSLIIPKPNRTPVEYEAPGYKLCLGMEENSESALSTNKEAISNATRNLMESSILAQDERWRHALHMQVGREVAEEQKEESARGGARWGIFRNGRKPDGAMPREGRRPTGHELLFPEKKQ

SEQ ID NO: 112561 - protein, 395 aa, Glycine max
  Coding DNA Sequence Number=SeqID_20876
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=Q7HDI4; Match level="QueryCoverage=100%, HitCoverage=84%, E-value=0.0, Identity=91%"; Hit description=ATP synthase subunit beta
  Pfam annotation: Domain name=ATP-synt_ab; Domain location=73-269; Score=263.2; E_value=5.4e-76; Accession=PF00006.16; Description=ATP synthase alphabeta family, nucleotide-binding domain
  Pfam annotation: Domain name=ATP-synt_ab_C; Domain location=282-389; Score=179.0; E_value=1.3e-50; Accession=PF00306.18; Description=ATP synthase alphabeta chain, C terminal domain
  Pfam module annotation: Pfam domain module=ATP-synt_ab::ATP-synt_ab _C; Domain location=73-269::282-389
MSATEGLMRGMEVIDTGAALSVPVGGATLGRIFNVLGEPIDNLGPVDTRTTSPIHRSAPAFIQLDTKLAIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMDDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVGNIDEATAKATNLEMESNLKK

SEQ ID NO: 112562 - protein, 62 aa, Glycine max
  Coding DNA Sequence Number=SeqID_20877
MMNQMIKMFDDDKGDDKKLKGKLKNTSRFKRKVEFKNQDSRIKLPRIKIKIQDSRFKNQEKT

SEQ ID NO: 112563 - protein, 99 aa, Glycine max
  Coding DNA Sequence Number=SeqID_20878
MRRRSSVGDLIPIDLEINATCRRRNQERISKFLQDLEAATIPEEEPQSSEASSSFPIIEHPHLDPIEDYIMAEDPRRVTLEDYSSSNVPQFFTSIAQLE

SEQ ID NO: 112564 - protein, 59 aa, Glycine max
  Coding DNA Sequence Number=SeqID_20879
MAEWTKASDANPLYKFCTEAQARKTQNPPFSYSSRPGLRPGSLDRNPKMKRETKNITTV

SEQ ID NO: 112565 - protein, 100 aa, Glycine max
  Coding DNA Sequence Number=SeqID_20880
  Homolog annotation: Hit_ID=A5AY05; Match level="QueryCoverage=88%, HitCoverage=22%, E-value=6e-07, Identity=36%"; Hit description =Putative uncharacterized protein
  Pfam annotation: Domain name=zf-CCHC; Domain location=75-92; Score =27.2; E_value=6e-05; Accession=PF00098.14; Description=Zinc knuckle
MELLILRAKLREEERTKQQLKRKPTSKSYGSHSYPKKDQGQCILGAAPSKPKDDKGKTIEKQPPKASMQEKTSSIKCFRCLGRGHIASQCPTKKAMGSKG

SEQ ID NO: 112566 - protein, 35 aa, Glycine max
  Coding DNA Sequence Number=SeqID_20881
EALPKRFRNVFREEFREGSTVFDVLHSFFIVSIST

SEQ ID NO: 112567 - protein, 133 aa, Glycine max
  Coding DNA Sequence Number=SeqID_20882
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=66%, HitCoverage=75%, E-value=2e-24, Identity=68%"; Hit description=LacZ protein
MAAIYAQVSSISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 112568 - protein, 73 aa, Glycine max
  Coding DNA Sequence Number=SeqID_20883
MKTPEEAMDLIENMAASDIAILRDRAHIPTKKSLLELTSQDALLAENKLLSKQLETLTETLRCTLDGGAHESG

SEQ ID NO: 112569 - protein, 370 aa, Glycine max
  Coding DNA Sequence Number=SeqID_20884
  Gene Ontology: Mol. function=calcium ion binding; Cellular component =integral to membrane; Biological process=cell communication
  Homolog annotation: Hit_ID=A3J1I0; Match level="QueryCoverage=77%, HitCoverage=42%, E-value=1e-48, Identity=40%"; Hit description =Putative uncharacterized protein
  Pfam annotation: Domain name=PKD; Domain location=298-363; Score =12.1; E_value=0.078; Accession=PF00801.11; Description=PKD domain
NIVFSQNRGQNIKLKQPTAESMKAGAFIDVNAAGYAESNYNITQLVKDVLIAGGSTCTTANVSNVNVSPNLPTTDQNRSWGYFNKAGTNFPFSKGIVLVTGFARKAGNNFQSVLSDPLPSGGDVDLATALNVNNANLRDATYIEFDFVPSSTEVSFRYLFASKEYSPSGTFTCSIADGFALLLKKVGDPTYTNLAVLPNGAGPVSVTNIIPSGLACGPKNAQYFAGMNNPQVETNFDGRTVPLTAKATVIPGETYHFKMVLADYQDVNFDSAVFLEAGSFDIGVQILGPGGVALPPSINMCDNTPQVLTASIQNATASYQWFLNNTPIAGATNATYTATQPGVYTLQVLLAGNTCPGTATVTIVGGTSPT

SEQ ID NO: 112570 - protein, 107 aa, Glycine max
  Coding DNA Sequence Number=SeqID_20885
MVMEEQEDNVGEEGEEAGNFWRKEREEEKSGPFWMLKSCIDLCAVSSVPVLRVSLHPSGPVFKGNRRWTSEIVPPLEAAVVHLQLAIGPPPAATVLGPTPAWGCNIS

SEQ ID NO: 112571 - protein, 122 aa, Glycine max
  Coding DNA Sequence Number=SeqID_20886
MKSQAATMHPSMINEQKLVLVVDELREVRMTNDMIYYDAMVLQSENKRSWLRRSISYNEMINQIHHVFIFLGSSTISLGSSLSIYRSCLPLKNRLVSRSCYNVPKLLGNRPRVRARVLAMLV

SEQ ID NO: 112572 - protein, 102 aa, Glycine max
  Coding DNA Sequence Number=SeqID_20887
MIMRGLDIYSSQDEATTSPSSSGSEEAKGEESSEEIYPQEEGQPLMVKEECQEVSVSSKRLATKEIHFAIKTTKKLPLLDNLHIFSFCTKTLVSAATLLGLE

SEQ ID NO: 112573 - protein, 91 aa, Glycine max
  Coding DNA Sequence Number=SeqID_20888
MARVAKVVKISAQELDRVKQNRNGVVGLPRKCLEEKAEAMVDQGEWTLFIDILALKESSVIVVLVDAYDTFELRCEKSGARIVCCMPALYV

SEQ ID NO: 112574 - protein, 121 aa, Glycine max
  Coding DNA Sequence Number=SeqID_20889
MSSLKEQMASMMDAIRPNSPSYRAPSSPKRGRTRKKHTGDISNPYLGYNRVAYPYELPPNYTPPVMRDDVGHVPSPIPEGEPPQHSVKVHEDHAQGDVDFYPPVLVEGLTPVILPQPNLPT

SEQ ID NO: 112575 - protein, 86 aa, Glycine max
  Coding DNA Sequence Number=SeqID_20890
  Subcellular localization annotation: CTP_CleavageSite=37; ConfidenceScore=5.47e-01
MVKVGTSYVPINVSFSPKVGPGLPGAPVASVSISCPSCSATDGVAAQLLGRAIGAGLFAITPAGERGMCCKAIKLGNARVFPVTTL

SEQ ID NO: 112576 - protein, 280 aa, Glycine max
  Coding DNA Sequence Number=SeqID_20891
MAFIIGESFGGSHTREGLPSHPTPSGMTRVPGVRTIVELPDTTLTPAARSTSHGKASVNAIQEGGPLRARRLGEVATSRHFIYQSLQAACMVSHGGGERDECLFHLGESHDMETCPAVEGLLQRLMDCGQLEVSIGGREEPQICMQSEEKKVPLTPKALVICFTRKGTGSTPIYPRTAPKPTPFAYQSNKAIPWKYTPPAFSERVATEVDSLSAKVTNITGLSGVTRSGRVFASPHLVELPSKGKAPMVQEPTDVATPSKEVDPPVVRGAEKKEGLQGKT

SEQ ID NO: 112577 - protein, 258 aa, Glycine max
  Coding DNA Sequence Number=SeqID_20892
  Gene Ontology: Mol. function=motor activity; Cellular component=cell projection
  Homolog annotation: Hit_ID=UPI00006A2939; Match level="QueryCoverage =85%, HitCoverage=100%, E-value=8e-14, Identity=31%"; Hit description= UPI00006A2939 related cluster
MSKSCGFGMTGPLDESISCFLIRVDPWVLVPITFRGLHVLANRGLHALTFRGLHVLALRGLHVLTFVGLHALAIRGLHVLTFRGLHALAIRGLHVLTFVGLHTLTIRGLHVLTFVGLHALTFRGLHVFANRGLHALTSRGLHVLTFVGLHALTFRGLHVLANRGLHALTLRGLHVLANRGLHALTLRGLHVLANRGLHALTLRGLHVLANRGLHALTSRGLHILALRGLHALTFRGLRVLIFSVLHICTVREFKVLYP

SEQ ID NO: 112578 - protein, 76 aa, Glycine max
  Coding DNA Sequence Number=SeqID_20893
MCRRNYQRQRIIKEKTLDEVSLSSSESETQHDHRSTSTSYIPMDPEKDTPNTKTSKELYGYKNIKERKGNNTKPKS

SEQ ID NO: 112579 - protein, 51 aa, Glycine max
  Coding DNA Sequence Number=SeqID_20894
MVKARQKGVRKPNEMKIKEKRGRWLPPSWPRRAGLLLPEGTAFCWNPLEGP

SEQ ID NO: 112580 - protein, 135 aa, Glycine max
  Coding DNA Sequence Number=SeqID_20895
SQQFSARNDAIVIRGVHEVATNPSASSETKKLEGKLDALVNLQPGAIEQPEAYAANIYNRPPQPQQQNQPQQSNYDLSSNRYNPGWRNHPNLRWSSPQQQQQQPAPSFQNVAGPSRPYIPPPNPTTATTPETANS

SEQ ID NO: 112581 - protein, 242 aa, Glycine max
  Coding DNA Sequence Number=SeqID_20896
  Homolog annotation: Hit_ID=A5C169; Match level="QueryCoverage=59%, HitCoverage=12%, E-value=3e-08, Identity=27%"; Hit description =Putative uncharacterized protein
FYSNLEIQEGTLISEVYGIKMVIDQSLFYDLTQLSSEGVPFEGTLNDDWKFDFSVGVARWLVCTNQADMTGRLLVGSLTFESRVLHYLIVRILLPRSSNLAQVSEEHLIVMWAFHTGRQIDWAHLVRYHMHKALRLNAPFPYPHLVTLFLQHFNIPLDSKPYVPIKRSFLIGATVIASFGYRKEHDGSWVKKGAQPIEEEGHLPLQVDMRFNEMDSRITKVEGDVSYIRTSFDLPPPPPPSS

SEQ ID NO: 112582 - protein, 64 aa, Glycine max
  Coding DNA Sequence Number=SeqID_20897
MGTKGWSFNGVSMEDEEERKSNVREREKASEMWADQMEAETSLYGRQDIPNSPSYLPTVILQNS

SEQ ID NO: 112583 - protein, 102 aa, Glycine max
  Coding DNA Sequence Number=SeqID_20898
YYTEFDEFKEELERRHWDEKLTDFADNNIDIAIVKEFYANLYDPEDKSPKQGENLCTYSRFALLRPDPQELDAKLCIPGRGFELNADGQPLKILRKNMTTLA

SEQ ID NO: 112584 - protein, 59 aa, Glycine max
  Coding DNA Sequence Number=SeqID_20899
MASFLVKPGKISSPPIVDADSPTVLHPSRNYHQLLLLLIFDHGEAGFLRDYLDGTHPLA

SEQ ID NO: 112585 - protein, 105 aa, Glycine max
  Coding DNA Sequence Number=SeqID_20900
MLAIISKYQEELNLATAHEHKVADEYAQVYAEKEARGRVIDSLHQEATMWMNRFALTLNRSQELPRLLAKAKAMADTYSAPEEIHGLLNYCQHMIGLMAHIIRNC

SEQ ID NO: 112586 - protein, 137 aa, Glycine max
  Coding DNA Sequence Number=SeqID_20901
MAAQLIHDRVEMECLEGAWETLEGNARCQFRGTIRFTATSLVHPDEPARTLQRTVEWILPTPTPYRLVEPVQVIEVTSSEEDPEEDLEELPPEPAMDALDFLEGDEDPLPEVDSPEEVMSASEANSTEDNGPREMAT

SEQ ID NO: 112587 - protein, 217 aa, Glycine max
  Coding DNA Sequence Number=SeqID_20902
MAKFDPDIVLEFYANAWPTEEGVLDMRSWVRGQWIPFDADALSQFLGYPLVLEEGQECEYGQRRNRSDGFDEEAIAQLLCIPGQDFARTAAGRRVRIMRTDMTTLTQIWMTLLLSNIQPSDHNSDLPLPKCQLVYAILTRMSIRVAQLIADAIYLFAGMAPTRHPLDPDKSNRALGFPALITGLCQSFGVPVAPSKVIRPPITRAFIEKYCTQRQAQ

SEQ ID NO: 112588 - protein, 64 aa, Glycine max
  Coding DNA Sequence Number=SeqID_20903
MRGLAKNVVATIVEALPCHSAMALGKNSAMRVEWRRRRVERRRHFKEKMSQEEPHHHRKPWIRA

SEQ ID NO: 112589 - protein, 149 aa, Glycine max
  Coding DNA Sequence Number=SeqID_20904
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MTRKQKDMEKQGGVSIAQKCSIQTEIHPQNPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 112590 - protein, 257 aa, Glycine max
  Coding DNA Sequence Number=SeqID_20905
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
GFPVSTGTPGFIYLRSDLPSQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDNPDMHNRCISTDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112591 - protein, 219 aa, Glycine max
  Coding DNA Sequence Number=SeqID_20906
WLSKLKVIDKENFEALEEDEEVRALKLELGKARLAKEKFKSTATHIRKECTELQEENAATARALEQETKRARKEEYGREKFRGALWGSNNELKLRREERDRSRVHGMILKEELVACARSKRSLAQHLEATEQSMLAIIGQYKEELNQSMAHEQKLVEDFAQVYAEKEARGRVSDVLHQEATIWMDWFAFTLNRSQDLPRLLAKAKVMAEVCTAPRRFMG

SEQ ID NO: 112592 - protein, 72 aa, Glycine max
  Coding DNA Sequence Number=SeqID_20907
MGTRGCINYNPVLAIRQLGYPMRGVPSDESITDAILPRKGPITRTMSKRLQEDWARAAEEGPRVLMNLRVDF

SEQ ID NO: 112593 - protein, 93 aa, Glycine max
  Coding DNA Sequence Number=SeqID_20908
SWSCQALITGLCQFYRVPVTSSKGIRPPTNRAFIKKYCIPRQAQGETPQQPGDGQQRATDAPPSPLEFTSAHPQKAVKRPAQDVKEALLGGNL

SEQ ID NO: 112594 - protein, 71 aa, Glycine max
  Coding DNA Sequence Number=SeqID_20909
MELTFEEVGVGLMNEILQRGIVVQLYNVLDLSIETMQKHCHGCLLRLLNLIPNQGNFHLFVILIHTPISLK

SEQ ID NO: 112595 - protein, 84 aa, Glycine max
  Coding DNA Sequence Number=SeqID_20910
  Homolog annotation: Hit_ID=A5AWG3; Match level="QueryCoverage=100%, HitCoverage=16%, E-value=2e-08, Identity=39%"; Hit description =Putative uncharacterized protein
MNIEESIHVTFDESNAILSRKNMLDDIADSLEHMNIDEQDSKGNDKGNNEDPPEEVKSNNELPREWKASRDHPLDNIIGDISKG

SEQ ID NO: 112596 - protein, 116 aa, Glycine max
  Coding DNA Sequence Number=SeqID_20911
MRHQIPMIGGMMNVLSGATLFCKITNASNIFMIHIHRDSLGSDQGVPTDPKRIKVIPEWSTPPTPLIELVRNHVPSRKGFSNLTLLQLSYPNFVRGPLLDDMRPFFGPCEVLGTHH

SEQ ID NO: 112597 - protein, 67 aa, Glycine max
  Coding DNA Sequence Number=SeqID_20912
MKILLIPHDVTPCGACRPWIFFINGVLCFLKIMEAEWRRKKDDWRRHSKEKMSQEQAHHHMKPWIRA

SEQ ID NO: 112598 - protein, 340 aa, Glycine max
  Coding DNA Sequence Number=SeqID_20913
  Gene Ontology: Mol. function=4 iron, 4 sulfur cluster binding; Cellular component=molybdopterin synthase complex; Biological process=Mo-molybdopterin cofactor biosynthetic process
  Homolog annotation: Hit_ID=A7ZJJ0; Match level="QueryCoverage=96%, HitCoverage=100%, E-value=0.0, Identity=99%"; Hit description =Molybdenum cofactor biosynthesis protein A
  Pfam annotation: Domain name=Mob_synth_C; Domain location=197-324; Score=168.4; E_value=1.8e-47; Accession=PF06463.4; Description =Molybdenum Cofactor Synthesis C
  Pfam annotation: Domain name=Radical_SAM; Domain location=29-192; Score=144.6; E_value=2.8e-40; Accession=PF04055.12; Description =Radical SAM superfamily
  Pfam module annotation: Pfam domain module=Mob_synth_C::Radical_SAM; Domain location=197-324::29-192
MTSPPVSGKVYMASQLTDAFARKFYYLRLSITDVCNFRCTYCLPDGYKPSGVTNKGFLTVDEIRRVTRAFARLGTEKVRLTGGEPSLRRDFTDIIAAVRENDAIRQIAVTTNGYRLERDVASWRDAGLTGINVSVDSLDARQFHAITGQDKFNQVMAGIDAAFEAGFEKVKVNTVLMRDVNHHQLDTFLNWIQHRPIQLRFIELMETGEGSELFRKHHISGQVLRDELLRRGWIHQLRQRSDGPAQVFCHPDYAGEIGLIMPYEKDFCATCNRLRVSSIGKLHLCLFGEGGVNLRDLLEDDTQQQALEARISAALREKKQTHFLHQNNTGITQNLSYIGG

SEQ ID NO: 112599 - protein, 234 aa, Glycine max
  Coding DNA Sequence Number=SeqID_20914
MGKKYFRSAPRTFYTSSSMAPEELEQLTQQIKDQLEELIIEKVTRRMMSSFSQMQSQFQSQMQSQGLALPPEPEGTIQTRVTHTNTGYTSKKILHAWFPLGRVYEGSTTVHNIPLLHDQGAVGPAKPVDRPDHEVMWDATVFGVFNEDFPLYIKHEDLSEIAHGGQCLSISVIQLWTLHLIETSMQAGNFDVYGFIEPQSIQRSGQSQFESKSYMKNWMQNSKWNVYLGAYMNG

SEQ ID NO: 112600 - protein, 51 aa, Glycine max
  Coding DNA Sequence Number=SeqID_20915
DSLEISEKNCFREENPSRGASVTLPRHFRERFREDSPPFFIVLRSFFGLQS

SEQ ID NO: 112601 - protein, 53 aa, Glycine max
  Coding DNA Sequence Number=SeqID_20916
MTKPMLDQFHPCIHNSIENIVDVKVNGMDGDSWSLVRNHLLKELEKWLPWISG

SEQ ID NO: 112602 - protein, 113 aa, Glycine max
  Coding DNA Sequence Number=SeqID_20917
  Homolog annotation: Hit_ID=Q6WAY4; Match level="QueryCoverage=87%, HitCoverage=18%, E-value=2e-10, Identity=37%"; Hit description =Putative uncharacterized protein
MRSSQVPSLKRRFYQVRVKSLGTTSLKELGQLMGQLQWQAFRKAYGKIWDLAMVEVSTKAIASLAQYYDQPLRCFTFGDFQLSPMVEEFEEILGCPLRGRKPYLFSGFYPSLA

SEQ ID NO: 112603 - protein, 434 aa, Glycine max
  Coding DNA Sequence Number=SeqID_20918
  Gene Ontology: Mol. function=RNA-directed DNA polymerase activity; Biological process=regulation of transcription, DNA-dependent
  Homolog annotation: Hit_ID=A5BZZ9; Match level="QueryCoverage=74%, HitCoverage=37%, E-value=3e-31, Identity=30%"; Hit description =Putative uncharacterized protein
MGKGRIKPQKGETTLFITDMTKANVSLPGTIKWDEVTLPEKWVMDKATPSIPKLAPSIEQIKQDNSSKVEITFNRRNCFSSRIEASRQSEYELTRRSFSVRTRSIPVGLSRFESHNQVSSINLQGLYMTSSIPRTTYNQEPEEDQKSIQSPTYFSIHEPYDHFRGAKRQQIQDKFYKFVEKVKINFPFFDWFHVYTTKENIDYPWQHDIISDSTTNVITNWQIKDGELIQSELPPTTQYQLPKINDNSDKLVMATPFKTKDVNEEITLKDIRSLMEQANYTNKYLLVLGESISKEKIFTKPKDHELSTSHVPKEKPLFEPFKVSENAKQKFRELRKHKSPTEEIGDNNSELLSKINSLLKTIPKTPQPSEESSKIRTRNTSKLINSINEDSEKIQNKHLKKVQCLKKKSIQLTPNIGNHLLSFITKDQLPLIFY

SEQ ID NO: 112604 - protein, 90 aa, Glycine max
  Coding DNA Sequence Number=SeqID_20919
MPFCGRARRGSRVRFPKEEKCTESPPTFICGKRWKNRRKPVEMKILSSGVVFTFEEVDKSRTFAPTYPPLERKSDLRSYFLRVNQAILFT

SEQ ID NO: 112605 - protein, 76 aa, Glycine max
  Coding DNA Sequence Number=SeqID_20920
MCQKSKESIVARSVKFRNMPEIKRKHCYAIREEVQIATKPTWAFQDVPPEGGAFWRKQPSSPGRAGWQAPPSFSYK

SEQ ID NO: 112606 - protein, 178 aa, Glycine max
  Coding DNA Sequence Number=SeqID_20921
  Gene Ontology: Mol. function=chloramphenicol O-acetyltransferase activity; Biological process=response to antibiotic
  Homolog annotation: Hit_ID=P62577; Match level="QueryCoverage=70%, HitCoverage=57%, E-value=1e-71, Identity=99%"; Hit description =Chloramphenicol acetyltransferase
  Pfam annotation: Domain name=CAT; Domain location=6-153; Score=275.1; E_value=1.5e-79; Accession=PF00302.9; Description=Chloramphenicol acetyltransferase
MEKKITGYTTVDISQWHRKEHFEAFQSVAQLFTLVGAVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQAGRNFFRQLLVPRNILSD

SEQ ID NO: 112607 - protein, 163 aa, Glycine max
  Coding DNA Sequence Number=SeqID_20922
  Subcellular localization annotation: CTP_CleavageSite=35; ConfidenceScore=5.07e-01
MPLIIGFFYRLDRTQPGSSRLILRETSERTCTLLRRSSIRSFSPIRPGRTTICTSVSMRALHQFPLANRPNRQDIHNHLSRRVARESLNPTEHYRVGRRCNPQGDPTNQLPCALRVYSPVDSHTCQTPWSVFQDGPNGEPTGRRQERAVPRHAKGARCHPQSR

SEQ ID NO: 112608 - protein, 78 aa, Glycine max
  Coding DNA Sequence Number=SeqID_20923
MGYWAVGYIAGGFENHYGIQDFQGFSHVELPGYLFCSLERNYSNRRRYMVLYKNVKTIRSSCIWDPHLVAAVEALSQE

SEQ ID NO: 112609 - protein, 182 aa, Glycine max
  Coding DNA Sequence Number=SeqID_20924
MQNFAVKIGAAGFWLVQKNACVWLAMESLVQNEFWIVFCLCSVLLGCDSLCCLNVVLLGCCGSLGGLMGTHALCGCGNLLCTIARPPPSTTCDGVVPGDMSRGSGDLGDVRRAPGSQQIKGTKTTKQGGLWWLASCEFCVIYGLWLWLENEVRKLRASGNRLPRRCNRLPGLELKATGCRGL

SEQ ID NO: 112610 - protein, 277 aa, Glycine max
  Coding DNA Sequence Number=SeqID_20925
EKFKLAATHIRKECAGLREENAITAKALEQETKRARKEEYGRNKFRGALWGSNSELKLRREEMDQSRAHSMVLKEELVACSRSKRSLSQRLCETETNMLAIIAKYQEELGLATAHEHRIADEYAQVYTEKEARGRVIDSLHQEATMWMDRFALTLNGSQELPRLLAKAKAMADTYSAPEEIHGLLGYWKNTITKRATRHPYRTRSKSRTMGDQEETQEQMKADMSALKEQMASMMEAMLGMRQLMEKNAATAAAVSSAAEADPTLLATAHHPPSNIV

SEQ ID NO: 112611 - protein, 45 aa, Glycine max
  Coding DNA Sequence Number=SeqID_20926
MAEQAKQAHGYYTCLASSSSSCSSISVSVYLEADTQSHTTTILGH

SEQ ID NO: 112612 - protein, 157 aa, Glycine max
  Coding DNA Sequence Number=SeqID_20927
LPSPLRGLHVLALKGLHVLERTTRPRLRGLHVLTSEGCTPLPRGLHCPRLKGYTPAHLRLPSRERTTRPHLERTTLLTIQRALLRPTLSRGLHAILPARVVYTSSPWRCYHALDLKKDYRALGPAEGCTASHLQRTAHSLPEGARPSGKYAHRSTDF

SEQ ID NO: 112613 - protein, 141 aa, Glycine max
  Coding DNA Sequence Number=SeqID_20928
  Homolog annotation: Hit_ID=Q6WAY6; Match level="QueryCoverage=73%, HitCoverage=18%, E-value=9e-12, Identity=34%"; Hit description =Putative uncharacterized protein
MDWDQLLAGIGGRTISWFPRWKEGKEGVLFSCGRYPNIPLVGTRGCINYNPTLAIRQLGYPMRGASTEESMSPFLVRDLGAQNSKTIQRIHKAWETPLRKDQELRGIRNGPFGGDEEVQALKSELGKAKLAKEKFKVAATH

SEQ ID NO: 112614 - protein, 106 aa, Glycine max
  Coding DNA Sequence Number=SeqID_20929
  Homolog annotation: Hit_ID=Q1RSH0; Match level="QueryCoverage=63%, HitCoverage=35%, E-value=7e-08, Identity=41%"; Hit description=H+ -transporting two-sector ATPase, alpha/beta subunit, central region, related
IIDDQWVWEADISGRYSVKSACSVLRQDVLEEAPAEAFKELWKLKVPSKVAMFAWRLLIDRLPTKDNLRRKQQSTSALVGILVLGEYGGCLPTTPKTALYPAHASI

SEQ ID NO: 112615 - protein, 90 aa, Glycine max
  Coding DNA Sequence Number=SeqID_20930
MSRNFTDRLMMGAEYLEVVKRGSHPNKHMAQNDHNLSLRALGHDRAWVARRRMTIICLCVPPDTIASGWQKGVGNDHNLSPPTSRLTVPE

SEQ ID NO: 112616 - protein, 210 aa, Glycine max
  Coding DNA Sequence Number=SeqID_20931
  Homolog annotation: Hit_ID=Q6UUU1; Match level="QueryCoverage=28%, HitCoverage=40%, E-value=2e-18, Identity=78%"; Hit description =Putative uncharacterized protein
  Subcellular localization annotation: CTP_CleavageSite=42; ConfidenceScore=5.14e-01
WNSYVPINVSFSPKVGPGLPAVPPVQLLTGWCVTAKAPPDISAGKCSGHAARRVPFAIQAAQLLGRAIGAGLFAITPAGERGMCCKAIKLDFKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112617 - protein, 238 aa, Glycine max
  Coding DNA Sequence Number=SeqID_20932
  Homolog annotation: Hit_ID=UPI00006A2D9E; Match level="QueryCoverage =79%, HitCoverage=87%, E-value=3e-07, Identity=14%"; Hit description =UPI00006A2D9E related cluster
GLHVLASVGLHALTFRGLHVLANRGLHALTFRGLHILAFRGLHVLALRGLHVLALRGLHVLTIRGLHALTSQRTTCPRLERATRPHLGGLHVLALRGLHVLTIRGLHALTSRGLHVLALRGLHALTLGTSYPHRSEDYTATALTFGTTRPHLERTTRGHALTFRGLHVLAIIGLHSLAFKRRHVLNFRGLHALAFRGLRVLTFILGPPPDIGGGPTVRAQPEREAITQLLCIPGQDFT

SEQ ID NO: 112618 - protein, 321 aa, Glycine max
  Coding DNA Sequence Number=SeqID_20933
  Homolog annotation: Hit_ID=Q2HW90; Match level="QueryCoverage=50%, HitCoverage=30%, E-value=8e-21, Identity=38%"; Hit description =Putative uncharacterized protein
VLFPNVDGLVDLAAIDDFLAYHHSKESPVVAILADLFDTFDRRCEKNSARIVCCLPALCVWLVSHLFQQDTRHPCPLQSYHSCAEKGRVNWDQHLAGIGGSAIKWFPRWKEGKEGVLFSCGNYPNVPLIGTRGCINYNPALAIRQLGYPMRGAPTEESLSPFLVRDLGAQSLKVIQRVHKAWRSPLRKDKELRGHPKWRHRWLSWMAKSSHVRNFEAPEEDEEVRALKLELGKARLAKEKFKSAATHIRKECTELQEENAASAIALEQETKRARKEEHGRKKFRGALWGSNNELKLRREERDWSRVHGMILWHPIGTSSRV

SEQ ID NO: 112619 - protein, 167 aa, Glycine max
  Coding DNA Sequence Number=SeqID_20934
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=76%, HitCoverage=96%, E-value=3e-24, Identity=51%"; Hit description =Putative uncharacterized protein
  Subcellular localization annotation: CTP_CleavageSite=61; ConfidenceScore=5.60e-01
MTMITPSSKLTLTKGNKSWYRAPPRVLKPSGVISHPSDTNSAQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 112620 - protein, 116 aa, Glycine max
  Coding DNA Sequence Number=SeqID_20935
  Subcellular localization annotation: CTP_CleavageSite=30; ConfidenceScore=5.55e-01
MCSPLKARTCSPLKVRACSPTKARVCSPLKARMSSPLMAIGSSTQGSTLMRKQEIDSLRGSVIQKYWTLDWMYPPLELIHKRCTLSCSQSNPSRCTLYLYHKGCTLQCVKTKILGD

SEQ ID NO: 112621 - protein, 87 aa, Glycine max
  Coding DNA Sequence Number=SeqID_20936
  Homolog annotation: Hit_ID=A5BEV8; Match level="QueryCoverage=85%, HitCoverage=9%, E-value=9e-07, Identity=39%"; Hit description =Putative uncharacterized protein
MSKLMVTVDIGSVAGLLGMGEDFWSVVRYHLLKELGNFSEDYTRLFGGMERFEELRMSLHVDGLTKVTMDKWMDITDMGHVIASRFI

SEQ ID NO: 112622 - protein, 227 aa, Glycine max
  Coding DNA Sequence Number=SeqID_20937
  Gene Ontology: Biological process=transposition, DNA-mediated
  Homolog annotation: Hit_ID=Q6UUU1; Match level="QueryCoverage=26%, HitCoverage=40%, E-value=3e-18, Identity=78%"; Hit description =Putative uncharacterized protein
  Subcellular localization annotation: CTP_CleavageSite=52; ConfidenceScore=5.12e-01
MVKVGTSYVPINVSFSPKVGPGLPWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112623 - protein, 123 aa, Glycine max
  Coding DNA Sequence Number=SeqID_20938
PPAAAEGPPHNEVSLFLEEGPPPFFQTANAVQDPLHGCSHKRWIDGRQVLPKGSQDGAILTRQLESGSVQTHVIRIRLRTRRASSYPDNSSFTGFYLSFTGLFVPSFMMELPSANRHSTAAPS

SEQ ID NO: 112624 - protein, 147 aa, Glycine max
  Coding DNA Sequence Number=SeqID_20939
GPAPWVLVTLTVERTTRPRLERTTRPHHQRAMHALTIRGLHVLALRGLHALILEGYTPSPWVLVTLTVERTTRPRLERTTRPHHQRAARPHLRGLHVLALRGLHALILGLHVLALRGLHVLTIRGLHALTSRGLHVLALRGLHALTL

SEQ ID NO: 112625 - protein, 122 aa, Glycine max
  Coding DNA Sequence Number=SeqID_20940
MADRGGGGNRPQRRTLGDYAYQQGPKHYNNIVIPPFNNKVMEPPPLSLIGSHPFAGMDHEDPYTHLSTFMELHSTMQILRSFTVVCVGWLVNIVVTGKKGFICIHKGGLVPDWLNHTIWATV

SEQ ID NO: 112626 - protein, 77 aa, Glycine max
  Coding DNA Sequence Number=SeqID_20941
MLKLSDNIIRFHRRVVLGILEVVSRPWRLTVGNWLCDLDLVNPTGIERVLIEKDLLADSYSDLEASILDENEFFLLK

SEQ ID NO: 112627 - protein, 88 aa, Glycine max
  Coding DNA Sequence Number=SeqID_20942
NLQDSGTLKRVAWGLDVGTGASCYFILKQPCSPERAGYFTMKLFSGPGEPGASLDKPGGSKDKDTNFVQAILLFGQATGEQGSETEKT

SEQ ID NO: 112628 - protein, 114 aa, Glycine max
  Coding DNA Sequence Number=SeqID_20943
MDRKMQGSCMSEHNMRTVKIECMQLAEQKNLMERIQKSPSSDNSKGWFHVTLLASRDIILLGNTLWRYGLSATMHHQKRKTLDEASLLLSESETQHDHRSTSTPYGSHIPGYRA

SEQ ID NO: 112629 - protein, 216 aa, Glycine max
  Coding DNA Sequence Number=SeqID_20944
  Gene Ontology: Cellular component=integral to membrane
  Homolog annotation: Hit_ID=A9CIT0; Match level="QueryCoverage=81%, HitCoverage=81%, E-value=3e-88, Identity=93%"; Hit description =Putative uncharacterized protein
  Pfam annotation: Domain name=DUF1003; Domain location=78-208; Score =278.3; E_value=1.6e-80; Accession=PF06210.2; Description=Protein of unknown function (DUF1003)
MNFGEGRLNAWWRKTFEFRHHAGLSRESSAPPIRTGDTPVSDISDYIVSHFKRSSREIGEVERRILELAHQKKLVSSDINAEFSAGASFGDRLADKIARVGGSWSFILGFCFFLIFWAIINTIVLTTRAFDPYPFIFLNLLLSMLAAIQAPIIMMSQNRQAARDRFEAAKDYEVNLKAELEVLSLHEKIDVKVLAELAALRQDLAALHRHVTRRED

SEQ ID NO: 112630 - protein, 35 aa, Glycine max
  Coding DNA Sequence Number=SeqID_20945
  Gene Ontology: Cellular component=integral to membrane
  Homolog annotation: Hit_ID=Q2PMP0; Match level="QueryCoverage=91%, HitCoverage=1%, E-value=1e-10, Identity=100%"; Hit description =Putative membrane protein ycf1
LETRNRAKAEYPDQRNLESSISNQEKDIENDYWIR

SEQ ID NO: 112631 - protein, 268 aa, Glycine max
  Coding DNA Sequence Number=SeqID_20946
  Homolog annotation: Hit_ID=Q2HW90; Match level="QueryCoverage=64%, HitCoverage=35%, E-value=1e-17, Identity=32%"; Hit description =Putative uncharacterized protein
MWMGLVDLAAIDAFVAYHDHKESPVVAMLADLYDTFDRRCEKSSMRIVCCTLALYVWLVSHLFRQELRHACPLESHRSCTEKGRENWDQLLANKEGASVNWFPRWKEGRTGVLISCGGFLNVPLMGTRGCISYNPVLAIRQLGYPMRGAPLEYELVPKVCKAWEVLQKKDKELRGSNNGTIGGYRKWLKAHVQGLDWLPSLRTTKREEVEAPEEDKEVQALRVEVEQAQTVKERFKSAALKIRKENTELRDVNVATTKALERETKSGL

SEQ ID NO: 112632 - protein, 107 aa, Glycine max
  Coding DNA Sequence Number=SeqID_20947
  Gene Ontology: Cellular component=integral to membrane
  Homolog annotation: Hit_ID=Q8ABK8; Match level="QueryCoverage=100%, HitCoverage=15%, E-value=6e-34, Identity=62%"; Hit description =Putative transmembrane mobilisation protein
LIPASKISTLTQGFFVGAVSDNFDERIQQKIFHSEIVVDNVKLSQEMKSFQQIPSIRSFIDEDGNDSMTRQIQDNYREIKSDILNIITDEMDRIKNDPELQHLLKSD

SEQ ID NO: 112633 - protein, 240 aa, Glycine max
  Coding DNA Sequence Number=SeqID_20948
  Gene Ontology: Biological process=transposition, DNA-mediated
  Homolog annotation: Hit_ID=Q6UUU1; Match level="QueryCoverage=30%, HitCoverage=49%, E-value=4e-18, Identity=67%"; Hit description =Putative uncharacterized protein
EPLRADQRLISPKVGPGLPGINRDTRIYFILRSDLPSQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCASEMAYERGGDFLEDARRYLTG

SEQ ID NO: 112634 - protein, 25 aa, Glycine max
  Coding DNA Sequence Number=SeqID_20949
DIFINFDLFDRDVWDSWVYVSIIDP

SEQ ID NO: 112635 - protein, 147 aa, Glycine max
  Coding DNA Sequence Number=SeqID_20950
MASMMDAMLGMRHLMENNVATAAADEKEAHWGTSATAILEYNRVAYPYGLPPNYMPLVMRDDAGHVPSPILDGEPPRQSDEVHEDRREYAQGDIDFYPPGPHRGAGTQHTALAQPPSTTNILVHRRTTPDSGRMKETRSHRREIESY

SEQ ID NO: 112636 - protein, 177 aa, Glycine max
  Coding DNA Sequence Number=SeqID_20951
FLETRLVLEEGQECEFSQRRNRADGFDKEAIAQLLCIPGQDFARTAAGRRVRIMRTSMTTLTQMWMTLLLNNVLPSDHNFDLPLPKCQLVYAILTRMSVHVAQLIADAIYLFVGMPPTRHPLDPDKSNRALGFPALITGLCQSFGVPVTPSKVIRPPITRAFIEKYCTPRQAQGDAP

SEQ ID NO: 112637 - protein, 106 aa, Glycine max
  Coding DNA Sequence Number=SeqID_20952
MIRGDTLQLSAPFCHPEAAGPMTSRDKIWSFCTLVSSRGGRPDDTRRYLTVIRTLLSSRGGGPDDKQRQNLVIRRGYHPEAAGPMIRGDTLRLSAPFCIIQRRRAR

SEQ ID NO: 112638 - protein, 41 aa, Glycine max
  Coding DNA Sequence Number=SeqID_20953
MNSLSEHAALKLAKRSYRTKRVHPLRMNTYPLAELPVAKRG

SEQ ID NO: 112639 - protein, 111 aa, Glycine max
  Coding DNA Sequence Number=SeqID_20954
MSSKVILMMPKNQELSKVSSKDSRIKFQDSRFKIQEKSRSRFKTQDSRIMRRLNQDKGYIYLGIVILRTREGTSLVDQFKWRVHPLGCSKRTREGTSLEDLWLVKDFRRLK

SEQ ID NO: 112640 - protein, 97 aa, Glycine max
  Coding DNA Sequence Number=SeqID_20955
EDPWVHALAFRGLHVLAFKGLHALAFRGLHIIPCRGLHVLTFRGLHVLAFRGPHTLSFSGLDALTFKGGRSTVRAHPEREAITQLLCILGQDFTRAA

SEQ ID NO: 112641 - protein, 83 aa, Glycine max
  Coding DNA Sequence Number=SeqID_20956
  Subcellular localization annotation: CTP_CleavageSite=58; ConfidenceScore=5.44e-01
MIHLLEAGWGRRVHLSNNAGSGNCNRIGLPLSSSRSSWPPSLWPFSLSWPSMSAFIFSCTSSASPITLALARVRKECNEQCNQ

SEQ ID NO: 112642 - protein, 98 aa, Glycine max
  Coding DNA Sequence Number=SeqID_20957
  Homolog annotation: Hit_ID=Q1RU80; Match level="QueryCoverage=97%, HitCoverage=94%, E-value=2e-08, Identity=32%"; Hit description =Putative uncharacterized protein
EVTINLDDVASLLYLSIIRVFHSFKQLHVDNIVYMLVELLESETYTWGVVALVYMHDNLNKASKSTTRQLVGYITLLQCWIYEHFLFIGSAIAVKDYD

SEQ ID NO: 112643 - protein, 126 aa, Glycine max
  Coding DNA Sequence Number=SeqID_20958
MTQELVARGDTLRLSAPRHSVTQRQNLVILHPLSSRGGGPDDTRRQNLVIPHPFAIQTQSCPMARRDKIWSFCTLVSSRGGGPDDTRRYLTVIRTLLSSRGGGPDDKQRQNLVILHPCVIQRRRAR

SEQ ID NO: 112644 - protein, 48 aa, Glycine max
  Coding DNA Sequence Number=SeqID_20959
MGRRSLTRTPLGILGCLPAALLACSELDMGRRSVDHGPSLYSHPSLST

SEQ ID NO: 112645 - protein, 183 aa, Glycine max
  Coding DNA Sequence Number=SeqID_20960
  Subcellular localization annotation: CTP_CleavageSite=33; ConfidenceScore=5.46e-01
MNVRALISGQITSMAQSNSSRLGFPALSTALCRTRGVASDNLVFERLSPFINLAYIRKNCWNPDDPTIIIRGARRPRARPVETPSTSAAPPPARIAAAPSTPPPVEFQRFEAMLRSIHHGQIILLQTWPWTQPPLHRDDEDPAAQVPHQPSDESSESSTPEPLIRKRREEVQTWDTQDQSQDL

SEQ ID NO: 112646 - protein, 69 aa, Glycine max
  Coding DNA Sequence Number=SeqID_20961
MKKILGLQAPMELASQPKFTLHEVKTVNTVQFRRYCASVHIRTLGDPIISVPMLLCGWPKNCVTEHESK

SEQ ID NO: 112647 - protein, 299 aa, Glycine max
  Coding DNA Sequence Number=SeqID_20962
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSINLNPNISSFHKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112648 - protein, 60 aa, Glycine max
  Coding DNA Sequence Number=SeqID_20963
MSQPTLQLECEGNIDKPKRPSPREKMSGVATNVYLRKTLEKLKRGKVLAPYTPVTRDDSL

SEQ ID NO: 112649 - protein, 188 aa, Glycine max
  Coding DNA Sequence Number=SeqID_20964
  Homolog annotation: Hit_ID=A7UQU7; Match level="QueryCoverage=48%, HitCoverage=16%, E-value=1e-09, Identity=37%"; Hit description=IMP dehydrogenase/GMP reductase, putative
MKGITGAPYRARCDGLTVTDVSWLPYTEHRGVRAFQEISSFQGQLRWGPMIVTVRPERVVRQFGYIQSIPPPPVSARLSHDQIDDRWMEFADHLLPAGQPCLVPGQAADQQRDAPAADPEDYIQPPSPQDDYEGYEAIAQRLERVLNLRIVTAGTELYDIMQDCLTIARGRPSADGTVRARQRRRTDH

SEQ ID NO: 112650 - protein, 19 aa, Glycine max
  Coding DNA Sequence Number=SeqID_20965
NDSGRVQGVRFWGGAVEPT

SEQ ID NO: 112651 - protein, 111 aa, Glycine max
  Coding DNA Sequence Number=SeqID_20966
MYLVFNSALKGLDDTPQPKSKAATRWIVVEYFNEVRPLEAERFKALHIHQCCKFYVNIGFFKTNVNDNTFNIGCDDEDDEKRGLAIATICEGSKEVWAQRETMRSWAQELE

SEQ ID NO: 112652 - protein, 150 aa, Glycine max
  Coding DNA Sequence Number=SeqID_20967
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=56%, HitCoverage=72%, E-value=3e-24, Identity=69%"; Hit description=LacZ protein
MNLEDLGLSFVETTLQFFSAFSIFTLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 112653 - protein, 79 aa, Glycine max
  Coding DNA Sequence Number=SeqID_20968
MSDSDIRAVFPLDRAILTEPEGAVNLGAAPSSKSGRKGIFPWDTSIALIGKWRRLGHCRGVLRPGADHNPSETYYQGFW

SEQ ID NO: 112654 - protein, 150 aa, Glycine max
  Coding DNA Sequence Number=SeqID_20969
MTTLTQIWMTLLLSNILPNDHNSDLPLAEVPVGLHYLDPGIMPLRHSVGPEKSNRALGFSALIMSLCQFYGVSVTPTKLIRPPINRAFIEKYCMPRMELQMHTDQQAANHRGAGPARTPKEEDRAQEHDDMADVMDFFLVKSLGEDHLKL

SEQ ID NO: 112655 - protein, 47 aa, Glycine max
  Coding DNA Sequence Number=SeqID_20970
MAQRINEGRGVEKGACWRGLQDMLITASWMDTLDTIRLQWTPRIRRR

SEQ ID NO: 112656 - protein, 146 aa, Glycine max
  Coding DNA Sequence Number=SeqID_20971
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=2e-24, Identity=55%"; Hit description =Putative uncharacterized protein
  Subcellular localization annotation: CTP_CleavageSite=40; ConfidenceScore=5.36e-01
MTMITPSSKLTLTKGNKSCYNVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 112657 - protein, 68 aa, Glycine max
  Coding DNA Sequence Number=SeqID_20972
MDNFQSCVILGESDVNILFPIPRLWLPAVPAPDPAPVIDYALDAVINSPLEQFEIIPLIPMLYSRLEI

SEQ ID NO: 112658 - protein, 198 aa, Glycine max
  Coding DNA Sequence Number=SeqID_20973
MEVMMSMKKIMEVNAAAVAATSVVAKVDLTPPSSLNQINHPTSDMSKYAFLPYGLPPNFAPPSVVRPPDKNVNYSTPVLIENQQPRSDHAYVPQLMGETHEIPHHNLADFESLLGYAAEGQAVGGVPLPNTLEGPQFLQLPQPLHFVAGRIPLAMAEKGKLDHIEERHRAVERGGSYAFANTAELCLVPDIAIPPKFK

SEQ ID NO: 112659 - protein, 70 aa, Glycine max
  Coding DNA Sequence Number=SeqID_20974
  Subcellular localization annotation: CTP_CleavageSite=46; ConfidenceScore=5.34e-01
ATGGFTSMAISSNNHTTKVMQAPLELVGLGSSSSMDSFASWKMNGSGMEKEEGEETPLQGEDESRRSSPP

SEQ ID NO: 112660 - protein, 153 aa, Glycine max
  Coding DNA Sequence Number=SeqID_20975
MSSKVILMMAKNQELSKVSSKDSRIKFQDSRFKIQDSRIIKIKIQESREDSIKISIKKFFKTLSSTRSFHKIITKDFYSLVIDYQKRVHLLGDCYTENKRGYISCGSVQVEGTSTWIFKENKGGYIPCGSLACKGFYKVERNLKNRRLLGDWM

SEQ ID NO: 112661 - protein, 35 aa, Glycine max
  Coding DNA Sequence Number=SeqID_20976
EKEGEACHPARPGKLGCFLQKAPPSGELPGRPKWA

SEQ ID NO: 112662 - protein, 148 aa, Glycine max
  Coding DNA Sequence Number=SeqID_20977
QLEVGNRGWWVYARFVDVENLWCTIARPPPSTTCDGVVPGDMSRGSGDLGDVRRAPGSQQIKGIETTKQGGLCGGWPAVNLAVEASGNRLPVCVIDYTEEWVTGNRLPKRCNRLPGLKAMRAVEASGNRLPVCVIDYTEEWVTGNRLQ

SEQ ID NO: 112663 - protein, 164 aa, Glycine max
  Coding DNA Sequence Number=SeqID_20978
  Homolog annotation: Hit_ID=A5ATL8; Match level="QueryCoverage=20%, HitCoverage=26%, E-value=2e-10, Identity=93%"; Hit description =Putative uncharacterized protein
NKLTKAMISSCREMISTLGLRHGPDSTGGSSGEFSAMGESLTEQCRVKVEGLRVMNFFSRRRSNDVRRQIPGLNPGQAVETTKLEYETKARGANGIRYPSSPSRKRWILGAVRIDPCNAVANALSIPPGETLPGLDMPRILLKERGAFGNADTGGAWLSSARAV

SEQ ID NO: 112664 - protein, 249 aa, Glycine max
  Coding DNA Sequence Number=SeqID_20979
  Gene Ontology: Mol. function=ion channel activity; Cellular component= integral to membrane; Biological process=ion transport
  Homolog annotation: Hit_ID=Q5D6H2; Match level="QueryCoverage=28%, HitCoverage=10%, E-value=1e-31, Identity=90%"; Hit description=CNGC2
MDGGLAAMVTVARTCVDAVHLLHVWLQFRLAYVSRESLVVGCGKLVWDARDIASHYLRSLKGFWFDAFVILPFHSLYPTLPSTNTRFFRSIFFLTRTCLPLRSSLWRLEENSGVIEKSNVNNTFSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAHPVSS

SEQ ID NO: 112665 - protein, 100 aa, Glycine max
  Coding DNA Sequence Number=SeqID_20980
  Gene Ontology: Mol. function=phosphonate transmembrane transporter activity; Cellular component=outer membrane-bounded periplasmic space; Biological process=phosphonate transport
  Homolog annotation: Hit_ID=Q83P96; Match level="QueryCoverage=82%, HitCoverage=24%, E-value=2e-37, Identity=92%"; Hit description =Periplasmic binding protein component of phosphonate transporter
MLAKRKELTFGNGDPNSTSGYLVPGYYVFAKNNASASDFKRTVNASHETNALAVANKQVDVATNNTENLDKLKTSAPDKLKETQGYLEITSHPRRPDCLA

SEQ ID NO: 112666 - protein, 139 aa, Glycine max
  Coding DNA Sequence Number=SeqID_20981
MGPFLSDPQKPLVGGIGRLEEKDRPHMLSRGGYDYLEQKLMAEKTKKRLKESAQSRSTEGVIDPPSPIRRHVSQGSFVPHGRQDLLTVAIGRPEHPDHVRAAGVSVTIKQYFGLVQRSFRSSSSMPPKELEQLTQQIRD

SEQ ID NO: 112667 - protein, 199 aa, Glycine max
  Coding DNA Sequence Number=SeqID_20982
  Homolog annotation: Hit_ID=Q84VH5; Match level="QueryCoverage=90%, HitCoverage=29%, E-value=2e-77, Identity=76%"; Hit description =Envelope-like protein
MVDIDVSEHQIAKEITAKRVQHWPKKGKLSAGKLSVKYAILHRIGAANWVPTNHTSTVATGLGKFLIQNHLLSKLPIAFPTVLCGIMLSQHPNILNYTDSVMKRESPLSLHYKLFEGTHVPDIVSTSGKAAASGAVSKDALIAELKDTCKVLEATIKATTEKKMELERLIERLTESGIDDGEAAEEEEEAAEREMQQRY

SEQ ID NO: 112668 - protein, 67 aa, Glycine max
  Coding DNA Sequence Number=SeqID_20983
  Gene Ontology: Biological process=transposition, DNA-mediated
  Homolog annotation: Hit_ID=Q1J7G7; Match level="QueryCoverage=44%, HitCoverage=42%, E-value=2e-10, Identity=100%"; Hit description =Transposase
GFPGINRDTRIYLFLRSDLPSQWLLFLSAVPPVQLLTGWCVTAKAPPDISAGKCSGHAARNHHTRRA

SEQ ID NO: 112669 - protein, 215 aa, Glycine max
  Coding DNA Sequence Number=SeqID_20984
MPKKPTAQDVRLAEVAQAPAHQRDDADEGGALEHVEVGRVRRIDGSEGGVEAASGDQHDHRGEDQRKDHQRSLHGVGPAHCQETTDEGVGDGRCGTGPQGGFVRHAEGALEQAGTGNDAGSAVDGEEHQDHDGRDDPQHAAVVFEAAGEVVRQGQCIAVVLGLHAQTASDEQPVRRHRRSGRWQSRLRTGQRNRWRPAGPSAASRSCRKHRRKAR

SEQ ID NO: 112670 - protein, 469 aa, Glycine max
  Coding DNA Sequence Number=SeqID_20985
  Gene Ontology: Mol. function=transferase activity, transferring glycosyl groups; Cellular component=integral to membrane; Biological process=metabolic process
  Homolog annotation: Hit_ID=Q8S9A6; Match level="QueryCoverage=98%, HitCoverage=97%, E-value=0.0, Identity=80%"; Hit description =Glucosyltransferase-3
  Pfam annotation: Domain name=UDPGT; Domain location=4-466; Score= -50.0; E_value=4.4e-08; Accession=PF00201.9; Description=UDP -glucoronosyl and UDP-glucosyl transferase
MKDSIVLYSALGRGHLVSMVELGKLILTHHPSLSITILFLTPPPNQDTPTSPTAFTCDATSKYIAAVSAATPSITFHRIPQISIPTVLPPMALTFELCRATTHHLRRILNSISQTSNLKAIVLDFINYSAARVTNTLQIPTYFYYTSGASTLAVFLYQTIFHENYTKSLKDLNMHVEIPGLPKIHTDDMPETVQDRAKEVYQVFIDIATCMRDSDGVIVNTCEAMEERVVEAFSEGLMEGTTPKVFCIGPVIASASCRKDDNECLSWLDSQPSHSVLFLSFGSMGRFSRTQLGEIAIGLEKSEQRFLWVVRSEFENGDSVEPPSLDELLPEGFLERTKEKGMVVRDWAPQAAILSHDSVGGFVTHCGWNSVLEAVCEAVPMVAWPLYAEQKMNKVILVEEMKVGLAVKQNKDGLVSSTELRDRVMELMDSDRGKEIRQRIFKMKISATEAMTKGGSSIMALNRKYKTDH

SEQ ID NO: 112671 - protein, 79 aa, Glycine max
  Coding DNA Sequence Number=SeqID_20986
  Subcellular localization annotation: CTP_CleavageSite=28; ConfidenceScore=5.27e-01
MWLARANEPASSLLVISAWLVQTNRRASCTEKSNFQSSSSAPSNGSMIEREEKRFVYRICCSSDENNEEEEMEEGIGVS

SEQ ID NO: 112672 - protein, 68 aa, Glycine max
  Coding DNA Sequence Number=SeqID_20987
MSRNLMDYAIVPSFGFRNVTELYGLRITLPFHSRHVAELHGLPNRWVPSTSKVVMPKVGIPPNRMGPG

SEQ ID NO: 112673 - protein, 112 aa, Glycine max
  Coding DNA Sequence Number=SeqID_20988
  Subcellular localization annotation: CTP_CleavageSite=68; ConfidenceScore=5.34e-01
GSHPTRHPVDPGKVQQGPGVSSSSYGPLSILQGARIAPARHPVDPKKSSRFYRVPVTSSKGIRPPTNRAFIKKYCVSRQAQGETPQQPGDGRQRATDAPPSPLEFTSAHPQK

SEQ ID NO: 112674 - protein, 351 aa, Glycine max
  Coding DNA Sequence Number=SeqID_20989
  Homolog annotation: Hit_ID=Q6UUU1; Match level="QueryCoverage=17%, HitCoverage=40%, E-value=5e-18, Identity=78%"; Hit description =Putative uncharacterized protein
  Subcellular localization annotation: CTP_CleavageSite=74; ConfidenceScore=5.11e-01
GAPVASCFYQLSLPVQLLTGWCVTAKAPPDISAGKCSGPAARNHPPPPRLMRRYRARPIRHSGCATVGKGAPVRASSLFPQLAKGGCAARRLSWGELELPRGGGRSRTSGSPGLQEFDLADYLLHGGYDTHLRRLRRLLAQRQSMMRQAITHHFPSTVKVSQPDGDQAYRYRRPRGGARYQLLFPLVRVNFELGVIMVIAVSCVKLLSAHNSTQHTSRKHRGVKPGVPNGGGLTHINCVALTARFPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 112675 - protein, 117 aa, Glycine max
  Coding DNA Sequence Number=SeqID_20990
MFDKQAAVSPAKPPDRPDPEVDDPLYLMTLTIPQLFLKPFQVMWDAIVIGVFNQHFPFYIKHEDLSETAHDGQCLSISIIQLWILLIRKALKSVVFHLLAKPICWLSEHSLSATLMG

SEQ ID NO: 112676 - protein, 78 aa, Glycine max
  Coding DNA Sequence Number=SeqID_20991
DEAATSPSSSESEEAKGEESSEEIYPQEEGQPLVVKRSTLASIATPLGLEFIPQVKKLLDEGLVCKSLNPCALLVPKI

SEQ ID NO: 112677 - protein, 50 aa, Glycine max
  Coding DNA Sequence Number=SeqID_20992
MGAKHLKAVKQRLHAIKQWSPDEIRPKLQNLDPSSDRINPSFVLRSLLLD

SEQ ID NO: 112678 - protein, 96 aa, Glycine max
  Coding DNA Sequence Number=SeqID_20993
MVEEFEEILGCPLGGRKPYLFTGFYPSLARISKIVQISAQELDHRKQVKNGVVGIPRKYLEAKARILAAIDAFLAYHNHKESPVVAMLADLYDTFD

SEQ ID NO: 112679 - protein, 119 aa, Glycine max
  Coding DNA Sequence Number=SeqID_20994
HTQEVHYMGNQQRQGYNQGGFSRFQQGPYNQQGQWRSHPSNQFNKDQALKNLEIQVGQLAKQLAEKSSSSFGANTEKNPKEECKVVIIRSRKLVVAEDEDVVALKEQVSLKDTTYKKEE

SEQ ID NO: 112680 - protein, 177 aa, Glycine max
  Coding DNA Sequence Number=SeqID_20995
LHVLTIQKGCTPSSSRGLHVLALRGAARPHLGYKLPSPLRGLHVLALRGLHVLTIRGLHALTSRGLHVLALRGLHALTLVTLTVERTTRPRLERTTRPHLQRATVLASEDFILAIRGLHALTSRGLPVLALRGLHVLTLGTSYPHREGTRPRLERTTRPHHRGLHALTSRGLHKSSP

SEQ ID NO: 112681 - protein, 147 aa, Glycine max
  Coding DNA Sequence Number=SeqID_20996
MASKKRKSIGTRPTYQYDTRRFHSFEAWTRYTNNVLGRHILPKRKVEIYHTELDEFKAELETCNFHKCLTNLVDISIDLVLVKEFYANLYSPKGPSPKQVRVRGHVVKIDVDNLNTFLETPVATLGRFSSGGGVSHTQLALLSHTPD

SEQ ID NO: 112682 - protein, 41 aa, Glycine max
  Coding DNA Sequence Number=SeqID_20997
MQKGLRTRQYLNNTELSPGNYLQNQVMTYLWFRIRIKHLPV

SEQ ID NO: 112683 - protein, 251 aa, Glycine max
  Coding DNA Sequence Number=SeqID_20998
  Homolog annotation: Hit_ID=Q6WAY6; Match level="QueryCoverage=21%, HitCoverage=9%, E-value=3e-09, Identity=53%"; Hit description =Putative uncharacterized protein
DFQLVPTVKEFKEILGCPLGGRKPYLFSGFYPSTTRVAKVVKISAQELNQQSTFFSPIITTRKVRLSLCQPTYMTPLTEDVKKAMQGLFVVLQLSMWGWFHTFFSKKVGPSIRYKEGRIRILSSCEGCPNVPLRGTRGCINYNPVLAIRQLGYPMRGAPLDESITPFIARGFGDHNARDRVLRGSSNGIIGGYHKWLRVRTQGLDWLPNLKTVRDDEVKASEESDEVQALKAELERARVVEEKFKSIAIKV

SEQ ID NO: 112684 - protein, 48 aa, Glycine max
  Coding DNA Sequence Number=SeqID_20999
MREKFHSYLGVVAREKVPIIHNNWKDVPETLKEIVWNDILGAGVVFYP

SEQ ID NO: 112685 - protein, 141 aa, Glycine max
  Coding DNA Sequence Number=SeqID_21000
MHKALRANAPLPYPQLITLFLCHFQITLDDEPFVQVKHSFAIGAGAVTSFGYRKDQNGQWLKKDALPPQYERIPSPPPQRDDSVLMTEVLSELRGLRSYVGERFDSLDTRFAGMDIRLTQLEEDVGYIRQSFDLPPPPPPS

SEQ ID NO: 112686 - protein, 66 aa, Glycine max
  Coding DNA Sequence Number=SeqID_21001
MARSVSASCPYSKDLYGRELTRLLVIIPKVVISLLMVSRGINETLGLIPDFGYGLEEGKLSSAYLS

SEQ ID NO: 112687 - protein, 76 aa, Glycine max
  Coding DNA Sequence Number=SeqID_21002
  Subcellular localization annotation: CTP_CleavageSite=54; ConfidenceScore=5.07e-01
MRKQTYKKSPYGSSTWKDKETFKKERGSSFKFHEKGASLGNGDITSASSSSFSSSSSESESECDVQPLEGDLLIVR

SEQ ID NO: 112688 - protein, 17 aa, Glycine max
  Coding DNA Sequence Number=SeqID_21003
ATEVWMTPLPVKEDKSG

SEQ ID NO: 112689 - protein, 219 aa, Glycine max
  Coding DNA Sequence Number=SeqID_21004
LGLLGWDFQVFVGFGKLHGYGVFSGHHTGKFHGDLLDLQYKDGDVDAHHKTVEEKGKEVDGFVVDNDHVVDDYDDLEGVAEKKLVKMKNHPYTEKNKNNVAGVEFHGDNDGDVNDQGNTDDNYSSEELISDNTDSGEEDNPRPIYVMYRSEDVRKEFQFKADMEFKSLKEFKAAIQEHSALNGKERARLERKSLTESRLVEVSTDVAEYFITKMLTLIG

SEQ ID NO: 112690 - protein, 238 aa, Glycine max
  Coding DNA Sequence Number=SeqID_21005
  Gene Ontology: Mol. function=RNA-directed DNA polymerase activity; Cellular component=exocyst; Biological process=exocytosis
  Homolog annotation: Hit_ID=Q1PER8; Match level="QueryCoverage=92%, HitCoverage=35%, E-value=6e-72, Identity=60%"; Hit description =Exocyst subunit EXO70 family protein
  Pfam annotation: Domain name=Exo70; Domain location=1-238; Score= -204.2; E_value=0.002; Accession=PF03081.6; Description=Exo70 exocyst complex subunit
MADLKSIADCMISNGYAKECISVYTTMRKSIVDEGIYRLNVEQLSASKVNKMHWDVLEFKIKSWLEAVKIAVRTLFARERILCDHVFGASQSIREACFADVSRSGASLLFGFPELVVKTKKSPPEKIFRMIDMYAAIATLWLEIESIFSLDSTTAVKSQAYGLLLRLSESVRTSLLEFVTAIQKGSPKSTANFAGVHSLTVQVMNHLTTLADYSNVLSEIFLDVPPPPRSPLPESTYT

SEQ ID NO: 112691 - protein, 352 aa, Glycine max
  Coding DNA Sequence Number=SeqID_21006
  Homolog annotation: Hit_ID=A5BAR8; Match level="QueryCoverage=92%, HitCoverage=87%, E-value=2e-66, Identity=46%"; Hit description =Putative uncharacterized protein
MATKQVTSMVHVDDDYIDMELCSSPNFFSYSLSSPPSNREFEFQMSEKESSTSPADDLFYKGKLLPLHLPPRLQMVQKLVENSTNANFEYIKSDSALEHRTFPFTTDLRVPSTNANTPFESNISPSESRRVSSDVSPNEYQLGWFSDMNKYNLIGDLPKKSWPKKLKQMKQFWLGQRLKASRAYLKTLFNKSGCSDKFCASAAASNNIGAEKKSSRCKECQNKYMKVARRNPFESFYDGKHQVTCSIMKSIKREMLEVEDDFCDHRRSFSGVGQRHCSTKASSLSTSSSGSSSSSSSFSFSSAGYYDLQLFKRSISANYELESSIEGAIAHCKQSLQQCGSKNGSDDSRICS

SEQ ID NO: 112692 - protein, 127 aa, Glycine max
  Coding DNA Sequence Number=SeqID_21007
MSGDSWALWAITIDSSVEMPNIVNLMCFNFNFSEACALSENHALSETLNPLSELGESRGEIEKHLRAQFVISSLTSLRGQKALFKAEVGKIKGVPELGRREQNRSAKQSKDAKNLSFQEDLRFRSNF

SEQ ID NO: 112693 - protein, 122 aa, Glycine max
  Coding DNA Sequence Number=SeqID_21008
MEATSFWFFTALHIVWDGRNSPHNACAYAFQALCYGSLLLSKHSYYVFCFSSGHTEAVAAGSQFKASSAVVIAKFCALGNMSLDGCNGRSLKDCNICSLCNAAKNEFFLADNMEKKVLRVPH

SEQ ID NO: 112694 - protein, 89 aa, Glycine max
  Coding DNA Sequence Number=SeqID_21009
MWVVVVRFAEEKEEQRGVEVALPCGGGQRRRRGGEEVEGGEEVAGDEEGLLGECESVEMVKAKSGGRIDCRLPDLVTEGGRKSGRFYVG

SEQ ID NO: 112695 - protein, 442 aa, Glycine max
  Coding DNA Sequence Number=SeqID_21010
  Gene Ontology: Mol. function=receptor activity; Cellular component =integral to membrane; Biological process=ion transport
  Homolog annotation: Hit_ID=Q9C5T6; Match level="QueryCoverage=91%, HitCoverage=92%, E-value=1e-154, Identity=67%"; Hit description =Putative uncharacterized protein F11F8_41
  Pfam annotation: Domain name=Lung_7-TM_R; Domain location=131-419; Score=151.0; E_value=3.2e-42; Accession=PF06814.4; Description=Lung seven transmembrane receptor
  Subcellular localization annotation: CTP_CleavageSite=89; ConfidenceScore=5.08e-01
MGKSASTTAAAALVLLLFFISPSTAEIKTLSITSDTRPMILLEKFGFTHSGHVSIAVSSVSVVASGGSQPDPSRLGFFLLSEESLLQVLTEIQQNPSFCVLDSRYTMHLFTFRKLSPPPAATANYTYPVTIPNEYSIFFANCAPETSVSTLVHTELYNLDADSEHSRDYLSAGQTHLPTLFSLFSVAYFAFLALWIYICYSNKLSLHRIHLLMAALLLMKALNLLCAAEDKHYVKVTGTPHGWDVLFYIFQFIRVVLLFTVIVLVGTGWSFLKPFLQEREKKVLMIVIPLQVLANVASVVIGETGPFIKDWVTWNQVFLLVDIICCCAIIFPIVWSIRSLRETSKTDGKAARNLAKLTLFRQFYIVVIGYLYFTRIVVFALKTIAAYKYQWVSNLAEEAASLAFYVVMFYMFRPVEKNEYFVLDEEEEEAAEIALRDEEFEL

SEQ ID NO: 112696 - protein, 219 aa, Glycine max
  Coding DNA Sequence Number=SeqID_21011
  Subcellular localization annotation: CTP_CleavageSite=86; ConfidenceScore=5.16e-01
MEETTSTIIMAALSTLTPSQFSDLTRSIISATNHHHRRLSSLLSSPTLFSLTLHHLHTLTLPQKTLLIARHLLSSLHLLTATSPPLSTTTRQRDLDAALLLLLLCETHNHNPHALEAPFSEWRKNLSKVFSDSLLTVSLAPLGTACGCAELRRREGGGFGGDNGGAAVGGGEAQWEGVRDMQGGDGNRKGRVRVAMSTLVSLDVYFAVAGEKEHVSLLQ

SEQ ID NO: 112697 - protein, 370 aa, Glycine max
  Coding DNA Sequence Number=SeqID_21012
  Gene Ontology: Mol. function=phosphoprotein phosphatase activity; Cellular component=nucleus; Biological process=multicellular organismal development
  Homolog annotation: Hit_ID=A7PSU5; Match level="QueryCoverage=98%, HitCoverage=97%, E-value=1e-150, Identity=71%"; Hit description =Chromosome chr8 scaffold_29, whole genome shotgun sequence
  Pfam annotation: Domain name=PP2C; Domain location=35-317; Score =107.3; E_value=4.6e-29; Accession=PF00481.12; Description=Protein phosphatase 2C
MVRSCWKPIADGDEGDGSGRVDGLLWYKDLGNHLYGEFSMAVVQANSSLEDRGELESGPLGSNHLGPQGTFIGVYDGHGGSEASQFVSDNLFCNLKRLAAEHQGVSEHVIKRAYSATEESFLSLVKKQWLSKPQIASTGTCCLVGVICNGMIYVANSGDSRVVLGRLERATRETEAIQLSTEHNVNQESVRDELRSKHPFDSQIVVLRQNVWRVKGLIQVSRSIGDAYLKKAEFNRDPLPAKYRLAETFFRPILSCEPSTSSHTLHPDDQFLIFASDGLWEHLTNQEAVNIVSNNPPNGIARRLVKAALREAAKKCEMRLSDLQKIEQGMRRHIHDDITVIVVFLNPKLTENTSLCGSPLSIKGGGSTNS

SEQ ID NO: 112698 - protein, 110 aa, Glycine max
  Coding DNA Sequence Number=SeqID_21013
  Gene Ontology: Mol. function=Rab GTPase activator activity; Cellular component=intracellular; Biological process=regulation of Rab GTPase activity
  Homolog annotation: Hit_ID=Q9ZUT7; Match level="QueryCoverage=50%, HitCoverage=10%, E-value=2e-21, Identity=87%"; Hit description =Putative uncharacterized protein At2g37290
MNFFAGLLLLLMPEENAFWAFAGIIDEYFAGYYTEDMIESQVDQLIFEELMRERFYQTDGNSLNVDSEVDSLPHLQEQVVSSAVCTSTFSSLFHSPLPAKRPIFVKNIEI

SEQ ID NO: 112699 - protein, 429 aa, Glycine max
  Coding DNA Sequence Number=SeqID_21014
  Gene Ontology: Mol. function=two-component response regulator activity; Cellular component=mitochondrion; Biological process=two -component signal transduction system (phosphorelay)
  Homolog annotation: Hit_ID=A7NZB2; Match level="QueryCoverage=87%, HitCoverage=44%, E-value=3e-65, Identity=58%"; Hit description =Chromosome chr6 scaffold_3, whole genome shotgun sequence
  Pfam annotation: Domain name=Response_reg; Domain location=122-238; Score=90.0; E_value=7.5e-24; Accession=PF00072.15; Description =Response regulator receiver domain
MAISEVSELCERFSIKYTMHRFWFWMFMFEQRSSVCVRVVQMSVDGDGKELRELNQCLRDGKKIAGGERGLYEGDEVKCNGVAEEVKIGKGGIVESSSVQQHIPQPQGAIICWERFLHIRSLKVLLVEYDDSTRHVVTALLRNCSYEVIDAANGLQAWKILEDLTNHIDLILTEVAMPGLSGIGLLYKIMGHKTRKNIPVVMMSSHDSMGLVFKCLSKGAVDFLVKPIRKNELKNLWQHSSGSGSESGTQTQKSVKSKSLEKFDNNSGSNGEDDNGSIGLNNGDGSDNGSGTQVVLPGIENSDMGLMNIGKECALVGLGWNAVITCYLLVASKQFNSKHHKSSAYWFRTNLPVLPYGGHVLILSSWTKHAVEVDSPKPVSHWDKIAECPDSTCAQVVHSNAEIGENKVVPLAAKECPEQKEQLGKGQVP

SEQ ID NO: 112700 - protein, 1044 aa, Glycine max
  Coding DNA Sequence Number=SeqID_21015
  Gene Ontology: Mol. function=microtubule motor activity; Cellular component=microtubule associated complex; Biological process =microtubule-based movement
  Homolog annotation: Hit_ID=Q0WQJ7; Match level="QueryCoverage=99%, HitCoverage=99%, E-value=0.0, Identity=55%"; Hit description =Putative kinesin heavy chain
  Pfam annotation: Domain name=Kinesin; Domain location=59-396; Score =592.2; E_value=5.2e-175; Accession=PF00225.14; Description=Kinesin motor domain
  Subcellular localization annotation: CTP_CleavageSite=59; ConfidenceScore=5.43e-01
MMPLTPDQSNKKVGSGMAASPSPFLTPRPERRRPDSRGSDWGSNRQDKDKETNVQVLLRCRPLSDDELRSNVPKVVTCNENKREVSVMQTLANKQVDRVFTFDKVFGPKSQQRSIYEQAIAPIVNEVLDGFNCTVFAYGQTGTGKTYTMEGGMRNKGGDLPAEAGVIPRAVRQIFDILEAQNADYSIKVTFLELYNEEITDLLSPDENSRPTEEKQKKPITLMEDGKGSVFVRGLEEESVYSLNEIYTLLERGASKRRTAETLLNKRSSRSHSVFTITVYVKETVIGDEELIKCGKLNLVDLAGSENILRSGAREGRAREAGEINKSLLTLGRVINALVEHSPHVPYRDSKLTRILRDSLGGKTKTCIIATISPSAYCMEETLSTLDYASRAKSIKNKPEANQKVSKAVLLKDLYMEIDRMKEDIRAAREKNGVYISHERFAKEEAEKKARNEKIEQLENDLSLSEKQVDSFRELYLTEQEQKLELESELKDCKVNLEKTSNNLHDLQENYKLLVSTLKEKERTISKLLKSENALIVRAKEMCTDLQNASDDINLLSSKLDHKERLEAENQKTILKFGSLLNESLKDLHTTIMGSVSQQHKELRSMEDHVSSYLASKNDAAQTLESRINKMTGIYTSGVETLKELANTLHMKASSDMEQIQSKVSSQTLAIENFLATAVHEAKDVICNIQNSLDEQKQLLAFSLQQQEKGLQQSLTSARVVSEAAVNFFDDIHLRSSRVMKILEENQNERFQQLTNFEKKFKEEVEREEEQALEKIAEILAALTSKKTAMVSEASRHMQDTSMQQSKRLQLEMLNMQQVSKDGTKEVGEYVENVKSHYVQQIFSASDIKATMENCLLECSKTVDNSKKQWESANLSLCNLQKNNLAEIQSSVKENILTNHILNQEFVSASLSMNSDYDVVTRNLRADVNGALMLDHENKKAIDSMTTRWLEQLNSLQDKNGEDVSNINVQAEKSLVKDYLVDHNARSQKRIIPVPSPASIEDMRATIIENSLKLIQTESKITRLAASPNRTPFADVNSVNDDCS

SEQ ID NO: 112701 - protein, 758 aa, Glycine max
  Coding DNA Sequence Number=SeqID_21016
  Gene Ontology: Mol. function=DNA binding; Cellular component =chromatin; Biological process=regulation of transcription, DNA -dependent
  Homolog annotation: Hit_ID=A7PSY8; Match level="QueryCoverage=96%, HitCoverage=90%, E-value=1e-108, Identity=35%"; Hit description =Chromosome chr8 scaffold_29, whole genome shotgun sequence
  Pfam annotation: Domain name=PWWP; Domain location=196-269; Score =55.1; E_value=2.4e-13; Accession=PF00855.8; Description=PWWP domain
VEPDGGLVIEFNDGFRSELGCENARDVAENGLLSFALNNVTQGGDNDAVECTQEVKNDGLVNLSAVVENDGKRNGADSLVTKDGMEDSRAIEVATYQLQDGIPCMEAVDVNAEESLHVKDLSRNCLELKPSCEPAFQVDANVDVMQNQTVVVDVSEGLFENIQNECHGFDLVVDLNSYKSMHKVGTYWGSVSSEMNFCVSDLVWGKVTGHPWWPGQIFDASAASEKAKKHLKEGCHLIAYFGDGTFAWNDVSMLKPFQTHFSQMEKLSNLENFHHAVDCALDEVSRRVEFSLSCHCMPEDVLSKIKTQVISNAGINNQSCRRNGGDRIMNAMSFEPMKLVNFVKSLAQSPLVESDRLDFVIARSQLSAFYCSKGYSQLPEFPVLGVLFENDMETLLMREKEQCDYQTHVSFLQQDHKHISGDSKWHGKKLKLLSDLMSEKGFCISNGEGTSEQEAKSVPQRRGRKRKTAFNTSEDYFHNSQNGRLTQLQYASTNDMRSQLCLAAKDPTGESCSSDMVHFFAEFRKFISHDYYASLDQEMSLERMNYDETGVTSTAALASMTPAMEPCSDSYWTDRIIQSIPKELSLTKYQNERVVFLPETLTEANPLSFKLQPSAETTTDLCYKQQDTDRNLGSESSKLVEHLDGSSKENFCPTALTLKFTNFDSVPSTTDLNNIFGRFGPLIESKTELLERTNRARVVFQRRSDAETAFSSAGKYSIFGPSLVSYRLKILPRKPPQGTGKRGRKRRKETSSVDGTAV

SEQ ID NO: 112702 - protein, 138 aa, Glycine max
  Coding DNA Sequence Number=SeqID_21017
  Homolog annotation: Hit_ID=A7P6V1; Match level="QueryCoverage=34%, HitCoverage=7%, E-value=2e-12, Identity=77%"; Hit description =Chromosome chr9 scaffold_7, whole genome shotgun sequence
MVKHTKDHLCSRRCGFEDIIGSFGFHGVLLLVLENLVENSLPYLKYSYKKYRVRHKKNEKGEAREKFQFISRVEKEYLKPSYSASIGEELEDGLFDGVVEARALLMVLGGIQESMTEIECRLEDLFGQTKLTDNKVKE

SEQ ID NO: 112703 - protein, 84 aa, Glycine max
  Coding DNA Sequence Number=SeqID_21018
MELIIDRLPTVDNLSKRNIQLNDEEKKGVFCLELEESAGHCRAHFQQLPWVMKSAAEKSRWQVVWGYLECLVLKKSMQIPEYRG

SEQ ID NO: 112704 - protein, 427 aa, Glycine max
  Coding DNA Sequence Number=SeqID_21019
MGSDNVKRRREGENEGKDVYESEDLLKVFHWRGKVREARGVICTSSPWSFFHGKWWRYKKYRDSEKEWFIAMFETIDKWTSDERTRESIVKIKCREEYPIQTKGRCYYTDHEIPDDELSVFIMENEDISLSGSEWSREEETNHRESFQEAISDDADMTLGQIAQNCSKRSKGKVRMDEEEGTMPRPEKKKKRVELEEGKVMEVEVGKDKEVLEGFVGKTNREGDAGSRESHIDVKDDREGHILSRQKGNINLIDVGLTKEMKSQHVNVQQKWADRTTNSINRGAKGNKCIKQGIANEKIDQTRRYESIGGGHGYGDKSIMTQKIQGVEDTNMVVTGGKNNEVEEKVKQRVQWAIIQEFKRLNLMDKWCLVEDSNSVRRLGDSRRHYHIAIGGIEMKEFNNFIEDMEVDDLPLVGLKYTWFRSNGVAK

SEQ ID NO: 112705 - protein, 609 aa, Glycine max
  Coding DNA Sequence Number=SeqID_21020
  Gene Ontology: Mol. function=molecular_function; Cellular component =nucleus; Biological process=negative regulation of transcription by carbon catabolites
  Homolog annotation: Hit_ID=A5B9W7; Match level="QueryCoverage=95%, HitCoverage=91%, E-value=0.0, Identity=58%"; Hit description =Putative uncharacterized protein
  Pfam annotation: Domain name=WD40; Domain location=284-323; Score =9.7; E_value=2; Accession=PF00400.23; Description=WD domain, G-beta repeat
  Pfam annotation: Domain name=WD40; Domain location=349-387; Score =12.1; E_value=1; Accession=PF00400.23; Description=WD domain, G-beta repeat
  Pfam annotation: Domain name=WD40; Domain location=435-486; Score =22.2; E_value=0.0019; Accession=PF00400.23; Description=WD domain, G- beta repeat
  Pfam annotation: Domain name=WD40; Domain location=536-572; Score =12.9; E_value=0.8; Accession=PF00400.23; Description=WD domain, G -beta repeat
  Pfam module annotation: Pfam domain module=WD40::WD40::WD40::WD40; Domain location=284-323::349-387::435-486::536-572
CDAVIAITMKNANGLISTTSSNTAQSQSTGLKTYFKTHEGRYKLYYDKTYPSTLLHYAHGKTVSQVTLAHLKDKPVPSTPTGQSSTFSATSGVRSAAVRLWGGSNGGRSLSFVGGNGTSKNLGGNSRIGSIGASSSSNATSNSNFDGKGTYLIFNVGDAIFISDLNSQDKDPVKSIHFSNSNPMCHAFDQDSKDGHDLIIGLNTGDVSLRQQLQDVGKKLVGAQHYNKDGSVNNRQHLIPSPPLVIDSCCNGRKVYTNTEAHSVQNPNSEWVQIWLSVTDKNRPSYGVVQIEHKIHCTCIAWVPGGDGAFVVGHADGNLYNRDGAGDSSFTVVKDQTQFSVSHARYSKSNPIARWHICQGSIDSISFSTDGTYIATVGRDGEAYLVLVNQLMDLWINLLFPQFLSYSSSRASKITVLDFAVTVDDLVQVWSMEDRKVVAWGEGHNSWVSGVAFDSYWSSPNSNDNEETVRYRFGSVGQDTQLLLWDLEMDEIVVPLRRPSGGSPTYSAGSQSSQWDSVVPLGTLQPAPSMLDVLKISPLVTHRVHTEPLSGLIFTQESVLTACREGHIKIWIRPAAAESQSSNAETLLSTSLKEKPSILSKVGNSSHRQ

SEQ ID NO: 112706 - protein, 82 aa, Glycine max
  Coding DNA Sequence Number=SeqID_21021
  Homolog annotation: Hit_ID=A6FJQ2; Match level="QueryCoverage=46%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTFGIHVYGTAPNPSPPHILIASKQKVM

SEQ ID NO: 112707 - protein, 113 aa, Glycine max
  Coding DNA Sequence Number=SeqID_21022
  Homolog annotation: Hit_ID=Q53NG0; Match level="QueryCoverage=62%, HitCoverage=8%, E-value=2e-07, Identity=40%"; Hit description =Retrotransposon protein, putative, unclassified
MEAYNKRLSIWKAKSMPIGSCLMMINSVLSSLPLYYFSFFKAPKKVIQTLTAIQRRLYKIAENKNSKVAKLELEKAIICLGRGDAAGIDHASAPGTHGYFLTRSLVLETDRGG

SEQ ID NO: 112708 - protein, 128 aa, Glycine max
  Coding DNA Sequence Number=SeqID_21023
  Homolog annotation: Hit_ID=A2Q1D6; Match level="QueryCoverage=65%, HitCoverage=13%, E-value=5e-10, Identity=38%"; Hit description =Ovarian tumour, otubain, related
MDEDQWMYNSIMSEEVEMNVENEEDGGVKVHCSDAFNTSELFGSRDEVLQWARSLAEDIGFVAVIMRSDTNTGVRGRTSFLLIVCERSGQYRPKKHNLVKACTDSRKCGCPFNLLYILRRKWMLSISC

SEQ ID NO: 112709 - protein, 78 aa, Glycine max
  Coding DNA Sequence Number=SeqID_21024
  Subcellular localization annotation: CTP_CleavageSite=22; ConfidenceScore=5.33e-01
MAIWPYIGNCQSNWRVSTASVRVQGRNEAGRRNLACKSCTSPAKPVRTRQFDWRFPMQYQIAISGGDFFKAQQTRQFH

SEQ ID NO: 112710 - protein, 225 aa, Glycine max
  Coding DNA Sequence Number=SeqID_21025
  Homolog annotation: Hit_ID=A7QJG6; Match level="QueryCoverage=48%, HitCoverage=46%, E-value=7e-47, Identity=85%"; Hit description =Chromosome chr8 scaffold_106, whole genome shotgun sequence
  Subcellular localization annotation: CTP_CleavageSite=51; ConfidenceScore=5.91e-01
MAETSAALCFSTFRFSFAPSRSPSKTFFNNSSFHFPPPSSSHTCLLHFAPKASPSGKLLRRRFFRFFPLVRFRQQRKMFACLLPEIQWIPEERITLFTADGLIQIGGSMVPRRVSSSDKKHGKSKTAKKFQRFQESNYMNPNQGLCLGALFDIAATNGLDMGRRLCIFGFCRSIEMLSDVVEDTVLEHGGEVGYTFSFNKAIVLWFLLYVEESLVKIAKANVKIS

SEQ ID NO: 112711 - protein, 651 aa, Glycine max
  Coding DNA Sequence Number=SeqID_21026
  Gene Ontology: Cellular component=membrane
  Homolog annotation: Hit_ID=A7QFQ8; Match level="QueryCoverage=85%, HitCoverage=85%, E-value=3e-95, Identity=40%"; Hit description =Chromosome undetermined scaffold_89, whole genome shotgun sequence
MGTGSTLASKEVPIVGSDAVRWIDLSVPSSSNIAAVDDGGAAPLTTDDRASCFVIGDPPTYLIWRIHKAQPHSLELLELAASKEFPRVGLRFTFPDALCPFAFICKNEISGASRVPYLLYVLTVSGVAYLLKIRNVSVYASVSVFPVDELLEVNVRGYIPNHAATITAVTATVGGLVVGTSDGSVFCFQLGVLDSSAPGFMHELRDDAGISRLWGLISRGKMVGTVQELAILELHEKKFVFVLHLDGTLRIWDLASHSRVFSNNMGTMAMAEAFSHALQEEFVADQLFQSSEHLADEILQITHSIFSSSKDDILPFVSSIFLRRLLLPGVHHNATLYATLVEYSRHLGESELQTLTTDGLKKEILSLIEHEVGSEKVSLLHCWKCFFTRYFHNWCKNNALYGLLVDSSSDAVGLIRKKSISLFRSLEDIERIVEGSSDEVSELTGLVDIFDDDLECEILIELLRCVISFSQQLGKTASSIFYESLLTTSLISSEDIVCYIVKILETGYCMSGPVLQTSTSGNHIVVLEKELADHKSLRKLSVDMFLSLQGLHKKASEWGRILKVIEDNNMGKQLWNEKLGRCDFTLAFIFLLNVGSSSIDHSHAGGSSTFLSRSIDLAFILFKHGQYGAAERRHPKVFKMMMVDGAYAIIF

SEQ ID NO: 112712 - protein, 942 aa, Glycine max
  Coding DNA Sequence Number=SeqID_21027
  Homolog annotation: Hit_ID=A7PSX1; Match level="QueryCoverage=79%, HitCoverage=99%, E-value=1e-128, Identity=38%"; Hit description =Chromosome chr8 scaffold_29, whole genome shotgun sequence
  Subcellular localization annotation: CTP_CleavageSite=84; ConfidenceScore=5.41e-01
MDKSRHSKSNAAPSSTHQPQPPLPQGNKEVHRQRQPLNLSPDPGSSSGGVAYKDSFSSKFGWRSSKQLFGTPIKKLLAEEMSPKAESKRRSPGVIARLMGLDGLPFQQPINKQHKALSENQQKTAQLERTRGKGVPYDGQSSRRSSKDHQEFKDVFEVSEIPKVESHRYPSQGCADLMTTDAEISFIEQKFMDAKRLATHQDLQSSKDFCDTLEVLDSNKDLLLKYFKRPDSLFKKHLNDLQAAPVQSHYGYVKPMDIEKYEHDFNLRSDWEKTRSNYNRSSHEKHHDGYPCHFDKRHVMHSSPKSSKLQFKAKYEQKAVTSQIVLLKPNLGKVQNGTRIVSSPCSSHNFLAGCENDTELCQATNLPESARSWRQDSFESREIAKEVTRQMKISLNNGSMKLSTSRIRGYAGDDSSCSVSGNESPEESEETTATLGNSIDLNNRSRRSSRSSESSVSREAKKRLSERWKMTHKSQELQGISRSSTLAEMLAIPDMKLKASNSDSMASGEGFHDKCTPNSQPAKWVEPLGISSRDGWKDGCIGSLSRSKSLPSSSTAFGSPRRFLRTEALLDERFMVPKDAHRRERRRSGHKKSRSLHSSIQNKMKISLKDSPKLEVLASESSSEIVRHAVADVDNDVTNGSKVWSEPSTKVLPESSSHLLIKDNSSADLDNSKQQDLSACSSCGSSVLPEPPVPVPGLEASCCKDADQPSPVSVLEPSFTDDASSCSDNFESLNNDLQGLRMQLQLLKLESDEYVEGPMIVSDEDGGEGSTGMLEDKGLRRTEDSWECSYIIDVLSESGIDGAQPDTISELWHSLECPVSLSVFDELEKRYGDWTTCSRSQRRLLFDRINLGIVKINEQCTHALPWVGPVTKNVIGSNLIENGFRDGLLRMLVSDGKVKDDALGKVLVMESEWLDLRDDIDVIGREVERLLLDDLVAEIIGA

SEQ ID NO: 112713 - protein, 158 aa, Glycine max
  Coding DNA Sequence Number=SeqID_21028
  Homolog annotation: Hit_ID=A7PT74; Match level="QueryCoverage=48%, HitCoverage=76%, E-value=1e-19, Identity=61%"; Hit description =Chromosome chr8 scaffold_29, whole genome shotgun sequence
  Pfam annotation: Domain name=Auxin_inducible; Domain location=35-129; Score=55.4; E_value=2e-13; Accession=PF02519.5; Description=Auxin responsive protein
MRRGETGLPLWTRKIAHPSDVEEENETAIVVHDGLAVVFAPIKRSFTLTSNDDSATTEVPGDVLEGHFVVLANKGEETKRFIVELHYLDDPAFLGLLERAREEYGFRQKGVLVIPCHPQELEKILEQPRDHESVGGDGGKLTDSIQDISECSVISCSS

SEQ ID NO: 112714 - protein, 96 aa, Glycine max
  Coding DNA Sequence Number=SeqID_21029
MVMKGIKRGNLYILQGTTCVEDGLVAVASRSNKSIPDLTQLWHMRLGHMLMTRVLGQRSFRLQPGVVSLLVLLFKGTLQRLQPGVVSLLLKGILER

SEQ ID NO: 112715 - protein, 125 aa, Glycine max
  Coding DNA Sequence Number=SeqID_21030
MTCFFSFSGRNLHFNNGIILGFFYFCPTMSREPLDEAKDSIGSAPTLQRKGKIQDPHPRPFKNQIHAEKRTLGLTLSPTDVFVVATPTHYLQWVNNQGDDSVVVLCEEVDGRRRCQRKSRPPFGP

SEQ ID NO: 112716 - protein, 106 aa, Glycine max
  Coding DNA Sequence Number=SeqID_21031
  Homolog annotation: Hit_ID=A7PT74; Match level="QueryCoverage=94%, HitCoverage=74%, E-value=3e-21, Identity=53%"; Hit description =Chromosome chr8 scaffold_29, whole genome shotgun sequence
  Pfam annotation: Domain name=Auxin_inducible; Domain location=1-102; Score=26.7; E_value=5.6e-08; Accession=PF02519.5; Description=Auxin responsive protein
MLRSLLGRIKKGLSLFVARRPTFNYFSEDHAATAAPDDVMEGYFAVLAIKGEETKRFIVGLDYLNDPAFLRLLDQAREEYGFRQKEALALPCCPQELQKILDAPKS

SEQ ID NO: 112717 - protein, 86 aa, Glycine max
  Coding DNA Sequence Number=SeqID_21032
MRGKIGRYWLQYQQEWIAMWNDRHNRIVQGPIMTVMILQAEPSQLNMVVDQDKDKWNQLNNNSKKEDHGVTCKGLHVGHHPTNNFF

SEQ ID NO: 112718 - protein, 536 aa, Glycine max
  Coding DNA Sequence Number=SeqID_21033
  Gene Ontology: Mol. function=DNA binding; Cellular component=nucleus; Biological process=regulation of transcription
  Homolog annotation: Hit_ID=A7NZM8; Match level="QueryCoverage=22%, HitCoverage=81%, E-value=2e-25, Identity=50%"; Hit description =Chromosome chr6 scaffold_3, whole genome shotgun sequence
  Pfam annotation: Domain name=Myb_DNA-binding; Domain location=336 -386; Score=27.5; E_value=5e-05; Accession=PF00249.22; Description =Myb-like DNA-binding domain
MDREEYLRKCSNMKCQRVQVDESFVPALQDEVMEVEHLLAEPRNVHASLDGSLDSHTTLNDKDDLELEVLDGLLDDVEIDDLEGTGGFAGACEEYFLDFGFADKFEEVLGSGPFEGSLLQISSSESHSSGLSGSSIVGGVLESTKVPIAKSECKNDSLDETITYEAHGAFRNNPSQPSKVNCRYNISLDIQHLQELENNSHLAAGILTCKKGKGPVEKGQPAVLREKRFRKPTQRYIEEFSNSRSKEKAPTAVTKTEHLSDSSCDVLHIRIKALKKSPSEKSSNENSDVMLPELQVRKRRLEKEKLEYDKELFPSESEDECSTSKRSRRKDRRKHQKMWTLPEVLKLVEGISEYGVGRWTDIKRFLFSSSSYRTPIDLRDKWRNLLRASSAQKTSREAEQNDELALRPLPFNVVHRVRELAKIHPYPRQRGSKRLRVSQAGSSIIAKDSPPLSLSKRNCIEPGYKARNVLKGFSTRQKFYSREAFKITPLCRQPHKDRVFQRPKVREKWEQNDNVTAQDSTGMHVKRKQSKVCLIK

SEQ ID NO: 112719 - protein, 163 aa, Glycine max
  Coding DNA Sequence Number=SeqID_21034
  Gene Ontology: Mol. function=binding; Cellular component=nucleus; Biological process=activation of protein kinase C
  Homolog annotation: Hit_ID=A7PJW3; Match level="QueryCoverage=98%, HitCoverage=45%, E-value=3e-39, Identity=40%"; Hit description =Chromosome chr12 scaffold_18, whole genome shotgun sequence
  Pfam annotation: Domain name=PPR; Domain location=17-51; Score=8.9; E_ value=0.69; Accession=PF01535.11; Description=PPR repeat
  Pfam annotation: Domain name=PPR; Domain location=52-86; Score=7.0; E_ value=1.2; Accession=PF01535.11; Description=PPR repeat
  Pfam module annotation: Pfam domain module=PPR::PPR; Domain location =17-51::52-86
ARRLFDELVELDVVACNSMIMGLAKCGENKRLMEAFELFHKMQRQRVQPSEFTMVSLLSACAHLGALQHGEWVHDYVKMGHFELNVIVLSALLTCTATIEYFSKLEASDLKLDHLSFIGVLTACKYIGAVEKVRDYFALMMDKYEIEPLIKHYTFMVEVLGQA

SEQ ID NO: 112720 - protein, 131 aa, Glycine max
  Coding DNA Sequence Number=SeqID_21035
MLKNWVLKKHNKTFLDWFKDTIFVDDNVSKKLRKLADGPKRTVITWQGYDINKQMATPPSSHLPPPPSLTGATSQSPSTLKRTRKATWLRSLVTRPVGAERPLVHVNLATKKADGPHRKKLRTYLGIVAHD

SEQ ID NO: 112721 - protein, 124 aa, Glycine max
  Coding DNA Sequence Number=SeqID_21036
MERSMIDAASGGALGDMTPAEARNLIEKMDSKSLQFSARNDAIVIRGVHEVATNSSSSGETKKLPVYAANIYNRPPQPQQQNQPQQNNYDLSNNRPYVPPPIQQQQQQQPNKQQTVDDAILPRK

SEQ ID NO: 112722 - protein, 85 aa, Glycine max
  Coding DNA Sequence Number=SeqID_21037
PVALRKLTYGRLGLQKSALTLAILSSTDLWTSRLDLIRFFFSVVDDLAAVLFSAENLMFGLRYEGFGVNNKRIIRTQGLGSNGIA

SEQ ID NO: 112723 - protein, 121 aa, Glycine max
  Coding DNA Sequence Number=SeqID_21038
  Subcellular localization annotation: CTP_CleavageSite=64; ConfidenceScore=5.26e-01
MEKLKQWLNQAAPQTWHQPSFVSLPQRSSPIGTKSITGKVCKGKTLHHTPFRHGPCSYGFFSMPCTRVGCLSRKFGGHALDISWVVSSAPKSRSLKFMVSRMTLALALAYFFRIYAISLLL

SEQ ID NO: 112724 - protein, 104 aa, Glycine max
  Coding DNA Sequence Number=SeqID_21039
MSITLLLYSLKADNLKLIMHMEAVCGIPLQNTLEGFQYHPQPHPSHSTTVKNPHAMAEMEKLDHLEERLKAIEGGEDYAFFNLEELFLVPNIITPPKFKVPARL

SEQ ID NO: 112725 - protein, 342 aa, Glycine max
  Coding DNA Sequence Number=SeqID_21040
  Homolog annotation: Hit_ID=A1FWD5; Match level="QueryCoverage=84%, HitCoverage=100%, E-value=6e-65, Identity=44%"; Hit description =Putative uncharacterized protein precursor
MGGRWRNRGRRSRLAEYVSQHAVMTPRWPRSRLRLELAIPPFYSRFDHARESPMSRAPACRLASFALVAVLSTTACAKAPSTEKDPNGTPMSETATSPRTVGGQTYTMQPVEARLGPHRFMFPANLYYNQTGPLADGGVMLTVFWPDFDAAPPGDRPVRSTQDSRRQVLVELRYIDRVPIQNYLARRSSSEATSAPGSLERRDPVENLALRVAQPERWGLTPYSIDPSLMEAYAKESEAALGRPYVHNPGMEPDWYVARSAEGQLTTFISCDPADRIPDGLVAQGKTLERAGEGQIAMCRHSIVDVGDSIAIEMNYARVMLSDWQRLENSVRDLLSRYRVQP

SEQ ID NO: 112726 - protein, 49 aa, Glycine max
  Coding DNA Sequence Number=SeqID_21041
VSTGRNLLTSAPERAQMTTLAFAHQSHLGSLNDEVRITVRCLRGLPALG

SEQ ID NO: 112727 - protein, 112 aa, Glycine max
  Coding DNA Sequence Number=SeqID_21042
MDFDRHWFWSAEHQQRFETIKGWSFLRERRVQLRDEEFVEFREEIARRHWAPLVSPMAKFDPEIVIEFYANAWPTEEGVRDMPSWVRGQWIPFDGDAISKFLGHLLILEEGL

SEQ ID NO: 112728 - protein, 94 aa, Glycine max
  Coding DNA Sequence Number=SeqID_21043
DPSRHSGFCFYQLSLPVQLLTGWCVTAKAPPDISAGKCSGRVPFAIQAAQLLGRAIGAGLFAITPAGERGMCCKAIKLGNARVFPVTTFPNDGQ

SEQ ID NO: 112729 - protein, 188 aa, Glycine max
  Coding DNA Sequence Number=SeqID_21044
MVAILADLFDTFDRRYTRVRFKAIAHDAEKGRVDWDQHLAGIGGSAINWFPRWKEGKEGVLFSCGDYPNIPLIGTRGAQSLKAIQRVHKAWRSPLRKDKELRGIRNGIIGGYHGWLRIHTRGLDWLSKLKVIDEEDFEAPEEDEEVRALKLELGKARLAKEKFKSAATHIRKGVHRVTRGKRGHCKSP

SEQ ID NO: 112730 - protein, 238 aa, Glycine max
  Coding DNA Sequence Number=SeqID_21045
  Homolog annotation: Hit_ID=Q1GZN5; Match level="QueryCoverage=99%, HitCoverage=71%, E-value=1e-63, Identity=51%"; Hit description=MxaL protein, putative
MAKQSIRKTLSALPCGSQVALGMFTERNVVNVVKPVEVCSHFAALDQTVASMDWRMAWAADSFIAHGVYNALEQTPKLGKDTRLMFFTDGQQAPPANPKYMPVYAGKPGEVQGYLVGMGKSTPSKIPKLDEKNAVSGYWEQEEVQRFGNFGMAETLSVLAMEQGQHDRNAGHGPGNTLLENAHLSALDAQNLRRLGDATGLHVVRLDDVAQGSSWATGLGMTAWRWADTDLRPWLAWP

SEQ ID NO: 112731 - protein, 144 aa, Glycine max
  Coding DNA Sequence Number=SeqID_21046
  Homolog annotation: Hit_ID=A0PAV3; Match level="QueryCoverage=26%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVVRNGKSTARTSALASVAVTLRVTTTPAALNAPLQGASHSPFRLRNCWEGRSVRASSLLRQLAKGGCAARRLSWVTPGFSQSRRCKTTASEL

SEQ ID NO: 112732 - protein, 145 aa, Glycine max
  Coding DNA Sequence Number=SeqID_21047
GGPWVLVTLTVERTTRPRLERTTRPHHQRAARPHHQRTTRPRLERATRPHLGTTCPRLERATRPHLAVLVTLTVRGLHALTLRGLHVLTIRGLHALTSRGLHVLALRGLHVLTLGTSYPHRQRATRPHLERTTCPCQQRAARPHL

SEQ ID NO: 112733 - protein, 236 aa, Glycine max
  Coding DNA Sequence Number=SeqID_21048
  Homolog annotation: Hit_ID=Q84VH5; Match level="QueryCoverage=92%, HitCoverage=31%, E-value=5e-78, Identity=71%"; Hit description =Envelope-like protein
MATSPKETSTPSSPSAPSNQERSEFNIQPIQMIPGQAPVPEKLVPKRQQGVKISENPSIATSPREVDPEMDKKIRSIVSSILKDASVPDAEKDVPTSSTPDVAVPDAEKDVPTSSTPNTEVLSSPSKEESTEEEDQATKETPAPRAPEPTPGDLIDLEEVESDEEPIANRLAPGVAERLQSRKGKTPIKRSGRIKTMAQKKSTPITPTTSRRSKVAIPFREERNFSSDSDDDVELD

SEQ ID NO: 112734 - protein, 22 aa, Glycine max
  Coding DNA Sequence Number=SeqID_21049
ARIIPVTLNQVLEESKILHTSI

SEQ ID NO: 112735 - protein, 159 aa, Glycine max
  Coding DNA Sequence Number=SeqID_21050
  Homolog annotation: Hit_ID=A0PAV3; Match level="QueryCoverage=40%, HitCoverage=31%, E-value=3e-07, Identity=52%"; Hit description =Restriction endonuclease
  Subcellular localization annotation: CTP_CleavageSite=96; ConfidenceScore=5.15e-01
MVKVGTSYVPINVSFSPKVGPGLPGINRDTRIYLFCEHRRTSALASVAVTLRVTTTPAALNAPLQGASHSPFRLRNCWEGRSGFPSHDVVKRRPVNCNTTHYRANWSSTAVAAALELVDPPGCRNSMGFFIFHLRRNETRLHLQLLLLNLHLPPRVCDG

SEQ ID NO: 112736 - protein, 104 aa, Glycine max
  Coding DNA Sequence Number=SeqID_21051
QQKVYTDNHSGIFACQHDSKVNMTDLVSAEDDAAKDDVGLYVLSGFLSYRQQKVYTDNHSGIFARQRDSKVSMTDLVSAEDNAFRAYRQQKVYTDNHSVFPPSA

SEQ ID NO: 112737 - protein, 91 aa, Glycine max
  Coding DNA Sequence Number=SeqID_21052
MATIDITGSNNNDLNKPFRFEGKVACVLNTDIPMMSKDAEKEVKDKMTMNLALWNENDYLCKNFILNGLADDLYDYSPYKSAKLVWLALEE

SEQ ID NO: 112738 - protein, 69 aa, Glycine max
  Coding DNA Sequence Number=SeqID_21053
MMIHHRGTDLANGRKPKLQICNKLITGGGGANNPNLARAITQPRPSQANNGQKPRSDRGQNFNQRLAKT

SEQ ID NO: 112739 - protein, 183 aa, Glycine max
  Coding DNA Sequence Number=SeqID_21054
  Homolog annotation: Hit_ID=Q6UUU1; Match level="QueryCoverage=46%, HitCoverage=55%, E-value=1e-18, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHEPPVQSDRCALSGNYRLESNPERHAKAPLAAATASYLGSRVGSSETSKTALQA

SEQ ID NO: 112740 - protein, 110 aa, Glycine max
  Coding DNA Sequence Number=SeqID_21055
  Subcellular localization annotation: CTP_CleavageSite=46; ConfidenceScore=5.50e-01
TRSPLKARTCSTLKLRTCRPLKVRVCNPLKVRTYSPLKVRTCSPLKVMNKKLKRSKNNSSESKNISSESRTGQEFQNQGEFKTHEESLESRIKTQDLKNQDQDSRLKIQE

SEQ ID NO: 112741 - protein, 123 aa, Glycine max
  Coding DNA Sequence Number=SeqID_21056
  Homolog annotation: Hit_ID=Q6UUU1; Match level="QueryCoverage=48%, HitCoverage=40%, E-value=9e-19, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNSLQAGLYARTPVQSTAALI

SEQ ID NO: 112742 - protein, 64 aa, Glycine max
  Coding DNA Sequence Number=SeqID_21057
MTEKKMMTMIVDTLPVFYYEKMVGYTPSSFDDMVFTDERIKVGLKRANNHPSHYPPPVIHKGHP

SEQ ID NO: 112743 - protein, 91 aa, Glycine max
  Coding DNA Sequence Number=SeqID_21058
MDKCLVKLQTKFREDPTVKEGWESFLPRQLHVVFSRSFIKRLLAHSRHLLKDPNDPTVNEGWAAFLPRQLHLAFSRSFIKRLPLEASSWLL

SEQ ID NO: 112744 - protein, 161 aa, Glycine max
  Coding DNA Sequence Number=SeqID_21059
  Homolog annotation: Hit_ID=Q5CDC4; Match level="QueryCoverage=26%, HitCoverage=32%, E-value=9e-16, Identity=100%"; Hit description =LacOPZ-alpha peptide from pUC9
MVKVGTSYVPINVSFSPKVGPGLPGINRDTRIYLFCEVIFRHSCPSCSATDGVGELELHRGGGRSRTSGSPGLQEFDDIEILDDEIQRIRKLMENMLATATGQSDQAYRYRRPRGGARYQLLFPLVRVNFELGVIMVIAVSCVKLLSAHNSTQHTSRKHKV

SEQ ID NO: 112745 - protein, 84 aa, Glycine max
  Coding DNA Sequence Number=SeqID_21060
HQVRWKIARTPRIGEILSEGAKEIAEKIDVLTVAIRHPEHPRHVRATGAGVSIKQSFRSAPRTSRNSFSLPLEEKQQLTQQIRD

SEQ ID NO: 112746 - protein, 106 aa, Glycine max
  Coding DNA Sequence Number=SeqID_21061
  Homolog annotation: Hit_ID=A8NF35; Match level="QueryCoverage=35%, HitCoverage=69%, E-value=8e-13, Identity=89%"; Hit description =Transcription factor, putative
MDPYLGKRIGSEGWARGSQSRPRRLSVDCSSCFRGESGSSRAGRGTDWERALRGLFPGRRTVNSELIPTVPVYYPAKPQPRERAWRNQRGKKTLLSLTLVRLCEMT

SEQ ID NO: 112747 - protein, 337 aa, Glycine max
  Coding DNA Sequence Number=SeqID_21062
  Homolog annotation: Hit_ID=Q84VH5; Match level="QueryCoverage=100%, HitCoverage=51%, E-value=1e-117, Identity=67%"; Hit description =Envelope-like protein
  Subcellular localization annotation: CTP_CleavageSite=21; ConfidenceScore=5.33e-01
MATSPKETSAPGSPSVPSSPSSTKAPSNQERPEFNIQPIQMIPGSAPVPEKLVPKRQQGVKISENPSLATSPREVDTEMDKKIRSIMFQHLPPQMFLFLMLIKMFQHLPPQMLKSSLHPAKEESTEEEDQATEETPAPRAPEPAPGDLIDLEEVESDEEPIANKLAPGIAERLQSRKGKTPITRSGRIKTMAQKKSTPITPTTSRWSKVAIPSKKRKEISSSDSDDDVELDVLDIKRAKKSGKKVPGNVPDAPLDNISFHSIGNVERWKFVYQRRLAVERELGRDALDCKEIMDLIKAAGLLKTVTKLGDCYESLVREFIVNIPSDITNRKTDDYQK

SEQ ID NO: 112748 - protein, 102 aa, Glycine max
  Coding DNA Sequence Number=SeqID_21063
MLHRPQARHHHLIRLAWLANHRAHVQTHDCLYQLSLSMQSQGFASFSCPTPDQFKAEVAWPGDWLEAQAGEAPPEAPGDGEEAHEDEEMADLLDFLGRSGAT

SEQ ID NO: 112749 - protein, 181 aa, Glycine max
  Coding DNA Sequence Number=SeqID_21064
  Homolog annotation: Hit_ID=A1IW39; Match level="QueryCoverage=38%, HitCoverage=98%, E-value=2e-17, Identity=69%"; Hit description =Putative uncharacterized protein ophh-69
MGDKLHRREGNSPDHQLRPLNDRSVIKEMNGAKRSAEAVGCKKESVGERSALEGRTRASSAGRSGSENVGLSNANVGENPMPRKPKGSSARFVHGGVIRGRENASSQSSSTRRYSAEVIHAILPRKSSNDPQQMDHVWGLTPAQCRKVKEVGDLMTGEPTTEAPVNGGRNYNGPKVAKFLV

SEQ ID NO: 112750 - protein, 196 aa, Glycine max
  Coding DNA Sequence Number=SeqID_21065
  Subcellular localization annotation: CTP_CleavageSite=53; ConfidenceScore=5.04e-01
MTMHNMQFQQENRACIQSLTNQMGQLATQLNQQQSQNSDKLPSQAVQNPKNVSAISLRSGKQCQRPQPVAPSSSANEPAKLHSIPEKGDDKNLPNNFCAAEAYAANIYNRPPQPQQQNQPQQSNYDLSNNKYNPGWRNHPNLRCSSTQQQQQQPAPSFQNAAGPSRPYIPPPIQQQQQPQKQPTVEPLHNLPSKNL

SEQ ID NO: 112751 - protein, 128 aa, Glycine max
  Coding DNA Sequence Number=SeqID_21066
  Subcellular localization annotation: CTP_CleavageSite=51; ConfidenceScore=5.36e-01
VRPRSNLAPLPGSSVQSFTIKRFPWFSLGCFAVKIVLENRVVVEISLRKNRCMTRGNPSDLQPFDPDIDRTFHRLVRHHFIPFYHSEHSITGESVHSVIGDFEHPDLEHYNFEHSDSEHSDFAHSGIL

SEQ ID NO: 112752 - protein, 202 aa, Glycine max
  Coding DNA Sequence Number=SeqID_21067
  Gene Ontology: Biological process=transposition, DNA-mediated
  Homolog annotation: Hit_ID=Q6UUU1; Match level="QueryCoverage=35%, HitCoverage=46%, E-value=9e-19, Identity=71%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 112753 - protein, 142 aa, Glycine max
  Coding DNA Sequence Number=SeqID_21068
MTPKKLSTKRSRRDTTAEGSSAAPEFDSHHFRSAEHQQRFEAIKGWSFHRERRVQLRVDKYTDFQEEIARRHRTSLVTSMAKFDPEVVREFYASAWPTEEGVRDMRSWVRGQWIPFDADALSQFLGDPLVLEEGQQCEFSQR

SEQ ID NO: 112754 - protein, 243 aa, Glycine max
  Coding DNA Sequence Number=SeqID_21069
MPFECKKWPRGNLPQRDPGRIKWPKELVPAPEYDSHRFRSAEHQQRFEAIKGWSFLRERRVQLRDDEYTDFQEEIVRRRWASLVTPMAKFDPDIVLEFYANAWPTEEGVRDMRSWVRGQWIPFDADAIGQLLGYPLVLEEGQECEYGQRRNRSDGFDEEAIAQLLCIPGQDFARTAVGRRVRIMRTNMTTLTQIWMTLLLSNIQPSDHNSDLPLPKCPLVYAILTRMSIHVAQLIADAIYIFA

SEQ ID NO: 112755 - protein, 215 aa, Glycine max
  Coding DNA Sequence Number=SeqID_21070
VLFLNMEGLVDLPVIDAFLAFHHGKESPVVAILAMYDTFDRGCEKSDARIFCCALALYVWLVSHPFLQEGRPVYPLQGHRLCVEKGKANWDQLLASMEGRLGCINYNPVLAIRQLGYPVRGAPLDKSITPFITRGFSDPNAKDRELRGSSNGIIGGYHKWLRVRTQGLDWLPNLKTVRDNEVKASEESDEVQALKAKLERTWVVKEKFKSIAIKV

SEQ ID NO: 112756 - protein, 138 aa, Glycine max
  Coding DNA Sequence Number=SeqID_21071
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=1e-24, Identity=65%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLSGEWDAPCSGALSAAGVVVTRSVTATLASADVRRCFCRYAPPRQ

SEQ ID NO: 112757 - protein, 176 aa, Glycine max
  Coding DNA Sequence Number=SeqID_21072
  Homolog annotation: Hit_ID=Q6UUU1; Match level="QueryCoverage=48%, HitCoverage=55%, E-value=1e-18, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHEPPVQSDRCALSGNYRLESNPGKTCKAHWQQPLVIDLEGVSLEVMR

SEQ ID NO: 112758 - protein, 119 aa, Glycine max
  Coding DNA Sequence Number=SeqID_21073
MNEFDAQVAWPGAQPSPSRRGGASTGQEPEPEEPAAVAEGEDELTPPEPFYFDAGVHIAQEEETGTDQIPEPSPAPIPDDAIPSTSTSELEQPISQDSPTTQVLDLNEHAQEQPQEQNI

SEQ ID NO: 112759 - protein, 72 aa, Glycine max
  Coding DNA Sequence Number=SeqID_21074
  Subcellular localization annotation: CTP_CleavageSite=58; ConfidenceScore=5.19e-01
MGVRDKSIMHKRFMQKSLLNVSRSLTIKDHTLTGLRLMRSFTINLTNQLTFSVMILIPCSFSSNDCMLIQGI

SEQ ID NO: 112760 - protein, 125 aa, Glycine max
  Coding DNA Sequence Number=SeqID_21075
MNCRVDRSDPDAAVAPRRYGLDPLLPTPGHHSMSGIRGDILDVTTPLGAAVPPCLSIDTQLSRPITNATGEGKKGPKHGRCRTLEWQRKGRSYLFFQACSDIWFPRKIKLVSRVMGNLPARFGEH

SEQ ID NO: 112761 - protein, 82 aa, Glycine max
  Coding DNA Sequence Number=SeqID_21076
MGIAPTKTPSGPEEVQQGPGVSSSGIVPAKHSVDPKKANRFHGVPVAPNKVIRSRINQAFIKKYYAPRRAQGETAQQHWDGR

SEQ ID NO: 112762 - protein, 82 aa, Glycine max
  Coding DNA Sequence Number=SeqID_21077
  Subcellular localization annotation: CTP_CleavageSite=31; ConfidenceScore=5.05e-01
MWDILAGMYKGMPWVKKMTSRKRKSTASRPTAQYDTRRFQSLEAWNRYTDNILGWNILLERNVKLYHTEFDEFKVELERRNF

SEQ ID NO: 112763 - protein, 113 aa, Glycine max
  Coding DNA Sequence Number=SeqID_21078
MVKVQDASSEATIPKPFIFEAGETQIRQEAATPERSPQISPDPPSPVVDQSSLQQPADPPTPVHEMPTDPSTPLLDLPEDPSTPVLGLTTTPVLHLTDEEDTQDEDTQSLDLS

SEQ ID NO: 112764 - protein, 75 aa, Glycine max
  Coding DNA Sequence Number=SeqID_21079
MMTKVMNKKLKRSKNNSSESRTSQEFKNQEEFKTQEESLQSRIKIQDSRFKIQDSRFKIQDLKNQDQDSRLKIQE

SEQ ID NO: 112765 - protein, 149 aa, Glycine max
  Coding DNA Sequence Number=SeqID_21080
  Pfam annotation: Domain name=zf-CCHC; Domain location=77-94; Score =26.7; E_value=8.7e-05; Accession=PF00098.14; Description=Zinc knuckle
MELQRLNQNEETDKRKRSIALKASSSMQEEEEEEESDDEENFSLFVKKFHKFVKNRRMERCHNFDSRKRSQEGFPTLKCYKCNRPGHIKAHCPTNESWPEKNEKKSHEERRSKKAYIAWDDNDSSDGLEKEINLLSKDYESDENISQEH

SEQ ID NO: 112766 - protein, 99 aa, Glycine max
  Coding DNA Sequence Number=SeqID_21081
MHRLHLLRLTHLCHLTRNGIYGIWFASRRPITGRTCRPMTLYISLASAYQFRAEVAWPGDWPEAQAAKAPTETPGEPDEAREDEEMSDLLGFLGGSGAT

SEQ ID NO: 112767 - protein, 111 aa, Glycine max
  Coding DNA Sequence Number=SeqID_21082
MNEILDVSISFLNDHLEETLGSTKIEENHSKCINLTQCEANKSPMHRILVGNQRERTTLGHDFLSFLVYLVTILYCSDIVWARFMVSWDLGSRLVESDGHDIRQSVGLASG

SEQ ID NO: 112768 - protein, 139 aa, Glycine max
  Coding DNA Sequence Number=SeqID_21083
MERLGNSSSTPNNRERDYHNDSRHVTGVLLWKMVGYTPSSFIDLVFANKRIEVGLKRGKFNHPSWTNEKTGANEEGEKEGETHAVTAIPVRPNFPPTQQYLYSANNKLSPYPPPSYPQRPSLNLPQSLSTALPNDEDHL

SEQ ID NO: 112769 - protein, 102 aa, Glycine max
  Coding DNA Sequence Number=SeqID_21084
  Gene Ontology: Cellular component=chloroplast
  Homolog annotation: Hit_ID=Q49KT9; Match level="QueryCoverage=55%, HitCoverage=50%, E-value=1e-11, Identity=68%"; Hit description =Putative uncharacterized protein ORF113
MSPHGGDMDGGDKGKRGMGRIDGAIQVRSNVDPTFSSLVGSGRSGGDHHGSSLLENSYIPYQYMDSYLSSTGLGLASMEKNGAPNNVSSQTKNYEIAPFILG

SEQ ID NO: 112770 - protein, 88 aa, Glycine max
  Coding DNA Sequence Number=SeqID_21085
MAAQLIRDRVEMECLEGAWETLEGNTRCRFRGTIRFMATSLVHPDEPARTLQRTEFDDCTLVAEATTMDTFALDDTMYFVKLPYFGQL

SEQ ID NO: 112771 - protein, 202 aa, Glycine max
  Coding DNA Sequence Number=SeqID_21086
  Homolog annotation: Hit_ID=A5C7Z4; Match level="QueryCoverage=57%, HitCoverage=41%, E-value=7e-10, Identity=31%"; Hit description =Putative uncharacterized protein
MTLTTLELFLRPYQVRWDATVFGVVNPDFPLYIKHEDLSEIAHGGQCLSISVHLTETCMRAGNSDIYGFLEPQSIQRFHCSGHWQMVVILPKEHIVVWFCSLHNRQDNYLKGIINSAIKGLDDAPQPKSKASARWIVIKCNRQKGSTECGYYVMHWMSTIILGTFRNNWEAYFNDPRPLEPERLKALRIQWAQFYLRVRDQA

SEQ ID NO: 112772 - protein, 234 aa, Glycine max
  Coding DNA Sequence Number=SeqID_21087
  Homolog annotation: Hit_ID=Q6UUU1; Match level="QueryCoverage=22%, HitCoverage=40%, E-value=2e-08, Identity=60%"; Hit description =Putative uncharacterized protein
  Pfam annotation: Domain name=Ins_element1; Domain location=27-88; Score=-23.7; E_value=0.028; Accession=PF03811.4; Description =Insertion element protein
GFPVSTGTPRIYFILRSDLPSQWLLFLSAVPPCSATDGVVRNGKSTAGHQRWQAAQLLGRAIGAGLFAITPAGERGMCCKAIKLGNARVFPVTTLSGRKLLYQAYRYRRPRGGARYQLLFPLVRVNFELGVIMVIAVSFGKPVVPAALMNRPTRGERRFAYWALAECILAYYVGTDEGEKKGCTGCVSRICDTGYIPLPRSLTRYARSFDCGERKWLTNGAEISWKMPGRYLTG

SEQ ID NO: 112773 - protein, 90 aa, Glycine max
  Coding DNA Sequence Number=SeqID_21088
MNKIRNGQDKGKWITANVRATLDEHWGSTDFLNNSSTAKANRSIDRGASAYYGGSISTATHFEKLVILLHIYAFKGVLKTTNCLGGDGEN

SEQ ID NO: 112774 - protein, 96 aa, Glycine max
  Coding DNA Sequence Number=SeqID_21089
MSRREKSFVEAEAQEKSPVKEHESREKDEEKDEEQAQQQWEKYSKVENQQENILQSNNLPHQLIDKKGRQGEHEETLSAILSLITNTFLEMSFQII

SEQ ID NO: 112775 - protein, 204 aa, Glycine max
  Coding DNA Sequence Number=SeqID_21090
  Gene Ontology: Mol. function=catalytic activity; Biological process =aromatic compound metabolic process
  Homolog annotation: Hit_ID=A8G9E6; Match level="QueryCoverage=32%, HitCoverage=24%, E-value=1e-26, Identity=92%"; Hit description=2-oxo- hepta-3-ene-1,7-dioic acid hydratase
  Pfam annotation: Domain name=Hyratase_decarb; Domain location=111 -203; Score=-79.8; E_value=4.8e-05; Accession=PF01689.7; Description =Hydratasedecarboxylase
MPHFYAECTDNIRREADLPTCSPRSTRRWRRPASFRWPAYAAAPSGSTLADGRRQAGLRLRAHDAEDRPRPQSGKPAAGGRDAVCADQGTLCRADGAALPGALFHYGRAGSEQVNRAVQRLHQAEKSREQIRALSLDHPEITIEDAYAIQRQWVELKIAEGRTLKGHKIGLTSRAMQRHSDRSLYRAAGGGGAGVRAGQAAARV

SEQ ID NO: 112776 - protein, 114 aa, Glycine max
  Coding DNA Sequence Number=SeqID_21091
MKADIEAMKEKMTTMMEAMMSMRKMMEVNMATVVTTGIATKMDPTHPSGLNQVNRPVSVMVGQGGETLGSMGGPHFVQVQNKHSFPPYDLPPNYTPLKLYMLPMRTSINLLSYH

SEQ ID NO: 112777 - protein, 379 aa, Glycine max
  Coding DNA Sequence Number=SeqID_21092
  Gene Ontology: Mol. function=nucleoside-triphosphatase activity; Cellular component=mitochondrion; Biological process=riboflavin biosynthetic process
  Homolog annotation: Hit_ID=A4WA94; Match level="QueryCoverage=100%, HitCoverage=29%, E-value=0.0, Identity=94%"; Hit description=ATP -dependent helicase HrpA
  Pfam annotation: Domain name=DEAD; Domain location=80-237; Score= -22.2; E_value=0.0019; Accession=PF00270.20; Description=DEADDEAH box helicase
  Pfam annotation: Domain name=Helicase_C; Domain location=312-375; Score=6.6; E_value=0.011; Accession=PF00271.22; Description=Helicase conserved C-terminal domain
  Pfam annotation: Domain name=NACHT; Domain location=94-267; Score= -27.8; E_value=0.0087; Accession=PF05729.3; Description=NACHT domain
  Pfam module annotation: Pfam domain module=DEAD::Helicase_C::NACHT; Domain location=80-237::312-375::94-267
MTEQQKFTFPMLLQQLDSLTLRDKQRFARRLHGVKKVKNPDAQQAIYQEMAKEIEQAAGKVVLREAARPAITYPENLPVSQKKQDILEAVRDHQVVIVAGETGSGKTTQLPKICMELGRGIKGLIGHTQPRRLAARTVANRIAEELQTEPGGCIGYKVRFSDHVSDSTMVKLMTDGILLAEIQQDRLLMQYDTIIIDEAHERSLNIDFLLGYLKELLPRRPDLKVIITSATIDPERFSKHFNNAPIIEVSGRTYPVEVRYRPIVEEADDTERDQLQAIFDAVDELGNESAGDILIFMSGEREIRDTADALSKRDLRHTEILPLYARLSNSEQNRVFQPHSGRRIVLATNVAETSLTVPGIKYVIDPGTARISRYSYRTK

SEQ ID NO: 112778 - protein, 283 aa, Glycine max
  Coding DNA Sequence Number=SeqID_21093
  Gene Ontology: Mol. function=undecaprenyldiphospho-muramoylpentapeptid e beta-N-acetylglucosaminyltransferase activity; Cellular component=1- 2nm peptidoglycan-based cell wall; Biological process=UDP-N -acetylgalactosamine biosynthetic process
  Homolog annotation: Hit_ID=A6T4N3; Match level="QueryCoverage=92%, HitCoverage=73%, E-value=1e-142, Identity=95%"; Hit description=UDP -N-acetylglucosamine--N-acetylmuramyl-(pentapeptide) pyrophosphoryl -undecaprenol ...
  Homolog annotation: Hit description=N-acetylglucosamine transferase
  Pfam annotation: Domain name=Glyco_tran_28_C; Domain location=115 -275; Score=126.3; E_value=8.8e-35; Accession=PF04101.7; Description =Glycosyltransferase family 28 C-terminal domain
  Pfam annotation: Domain name=Glyco_transf_28; Domain location=1-77; Score=4.7; E_value=0.001; Accession=PF03033.11; Description =Glycosyltransferase family 28 N-terminal domain
  Pfam module annotation: Pfam domain module=Glyco_tran_28_C::Glyco _transf_28; Domain location=115-275::1-77
LKAQLLAPVRIFNAWRQARAIMKRFQPDVVLGMGGYVSGPGGLAAWSLGIPVVLHEQNGIAGLTNKWLAKIAKKVMQAFPGAFPHADVVGNPVRTDVLALPLPGQRLVGRQGPIRVLVVGGSQGARVLNQTMPQVAAKLGDAVTIWHQSGKGGMDTVRQAYAAAGQPQHKVTEFIDDMAAAYAWADVVVCRSGALTVSEIAAAGLPALFVPFQHKDRQQYWNALPLEKAGAAKILEQPEFTADAVAATLAGWDRETLMDMAGTSAWRFDSGCYRAGSGKRSAP

SEQ ID NO: 112779 - protein, 102 aa, Glycine max
  Coding DNA Sequence Number=SeqID_21094
MQVSSPGQAELAWASNLYTKWVKKGEGEGFCTKISLHPPPPHSKKQELTGLMDFAALRSPFFAFLIPFCSIIHLQQGKALSLWGILGKRGMPHWPHFLGFHG

SEQ ID NO: 112780 - protein, 18 aa, Glycine max
  Coding DNA Sequence Number=SeqID_21095
MTKIIQLIEGAKDTVIIQ

SEQ ID NO: 112781 - protein, 330 aa, Glycine max
  Coding DNA Sequence Number=SeqID_21096
  Gene Ontology: Mol. function=transferase activity, transferring phosphorus-containing groups; Cellular component=integral to membrane; Biological process=two-component signal transduction system (phosphorelay)
  Homolog annotation: Hit_ID=A6TCH0; Match level="QueryCoverage=97%, HitCoverage=67%, E-value=1e-149, Identity=83%"; Hit description =Sensor protein
  Pfam annotation: Domain name=HAMP; Domain location=27-97; Score=35.7; E_value=1.7e-07; Accession=PF00672.16; Description=HAMP domain
  Pfam annotation: Domain name=HATPase_c; Domain location=212-323; Score=104.3; E_value=3.8e-28; Accession=PF02518.17; Description =Histidine kinase-, DNA gyrase B-, and HSP90-like ATPase
  Pfam annotation: Domain name=HisKA; Domain location=101-169; Score =71.2; E_value=3.5e-18; Accession=PF00512.16; Description=His Kinase A (phosphoacceptor) domain
  Pfam module annotation: Pfam domain module=HAMP::HATPase_c::HisKA; Domain location=27-97::212-323::101-169
MVQATRTVIFSRGQQLQQEIAERGQFFGWQALVLFLLSLTLVLLFTRMIIGPVKGIEKMINRLGEGKSLDDAALFTGPRELRSVGKRIIWLSERLAWLESQRHQFLRHLSHELKTPLASMREGTELLADRVAGPLTTEQQEIVEILDNSSRNLQKLIEQLLDYNRKLADGPVERQKVDIAELAQTVVSAHSLPARAKMMSTELALGERFCLAEPTLLTSVLDNLYSNAVHYGAESGNIRIHSYRHGEQVRIDVANSGEPIPVAERNMIFEPFYQGSHLRKGAVKGSGLGLSIARDCVRQMQGELSLVDDNPGFICFRISLPAAEPGKTNT

SEQ ID NO: 112782 - protein, 585 aa, Glycine max
  Coding DNA Sequence Number=SeqID_21097
  Gene Ontology: Mol. function=protein serine/threonine kinase activity; Cellular component=ribosome; Biological process=protein amino acid phosphorylation
  Homolog annotation: Hit_ID=A2XGD6; Match level="QueryCoverage=19%, HitCoverage=29%, E-value=1e-16, Identity=43%"; Hit description =Putative uncharacterized protein
  Pfam annotation: Domain name=Pkinase; Domain location=414-573; Score=- 70.2; E_value=0.00021; Accession=PF00069.16; Description=Protein kinase domain
  Pfam annotation: Domain name=Pkinase_Tyr; Domain location=414-558; Score=-173.4; E_value=0.086; Accession=PF07714.8; Description =Protein tyrosine kinase
  Pfam module annotation: Pfam domain module=Pkinase::Pkinase_Tyr; Domain location=414-573::414-558
MLLLLQDSLQEQMMHGSFVLDGRDDILNTAIGRPEHLGRVRVAGTGVIISQYFEHASRCSNTSLTSISPQQLVNIIGNLKEEWRREVEEENKNLNEAWRREVEEENKLSLEIMKQGLKKAIKIKLSQMESQHPPHVEASDIQVLVAREESSGVDVASVGLYIVGDQCTHLVALGKVYDSVTTIHNVPYSNNVLRKLVELSWDETKFGIPNVQASFFIIHADVTEIISGDKCLNISILQLRMMAQWKLVVVCPWDNTIVWFCSLRKKPDVNIKATINSAMKTLTTSLEGKSDQPVPRWIETKNMLNIFHIEFRVMFKLEAECGYYVMHWMWNIISGGLKNEWNKWFSDGTELDIEAMTTLCKKWATYFLQDKCFLYWHTWHFAAYCQPKNFGSPVDSLNHKNKNQVGESIGVQDFEVLKVVGQGAFGKVYRVRRAGFILCLILSMVSTFSFSSITKAYLASSLIHSTFVRADLACFYAAEIICVVSYLHANDITHRDLKPKNILLDEDDMPVATYPSAGGRRETRGRRVPRKEYARSRHQRLFEENVGKTGKDAINELLSEKVRELYLRTGKVLAPHTSVPRDGSL

SEQ ID NO: 112783 - protein, 79 aa, Glycine max
  Coding DNA Sequence Number=SeqID_21098
MEEQAEYDNDELEKVNGLLKEKEKEIQDLEAEEKDYISQFLKNLEEKVHQIYLHAPNDRSEKLEVSKSNQQGASNGEWP

SEQ ID NO: 112784 - protein, 146 aa, Glycine max
  Coding DNA Sequence Number=SeqID_21099
  Homolog annotation: Hit_ID=Q6UUU1; Match level="QueryCoverage=41%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPVTIVLSPTRKDMQSTLAAAT

SEQ ID NO: 112785 - protein, 82 aa, Glycine max
  Coding DNA Sequence Number=SeqID_21100
  Homolog annotation: Hit_ID=UPI0000ECAFAB; Match level="QueryCoverage =40%, HitCoverage=40%, E-value=4e-12, Identity=100%"; Hit description= UPI0000ECAFAB related cluster
GRHRGGAPIRPIVSRITIHWPSFYNVVTGKTLALPNLIALQHIPLSPAGRGGCGGTRSVTATLASADVRRCFCRYATTPVSS

SEQ ID NO: 112786 - protein, 527 aa, Glycine max
  Coding DNA Sequence Number=SeqID_21101
  Gene Ontology: Mol. function=nucleotide binding; Cellular component =intrinsic to membrane; Biological process=defense response
  Homolog annotation: Hit_ID=Q2YE88; Match level="QueryCoverage=97%, HitCoverage=58%, E-value=1e-166, Identity=52%"; Hit description=NBS -LRR type disease resistance protein Rps1-k-1
  Pfam annotation: Domain name=LRR_1; Domain location=119-141; Score =11.1; E_value=2.7; Accession=PF00560.24; Description=Leucine Rich Repeat
  Pfam annotation: Domain name=LRR_1; Domain location=143-164; Score =7.7; E_value=12; Accession=PF00560.24; Description=Leucine Rich Repeat
  Pfam annotation: Domain name=LRR_1; Domain location=274-295; Score =7.5; E_value=13; Accession=PF00560.24; Description=Leucine Rich Repeat
  Pfam annotation: Domain name=LRR_1; Domain location=297-319; Score =1.0; E_value=2e+02; Accession=PF00560.24; Description=Leucine Rich Repeat
  Pfam annotation: Domain name=LRR_1; Domain location=355-378; Score =9.7; E_value=5; Accession=PF00560.24; Description=Leucine Rich Repeat
  Pfam annotation: Domain name=LRR_1; Domain location=430-453; Score =1.2; E_value=1.8e+02; Accession=PF00560.24; Description=Leucine Rich Repeat
  Pfam annotation: Domain name=LRR_1; Domain location=96-117; Score =17.9; E_value=0.038; Accession=PF00560.24; Description=Leucine Rich Repeat
  Pfam module annotation: Pfam domain module=LRR_1::LRR_1::LRR_1::LRR _1::LRR_1::LRR_1::LRR_1; Domain location=119-141::143-164::274 -295::297-319::355-378::430-453::96-117
DLILLWMAEDLLKLPNRGKALEVALYLGGEFYFRSEELGKETKIGIKTRHLSVTKFSDPISDIEVFDRLQFLRTLLAIDFKDSSFNKEKAPGKLIHLRYLNLSHTSIKTLPESLCNLYNLQTLALSRCEMLTRLPTDMQNLVNLCHLHIDHTPIGEMPRGMGMLSHLQHLDFFIVGKHKENGIKELGTLSNLHGSLSIRNLENVTRSNEALEARMMDKKNINHLSLKWSNGTDFQTELDVLCKLKPHQGLESLTIWGYNGTIFPDWVGNFSYHNMTYLSLRDCNNCCVLPSLGQLPCLKYLVISKLNSLKTVDAGFYKNEDCSSVTPFSSLETLEIDNMFCWELWSTPESDAFPLLKSLRIEDCPKLRGDLPNHLPALETLKIKNCELLVSSLPRAPILKGLEICNSNNVSLSPMVESMIEAITSIEPTCLQHLTLRDCSSAISFPGGMPPNLRTVWIFNCEKLLSGLAWPSMGMLTHLTVGGPCDGIKSFPKEDVGLHGASPSHIPPTIIHQRMSFAGEYGWRKAS

SEQ ID NO: 112787 - protein, 85 aa, Glycine max
  Coding DNA Sequence Number=SeqID_21102
MELQRLNQNEETDKRKRSIALKASSSMQEEEEEEESDDEEDFSLFVKKFHKFVKSRRMKRSHNFNNGKRSQEVSPTLKCYKCNQP

SEQ ID NO: 112788 - protein, 221 aa, Glycine max
  Coding DNA Sequence Number=SeqID_21103
  Gene Ontology: Mol. function=methyltransferase activity; Cellular component=cytoplasm; Biological process=biological_process
  Homolog annotation: Hit_ID=P60391; Match level="QueryCoverage=59%, HitCoverage=42%, E-value=9e-61, Identity=87%"; Hit description=S -adenosyl-L-methionine-dependent methyltransferase mraW
  Pfam annotation: Domain name=Methyltransf_5; Domain location=93-221; Score=26.3; E_value=4.2e-13; Accession=PF01795.10; Description=MraW methylase family
  Pfam annotation: Domain name=MraZ; Domain location=12-80; Score=80.9; E_value=4e-21; Accession=PF02381.9; Description=MraZ protein
  Pfam module annotation: Pfam domain module=Methyltransf_5::MraZ; Domain location=93-221::12-80
MNPNERRVQRLLLGHASECQMDNAGRLLLANTLRQHASLTKEVMLVGQFNKFELWDEQTWYQQVKDDIDAEQSAQEPLSGGVAGLVAIAMQENFKHTTVLLDEAVNGLNIREDGIYIDGTFGRGGHSRLILSQLGAHGQLLAIDRDPQAIAAAAEIKDPRFSIVHGPFSALAEYVEERGLTGKIDGVLLDLGVSSPQLDDAERGFSFMRDGPLDMRMDPTR

SEQ ID NO: 112789 - protein, 81 aa, Glycine max
  Coding DNA Sequence Number=SeqID_21104
MRHPIPMIGGMMNVLGGATLFCKITHAPNIFMICVHRDSLGSDQGLPMDPKRIKVIPEWPTPPCIREIWGFNDLTNFCKRC

SEQ ID NO: 112790 - protein, 182 aa, Glycine max
  Coding DNA Sequence Number=SeqID_21105
  Gene Ontology: Mol. function=protein dimerization activity
  Homolog annotation: Hit_ID=A5BG18; Match level="QueryCoverage=98%, HitCoverage=29%, E-value=2e-35, Identity=37%"; Hit description =Putative uncharacterized protein
MLISIMKKFTNGRDLIRPGMTRFATTYLTLACLHELKASLMNMFIFEEWKTSKFGTSQEGRKVQNVALDSQFWKNITIYEPVWKIIYERWDHQLHRPLHAAAYYLNPHLHYEPTFRHDDPQLKEGGLFSMEKAKDSRKIMQPGEWWEMFSDGTPELRRFAIRVLSFTCSSSGCERNWSSFEM

SEQ ID NO: 112791 - protein, 123 aa, Glycine max
  Coding DNA Sequence Number=SeqID_21106
  Homolog annotation: Hit_ID=Q84VI1; Match level="QueryCoverage=53%, HitCoverage=9%, E-value=2e-15, Identity=71%"; Hit description =Envelope-like protein
  Subcellular localization annotation: CTP_CleavageSite=25; ConfidenceScore=5.27e-01
IGAANWVPTNHTSTVATGTHVRDIVSTSVSTSGKAAASGAVSKDALIAELKDTCKVLEATIKATTEKKMELELLIKRLSESGIDDEEAAEEEGEAAEEEEEAAEEEEDAAEETESDDDSEATP

SEQ ID NO: 112792 - protein, 136 aa, Glycine max
  Coding DNA Sequence Number=SeqID_21107
  Gene Ontology: Mol. function=helicase activity; Biological process =viral genome replication
  Homolog annotation: Hit_ID=Q9LX60; Match level="QueryCoverage=97%, HitCoverage=10%, E-value=2e-29, Identity=38%"; Hit description =Putative uncharacterized protein F4M19_60
MYTIEFQKRGLPHVHLLLFLHPDNKYPSSDEIDQIISTEIPSQQDDPELHSLVKNHMVHGPCGTSNPGSPCMKEGNPRLLRKYQAHINIEWCNQSTSIKYLFKYINKGYDRVTAILIHDDNDRTHNGSTHNDEIKE

SEQ ID NO: 112793 - protein, 86 aa, Glycine max
  Coding DNA Sequence Number=SeqID_21108
MGIAALPLESLSSQSFLRSQSKSEVQVPLDQRLYEESGTTLKKIIVVLFEHLLLVISLQLNSRRQQIKLTRAGRNAPSGALPLTLN

SEQ ID NO: 112794 - protein, 182 aa, Glycine max
  Coding DNA Sequence Number=SeqID_21109
  Homolog annotation: Hit_ID=Q6UUU1; Match level="QueryCoverage=80%, HitCoverage=100%, E-value=6e-42, Identity=64%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGEREMAYERGGDFLEDARKILNREVRGPRQSRFSIGSAPLTSITKSDAQISGGETRQDYKDTRRSPWRLPRALSVPAFRFTGCHSAGMAAFVSFHADTQFGS

SEQ ID NO: 112795 - protein, 115 aa, Glycine max
  Coding DNA Sequence Number=SeqID_21110
  Homolog annotation: Hit_ID=Q6WAY6; Match level="QueryCoverage=66%, HitCoverage=13%, E-value=5e-10, Identity=42%"; Hit description =Putative uncharacterized protein
KEGRIRILSSCEGFPNVPLMGTRGCINHNPALTIRQLGYPMRGVPSDESITPFIARGFSDPNARVLQGVRKAWDATVRDNEVKASEESDEVQALKAKLERARIVKEKFKSIAIKV

SEQ ID NO: 112796 - protein, 178 aa, Glycine max
  Coding DNA Sequence Number=SeqID_21111
MGLPRGVIEWGGLKTRSGSHEGFWDGSLVIDYQIVMAAQLIRDRVEMECLEGAWETLEGNTRCRFRGTIRFTATSLVHPDEPARTLQRTVEWILPTPTPYRLVEPVPVIEVTSSEEDPEKDLEELPPEPTVDALDFLEGDEDPLLEVDSPEEVMSASEADSTEDSGPEEMAISGGSSS

SEQ ID NO: 112797 - protein, 112 aa, Glycine max
  Coding DNA Sequence Number=SeqID_21112
  Homolog annotation: Hit_ID=Q5QJQ3; Match level="QueryCoverage=67%, HitCoverage=89%, E-value=5e-28, Identity=59%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPTRKDMQKHHWAAATGN

SEQ ID NO: 112798 - protein, 202 aa, Glycine max
  Coding DNA Sequence Number=SeqID_21113
  Gene Ontology: Mol. function=aspartic-type endopeptidase activity; Cellular component=small subunit processome; Biological process=DNA integration
  Homolog annotation: Hit_ID=A5BEY3; Match level="QueryCoverage=81%, HitCoverage=16%, E-value=9e-19, Identity=31%"; Hit description =Putative uncharacterized protein
  Pfam annotation: Domain name=zf-CCHC; Domain location=126-143; Score =12.0; E_value=0.023; Accession=PF00098.14; Description=Zinc knuckle
MKVTALKQTSHDMIAHVGKARAAVEELRKFLVADSLEEVNRKLDKFYMVLILRSLHSDFDHVRDQVLAGDQVPSMDSLITRLLRVPHLSKDENPTDSVETSAMVASRGRGGGRNSRGGRNGRGGRPHCTYCKRMGHTQENCYSLHGFPDKVAQVSRSEKAESKFSDEEYQEYLKLKSERPSNQAQSSSVPCFSQLVSLNQLK

SEQ ID NO: 112799 - protein, 19 aa, Glycine max
  Coding DNA Sequence Number=SeqID_21114
FEPFFDVLHSFFIVLRSST

SEQ ID NO: 112800 - protein, 80 aa, Glycine max
  Coding DNA Sequence Number=SeqID_21115
  Subcellular localization annotation: CTP_CleavageSite=64; ConfidenceScore=5.72e-01
MAMDLNFSSTTQALSSSAFRASTYDSPPMIPLRLPLSSLSFLHAASHALRTPWSTLALWSPKPRAMKGMMLSSNGAPLMG

SEQ ID NO: 112801 - protein, 222 aa, Glycine max
  Coding DNA Sequence Number=SeqID_21116
  Homolog annotation: Hit_ID=Q6WAY6; Match level="QueryCoverage=44%, HitCoverage=17%, E-value=6e-11, Identity=36%"; Hit description =Putative uncharacterized protein
EGKEGVLFSCGDYPNIPLIGTRGCINYNPALAIRQLGYPMRGASTEESLSPFPVRDFGAESFKVIQRVQKAWESPLRKDKELRGIRNGIVGGYHEWRKVRTRGLDWLSKLKVINEENFEAPEEDEEVRALKTELRKARLGKEKFKLVATDKACKEESWLETKLGLGALWGSSNSDLKLRRELRETSLRAHSMVLGEKGTYLFFGFLPRDTLCSAFMARGWTA

SEQ ID NO: 112802 - protein, 85 aa, Glycine max
  Coding DNA Sequence Number=SeqID_21117
MKNCLEYHNSRELKTYFDLQIQLQLSTTTQFLQRHLSYPNFVQGLLLDGMQPLIDRFEVLNTLCFTMCEVPRRAGNQKKAWLRDP

SEQ ID NO: 112803 - protein, 34 aa, Glycine max
  Coding DNA Sequence Number=SeqID_21118
MADQQATKCKAKAQDVKEALLGGNLVPFKSVLVI

SEQ ID NO: 112804 - protein, 158 aa, Glycine max
  Coding DNA Sequence Number=SeqID_21119
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=63%, HitCoverage=79%, E-value=3e-24, Identity=59%"; Hit description =Putative uncharacterized protein
MVISEQWSSYKADDINKAKSVKKTLLDDIWWDKKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 112805 - protein, 261 aa, Glycine max
  Coding DNA Sequence Number=SeqID_21120
MGMGDFISRLSFPVDALFENTETISSLTSYPELRRSEFIIGGYVGARASLLLTTPLFVTMTQELVARGDTLRLSAPRRSVTPSVIDEQRPMWSEFLIGGYVGARASLLSTTPLFVTMTQELVARGDTLRLSAPRCSVTPSVIDEQRPMWSSAPFPEMSKSLAFVGRPTRSVILTLRSCDMRRQNLVIPHPFAIQTQSCPMARRDKIWSFCTLLSSRGGGPDDMRRQNLVIPHPFAIQTQSCPMARRDKIWSFCTLLSSRGG

SEQ ID NO: 112806 - protein, 81 aa, Glycine max
  Coding DNA Sequence Number=SeqID_21121
  Homolog annotation: Hit_ID=A5BUU0; Match level="QueryCoverage=62%, HitCoverage=8%, E-value=5e-09, Identity=52%"; Hit description =Putative uncharacterized protein
MELDQQDSHREDSTPVILDVVKKEITKLLQAGIIYPTANGRLNQVTKKDHFPLPFIDQMLERLAGGCLSACAMPLVPSNGA

SEQ ID NO: 112807 - protein, 200 aa, Glycine max
  Coding DNA Sequence Number=SeqID_21122
RNWSSTAVAAALELVDPPGCRNSIPHADAPPPDAPRPAWMPRKACASHHQRACVALRKPAARAGVGLVLAAGDGAMATLDRAPDWPRARCLARTAGMQRDHAPPPVIRHRQRGGRRPGGAGGGRRRDANAIRHAVVGVVVRLSGELSPGAFAGLEGQGLRPAGIKLIDTVDLEGGPGYQLLFPLVRVNFELGVIMVIAVS

SEQ ID NO: 112808 - protein, 203 aa, Glycine max
  Coding DNA Sequence Number=SeqID_21123
  Homolog annotation: Hit_ID=Q84VH5; Match level="QueryCoverage=99%, HitCoverage=31%, E-value=8e-97, Identity=85%"; Hit description =Envelope-like protein
WSKVAIPSKKRKEISSSDSDDDVELDVPDIKRVKKSGKKVPGNVPDAPLDNISFHSIGNVERTGRDALDCKEIMDLIKAAGLLKTVTKLGDCYESLVREFIVNIPSDITNRKSDEYQTVFVRGKGIRFSPAVINKYLGRPTEGVVDIAVSEHQIAKEITAKQVQHWPKKGKLSAGKLSVKYAILHRIGTANWVPTNHTSTVAT

SEQ ID NO: 112809 - protein, 278 aa, Glycine max
  Coding DNA Sequence Number=SeqID_21124
  Homolog annotation: Hit_ID=Q84VH5; Match level="QueryCoverage=85%, HitCoverage=39%, E-value=2e-58, Identity=72%"; Hit description =Envelope-like protein
VLDIRGQEIREKGAWKCPDAPLDNISFHSIGNVERWKFVYQRRLAVERELGRDALDCKEIMDLIKAAGLLKTVTKLGDCYESLVREFIVNIPSDITNRKSDEYQKVFVRGKCIRFSPAVINKYLARPNEGVVDIAPAPVPENWLPTIDTSRCHRGDRLSKLEEDDQATEETPAPRAPEPAPGDLIDLEEVESDEEPIANKLAPGIAERLQSRKGKTPIKRSGRIKTMAQKKSTPITPTTSRRSKVAIPSKRGKKFPHLILMMMLTRCSRHQRARHQGK

SEQ ID NO: 112810 - protein, 103 aa, Glycine max
  Coding DNA Sequence Number=SeqID_21125
  Gene Ontology: Mol. function=structural constituent of ribosome; Cellular component=intracellular; Biological process=translation
  Homolog annotation: Hit_ID=Q32703; Match level="QueryCoverage=36%, HitCoverage=90%, E-value=3e-11, Identity=84%"; Hit description =Putative uncharacterized protein
MNSQYICFYLMPFFVHGSIFWCPRRRGTTPIHPELGGYSGEQISSGDDGVGPVAQRIRARGYEPRCRGFESLLAHNRPKKGKIFPSGGRKIMIGLADPKLWNL

SEQ ID NO: 112811 - protein, 157 aa, Glycine max
  Coding DNA Sequence Number=SeqID_21126
KEGRIRILSSCEGCPMRGVPSDESITPFIARGFSDHNARDRELRGSSNGIIGGYHKWLRVRTQGLDWLPNLKTVRDDERSLKSHRVGPCKEKRVWGTSEICQGSLFGAKRAKDPWQRHDLKANGLSFIDGLGAFEVFGKEICPLSSETMEGNMWAIR

SEQ ID NO: 112812 - protein, 131 aa, Glycine max
  Coding DNA Sequence Number=SeqID_21127
MSVSACYQAFRLTDSKKNVYTDNHSGISARQRDSNVSMTDIVSAEDDTTKKNVYKDNHSGISARQRDSNVIMTDLVSAEDDTAKKNVYTDNHSGISARQRDSNVSTTDLVSTEDDVNLHVSTGLLAAIDGG

SEQ ID NO: 112813 - protein, 56 aa, Glycine max
  Coding DNA Sequence Number=SeqID_21128
MLKIRKVLLGDSYTTTVAETGDVELKFTSGKDFDSQRCDAYSRDEKESGFRERVRH

SEQ ID NO: 112814 - protein, 63 aa, Glycine max
  Coding DNA Sequence Number=SeqID_21129
MFFEAGLLLGELGGNLSLLFPINRLKGVVLMIWDAPGEVFVSKFVKVFLRYSSFFIRSSFFNG

SEQ ID NO: 112815 - protein, 83 aa, Glycine max
  Coding DNA Sequence Number=SeqID_21130
  Subcellular localization annotation: CTP_CleavageSite=43; ConfidenceScore=5.25e-01
GVYPDLSSFTGSGVYPDLSSFTGSGVYPDLSSLTGSGVYPDLSSFTGSGVIQIFVACIKRSAPTQVHISRPASVFKKKLRNVG

SEQ ID NO: 112816 - protein, 40 aa, Glycine max
  Coding DNA Sequence Number=SeqID_21131
GKLGQALRAFAKHNPPGLSARKTLEEDELYRFTKRTASSH

SEQ ID NO: 112817 - protein, 91 aa, Glycine max
  Coding DNA Sequence Number=SeqID_21132
MALARDFRRETTHGAIWFRIGSKIPLAIYTLGVVAKYLDGMAPRNLASKRSRKDKAAEGTSSAPEYDNHRFRSAVHQQRFEAIKGRSFLWE

SEQ ID NO: 112818 - protein, 77 aa, Glycine max
  Coding DNA Sequence Number=SeqID_21133
MHSPLKARACRPLKVRTYSPLKARMCSPLKARACSPLKKTQIDYPFERGDNSCNLILSFTNLSTNSLRVYVLFDLNT

SEQ ID NO: 112819 - protein, 156 aa, Glycine max
  Coding DNA Sequence Number=SeqID_21134
MWVSSEWFPADFRSEEKETNKCRGFERAGCEISSTIVVEAKLHDESRLIQRCFDDNKDDDKGKLKNTSRFKRKVDFKNQESRFKDKASKNQDQDSRIKRRLNQDKYEKGTSFVVQVEGTSTWVIDWEQERVHLLWISSSGGLKRNLKDRKSLGDWM

SEQ ID NO: 112820 - protein, 132 aa, Glycine max
  Coding DNA Sequence Number=SeqID_21135
MATTEALEQETKKARKEEHGRNKFRGTLWGSNSELKLRRAKRDQSWIEGMILKDELKACHRSKRSLSEKLSKTEGNIPASGKGGKGKGDHFIAQRSNDVDGHVLLYFEWESRASLTASQGQGNGGCVLGSRG

SEQ ID NO: 112821 - protein, 201 aa, Glycine max
  Coding DNA Sequence Number=SeqID_21136
MIRGDTLRLSAPFCHPEAAGPMIRGDTLRLSAPFCHPEAAGPMTSRDQVWSFCTLVSSRGGGPDDTRRYLTVIRTLLSSRGGGPDDTRRYLTVIRTLLSSRGGGPDDKQRPKAAGPMIRGDTLRLSAPFCHPEAAGPMTSRDQVWSFCTLVSSRGGGPDDTRRYLTVIRTLLSSRGDGPDDKQRPSLVILHPCIIQRRRAR

SEQ ID NO: 112822 - protein, 75 aa, Glycine max
  Coding DNA Sequence Number=SeqID_21137
MTRDQRLYSGPEFCHYFAPGGHLGVQRTARKVLTVAFIGPPSLKMCGTFVALMNSVREQELIMFQMGWKPSPLEL

SEQ ID NO: 112823 - protein, 74 aa, Glycine max
  Coding DNA Sequence Number=SeqID_21138
  Subcellular localization annotation: CTP_CleavageSite=37; ConfidenceScore=5.61e-01
MDLGRFQVSVPGNSYPSKTFLGRNMVLGANSPFVLVKSSTLNLGGVMILGTRNNSSRLAKGIIFTSFNGPGAFL

SEQ ID NO: 112824 - protein, 184 aa, Glycine max
  Coding DNA Sequence Number=SeqID_21139
  Gene Ontology: Mol. function=protein binding; Cellular component =outer membrane-bounded periplasmic space; Biological process=cell wall organization and biogenesis
  Homolog annotation: Hit_ID=A8GL25; Match level="QueryCoverage=51%, HitCoverage=37%, E-value=2e-28, Identity=60%"; Hit description=Pili assembly chaperone precursor
  Pfam annotation: Domain name=Pili_assembly_C; Domain location=35-116; Score=36.0; E_value=1.3e-07; Accession=PF02753.8; Description=Gram -negative pili assembly chaperone
GWIEDVNGNKLEAGGPLTLLPPALALVATEQQSAPFQEKITLSRKGESYTVNNPTPYYITLIGASSKVKGDPVKGFEAMMVPPKGSAKLGGKASELGTEPVLVYVNDYGAMPSLTFRCDGTECRVNAGQTDGLVEGDNGVLHVSGVLTESACRLEMPSADQTVEMGNISTGELSVVGSRGTPVA

SEQ ID NO: 112825 - protein, 269 aa, Glycine max
  Coding DNA Sequence Number=SeqID_21140
MEESMSPFLVRDFGAQNSKTIQRIHKAWETPLRKDQELRGIRNGIIGGYHEWLKVHIRGLYWLAKLKVISEESFEAPEEDEEVQALKSELGKAKLAKEKFKLAATHIRKECAGLREENAITAKALEQETKRARKEEYGRNKFRGALWGPKEALSQRLCETETNMLAIIAKYQEELGLATAHEHRVADEYAQVYTAKKEARGRVIDSLHQEATMWMDRFALTLNGSQELPHLLAKAKVMADTYSAPEEIHGLLGYCQHMIDLMAHIIRNR

SEQ ID NO: 112826 - protein, 127 aa, Glycine max
  Coding DNA Sequence Number=SeqID_21141
AQRDAPQAAGAPPPPHQAGPAVSFDMEQYLRHLVRQQAANHRAHVQTHDCLYQLSLSMQSQGFASFSCPTQDQFRAEVAWPGDWPEAQAGEAPPEAPGDGEEAHEDEEMADLLGREWSYMTGRSPYS

SEQ ID NO: 112827 - protein, 61 aa, Glycine max
  Coding DNA Sequence Number=SeqID_21142
  Homolog annotation: Hit_ID=A7QUJ8; Match level="QueryCoverage=59%, HitCoverage=15%, E-value=3e-08, Identity=75%"; Hit description =Chromosome chr10 scaffold_179, whole genome shotgun sequence
MGSTNTLSNCRTEVCKALEMPEEECELSMGMSGDFELAFWMLFSSSGNELTIIIGMGFFDT

SEQ ID NO: 112828 - protein, 173 aa, Glycine max
  Coding DNA Sequence Number=SeqID_21143
  Homolog annotation: Hit_ID=Q6WAY4; Match level="QueryCoverage=87%, HitCoverage=27%, E-value=1e-18, Identity=36%"; Hit description =Putative uncharacterized protein
MGTNQNDKRFYQVKVKSLDVTSLKELGQLMGPLQRQAFCKVYGKILDLTAAEVFTEAVVSLAQYYDQPLRCFTFGDFQMVPTIEEFEEILGCPLEGRKPYLFFGFLPSLSKIAAVVGDSAKELDRMKQTRNGIVGLPRKYLEGKARDMASQEKWGPFVDILALLIFGVVLFRT

SEQ ID NO: 112829 - protein, 69 aa, Glycine max
  Coding DNA Sequence Number=SeqID_21144
MAWNFLFKCKYVHDEMAPRKLPAKRSRKDKAAEGTSAAPEYDSHRFWSAEHQQRFEAIKDGHSIGRRRV

SEQ ID NO: 112830 - protein, 143 aa, Glycine max
  Coding DNA Sequence Number=SeqID_21145
MHKALRLNAPLPYPQLVTLFLRHFEIPLDFESYIPIKISLLIGAAAIVSFGYRKERDGSWVKKGTQPADEEGNLPDEDNSTLLRRLMDKFDGLQTFVGDKFDAMELQVDMRFDAMESRITRVEEDVSFIRTCFDPPPPPPSSS

SEQ ID NO: 112831 - protein, 20 aa, Glycine max
  Coding DNA Sequence Number=SeqID_21146
PNHKIMEEIHGEEDEAQGIK

SEQ ID NO: 112832 - protein, 118 aa, Glycine max
  Coding DNA Sequence Number=SeqID_21147
MAAQLIHDRVVMECLEVHPEEPAHTLQQPVEWILPTPTPYRLVEPVQVIEVSSSEEDREEDPEELPPEPAMDALDLPEDDEDPLPDVDSPEDIMSAFEADSTEENGPRGTANSDNSSS

SEQ ID NO: 112833 - protein, 86 aa, Glycine max
  Coding DNA Sequence Number=SeqID_21148
  Homolog annotation: Hit_ID=A5AUE6; Match level="QueryCoverage=87%, HitCoverage=4%, E-value=4e-18, Identity=42%"; Hit description =Putative uncharacterized protein
MDALKIYLNEVKRQLDRKVKLVKSNRGGEYYERFHNKVVPNTSFEPWTNRIPSIRHLHVWGCQTKIRIYNPQDKKTGCKNNQWIFH

SEQ ID NO: 112834 - protein, 133 aa, Glycine max
  Coding DNA Sequence Number=SeqID_21149
  Homolog annotation: Hit_ID=O52175; Match level="QueryCoverage=61%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGGVSLEVMRPVKAKLKGQVLGDLRSSKPVTSGFKRW

SEQ ID NO: 112835 - protein, 169 aa, Glycine max
  Coding DNA Sequence Number=SeqID_21150
  Gene Ontology: Mol. function=nucleoside-triphosphatase activity; Cellular component=chloroplast
  Homolog annotation: Hit_ID=Q2PMM5; Match level="QueryCoverage=100%, HitCoverage=10%, E-value=4e-83, Identity=70%"; Hit description =Protein ycf2
MSHTNGFGSTTMGSNVRSVQDHGILFYQIGRAVSQNVLLSNCSIDPISIYMKKKSCDGGDSYLYKWYFELGTSMKKLTILLYLLSCSAGSVAQDLWSLPGPDEKNGITSYGLVENNSDLVHGLLEVEGALVGSSRTEKDCSQFDKDRRFLYEKYESEFEEGGGVLDPHR

SEQ ID NO: 112836 - protein, 137 aa, Glycine max
  Coding DNA Sequence Number=SeqID_21151
  Homolog annotation: Hit_ID=A1IW39; Match level="QueryCoverage=37%, HitCoverage=92%, E-value=2e-12, Identity=71%"; Hit description =Putative uncharacterized protein ophh-69
ERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHSAGRSREVGDLMTGGADDRSP

SEQ ID NO: 112837 - protein, 182 aa, Glycine max
  Coding DNA Sequence Number=SeqID_21152
MEKTKKLKFEEWVNDKSREFADSLNTTTSVNDNEIYLNVVGGPNYKGKVYGLGTLSKRFSCSKSVPSTSIALVEDQIEEMRETINKLNAKLLAKTNKEKILEDKMLQPMENHDHQSQEMQQQMQEQNEQIHQHNEQMQCILQHLHIESIMPAPNLLPTIADGTKRHVNDTQVDRPHNMKNDH

SEQ ID NO: 112838 - protein, 80 aa, Glycine max
  Coding DNA Sequence Number=SeqID_21153
MGARDKSIMFKDLLHQWIPFFLEDEWQRNGERKRERRRHFKEKMSLEEARLHRRPWIRAWKKKEMNEGRGREEPEILCSK

SEQ ID NO: 112839 - protein, 162 aa, Glycine max
  Coding DNA Sequence Number=SeqID_21154
MWAFHIGRQIDWAHLVRYHMHKALQLNDSLPYPHLVTLFLQHFNIPLDSEPYVPIKRSFLIGAAVVASFGYCKERDGSWVKKGAQPIDDEGHLPVGEDSSLLQRILDRFDGLQTYVGERFDALELQVDMRFDEMDSRITKVEGDVTYIRTCFDLPPPPPPSS

SEQ ID NO: 112840 - protein, 120 aa, Glycine max
  Coding DNA Sequence Number=SeqID_21155
  Subcellular localization annotation: CTP_CleavageSite=40; ConfidenceScore=5.15e-01
MMDELLHHSSAALCIGAEVAVSSRTGPATRVVHRAAVFPSQAEKTSKESLSMALPGNPNVSSRCAPLGYPANRQERSCFLVDSSDDADTTGCLRGKHRPYAKEARSYIRIYRLVGLRKSC

SEQ ID NO: 112841 - protein, 286 aa, Glycine max
  Coding DNA Sequence Number=SeqID_21156
  Gene Ontology: Mol. function=aspartate-tRNA ligase activity; Cellular component=cytoplasm; Biological process=tRNA aminoacylation for protein translation
  Homolog annotation: Hit_ID=Q8UG87; Match level="QueryCoverage=100%, HitCoverage=52%, E-value=1e-150, Identity=85%"; Hit description =Aspartyl-tRNA synthetase
  Pfam annotation: Domain name=GAD; Domain location=169-266; Score =45.2; E_value=2.4e-10; Accession=PF02938.5; Description=GAD domain
  Pfam annotation: Domain name=tRNA-synt_2; Domain location=4-283; Score=72.3; E_value=2.2e-19; Accession=PF00152.11; Description=tRNA synthetases class II (D, K and N)
  Pfam module annotation: Pfam domain module=GAD::tRNA-synt_2; Domain location=169-266::4-283
PDYPEDVRLKYRFLDLRRETLHKNIVKRTQIISAMRTGMADAGFAEYTTPILTASSPEGARDFLVPSRIHEGKFFALPQAPQQYKQLLMVAGFRPLLPDRAEDVWTTMEPMMTAVFEKFAEGKPVTKEWPRIPYDEAIRKYGSDKPDLRNPIVMQAVTEHFDGSGFKVFANMIASNPKVQVWAIPAKTGGSRAFCDRMNAWAQSQGQPGLGYIFWKEEDGKVGGSGPLAKNIGEERTEALRQQLGLEAGDACFFVAGDPAKFYKFAGEARTRAADELNLIDRDRFE

SEQ ID NO: 112842 - protein, 95 aa, Glycine max
  Coding DNA Sequence Number=SeqID_21157
MAKFDLEVVLEFYANAWPTEEGVRDMRSWVRGMPPTRHPLDLDKSNRALGFLALITSLCQSFGVPVTPSKVIRPLITRAFIEKYCTPRQAQGDAH

SEQ ID NO: 112843 - protein, 65 aa, Glycine max
  Coding DNA Sequence Number=SeqID_21158
  Subcellular localization annotation: CTP_CleavageSite=30; ConfidenceScore=5.02e-01
MTLGAEFNVESLTCRDWNTSSKVSQKVCVRFCARKKMTTYISMKFSRFKKLGLGFDMLMKDRDTG

SEQ ID NO: 112844 - protein, 179 aa, Glycine max
  Coding DNA Sequence Number=SeqID_21159
  Homolog annotation: Hit_ID=O52175; Match level="QueryCoverage=45%, HitCoverage=94%, E-value=2e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGTSFGDCAPPSQLPRFKELVAQRTFEKPPCKAVFSFSEQEITRRPKRSQEDHLINQIKYLLGTNNCLKKIYAPALPLIAVLL

SEQ ID NO: 112845 - protein, 64 aa, Glycine max
  Coding DNA Sequence Number=SeqID_21160
VKGPSGKEAEVPEESEEVQALKAELEKMRVVKEKLKTTVTRVRKECDKLRDVNMTDVSLFSLIS

SEQ ID NO: 112846 - protein, 50 aa, Glycine max
  Coding DNA Sequence Number=SeqID_21161
MLVFMRNNAVRKRREQEAQGRSQTSPPPSPQSYIQMERGTCTTNDARGLL

SEQ ID NO: 112847 - protein, 90 aa, Glycine max
  Coding DNA Sequence Number=SeqID_21162
  Subcellular localization annotation: CTP_CleavageSite=54; ConfidenceScore=5.71e-01
MATPPSSPSSPPPTGVGSHSSSTLKRTRKATRLRSLVTRPVGAERPLVHVDFVTEKADSPHRKKLRTYLGIIARDKVDVTYKNWKRVPTA

SEQ ID NO: 112848 - protein, 78 aa, Glycine max
  Coding DNA Sequence Number=SeqID_21163
MACLDQQHSRNEGHAAVVVEDLSISDLDDSSNLDCIYCSKGHNYSIVVGFATEEIVSAKKDKDLYGDLQKNIDHRLYN

SEQ ID NO: 112849 - protein, 165 aa, Glycine max
  Coding DNA Sequence Number=SeqID_21164
MCSSQYSLEEQVSQGSFVAHGHHDVLAAAIGQPEHPGRVHFAGAGVTIKQYFGSIPRTSCITKESCVDLSGNDLDTDDLDKYGLYIKGNPPRLVALGRVYEGSTIVHNIPLLHDQVKVGVEEVRDADAPIPIPIEEVKVVGQTLNTFLSWLAHLVKRLSEQLWDP

SEQ ID NO: 112850 - protein, 111 aa, Glycine max
  Coding DNA Sequence Number=SeqID_21165
  Gene Ontology: Biological process=transposition, DNA-mediated
  Homolog annotation: Hit_ID=Q1J7G7; Match level="QueryCoverage=34%, HitCoverage=67%, E-value=7e-11, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPEFDKGNEWIVMEACLRSFYEGWIFELQ

SEQ ID NO: 112851 - protein, 98 aa, Glycine max
  Coding DNA Sequence Number=SeqID_21166
MTLAPGACFVQRDATTLVASAGNARGRCLVINGCYLVDPASSHMLVSKIKPCMFKKLVVGPWVGSIGPPPVCTGRLVPSAGDALLSLTGRVVPPVLLL

SEQ ID NO: 112852 - protein, 232 aa, Glycine max
  Coding DNA Sequence Number=SeqID_21167
  Gene Ontology: Mol. function=chloramphenicol O-acetyltransferase activity; Biological process=response to antibiotic
  Homolog annotation: Hit_ID=P62577; Match level="QueryCoverage=89%, HitCoverage=94%, E-value=1e-122, Identity=99%"; Hit description =Chloramphenicol acetyltransferase
  Pfam annotation: Domain name=CAT; Domain location=6-209; Score=510.6; E_value=1.8e-150; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNDYNSTAMSGRAGRNFFKAVMCLEYFI

SEQ ID NO: 112853 - protein, 141 aa, Glycine max
  Coding DNA Sequence Number=SeqID_21168
MTETSMRVGNADVYGFLEPQSIQRSGQLQFESESYIKNWMQNSNRDVYLGAYLNGAHFQMVVILPKENVVIWFCSLHNRLDNYLKGIINRNINILIVQYASMFVLNNALKRFDDTPQSKSKAAVRWIVVKCNRQKGSTECE

SEQ ID NO: 112854 - protein, 42 aa, Glycine max
  Coding DNA Sequence Number=SeqID_21169
MGAKYLEVVKRGLHPNNGCSPDEIKGAESVSARLPTQLVVPE

SEQ ID NO: 112855 - protein, 59 aa, Glycine max
  Coding DNA Sequence Number=SeqID_21170
MSWNFTNYLTMGVKYLEAIKRRLHATKQWYLDEIRNRMTNIILIPSNSFASVDERCGRP

SEQ ID NO: 112856 - protein, 335 aa, Glycine max
  Coding DNA Sequence Number=SeqID_21171
  Homolog annotation: Hit_ID=Q6WAY6; Match level="QueryCoverage=83%, HitCoverage=50%, E-value=4e-29, Identity=31%"; Hit description =Putative uncharacterized protein
MVEEFEEILGCPLGGRKPYLFTGFYPSLARISKIVQISAQELDHRKQVENGVVGIPRKYLEVKARILADKGEWVPFIDILALLIFGGVLFPNVDGLVDLAAIDAFLAYHNHKESPVVAMLADLYDTFDRRFSHLFRQEVRHACPLESLRSCTEKGRADWDQLLASIEGAYVNWFLRWKEGRTGVLISCGGFPNVPLMGTRGCISYNLILAIRQLGYPMRGAPLEEEIVPVISRGFNKTNVETLQKVRMAWEVLQKKDKELRGSNNGPIGGYREWLKAHVQGLDWLPSLRTTKREEDEAPEEDEEVQALRTELKQAQTVKKGSNLQLLKSERRMPN

SEQ ID NO: 112857 - protein, 115 aa, Glycine max
  Coding DNA Sequence Number=SeqID_21172
MRLINTTCNKKGYSKAFHLWLVIDYQRLPKFPDFVFKPGNRLHPLELACLGTSQVLTDRLCPGWVGIGQAWFWAIAPHLTSPRSPDPRDISPGTTLWSTIKAGSFTLQHFLISSL

SEQ ID NO: 112858 - protein, 212 aa, Glycine max
  Coding DNA Sequence Number=SeqID_21173
  Gene Ontology: Cellular component=mitochondrion
  Homolog annotation: Hit_ID=Q5M9S2; Match level="QueryCoverage=33%, HitCoverage=89%, E-value=1e-26, Identity=68%"; Hit description =Putative uncharacterized protein orf109c
  Subcellular localization annotation: CTP_CleavageSite=67; ConfidenceScore=5.87e-01
GKSLPFPSNDPAPPGSSTVLAPFPTYAMLPRHRPTTLRACGVFAGRSLPVVPSSPLAVRVTRSAVPRCEVQVVMITPGYALAPLTGTPGPANAHENPGRKGIASGIGADSASAASCRTGVIQYVVPHVPPLLRSFPILIVKHHEQQDVEIARHNVLCDTGIDFFNFRKVNGKPPFPLLTILPNLLKNEWHFEVPHVGGSAWGTSTGSGLEPA

SEQ ID NO: 112859 - protein, 327 aa, Glycine max
  Coding DNA Sequence Number=SeqID_21174
MAKFDPEIVLEFYANAWPTEEGVRDMRSWVRGQWIPFDVDAIGQLLGYPLVLEEGQDCEYGQRRNRSDGFDEEAIAQLLCIPGQDFARTVAGRRVQIMRTNMTTLTQIWMTLLLSNILPTDHNSDLPLPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPLIRLARLGHLTWSSIYSIWFANRRPTTGHMYRPMISQGFASFSCPTPDHFRAEVAWPGDWPEAQAGEAPPEAPGDGEEAHEDEEMADLLDFLGGSGAT

SEQ ID NO: 112860 - protein, 71 aa, Glycine max
  Coding DNA Sequence Number=SeqID_21175
MGEVEEVQELIEADMEAMKEQMVTMMEAMMSMKKIMEANAVAVATTSVVAKVGPDVPIRHQPNESSNLRLW

SEQ ID NO: 112861 - protein, 189 aa, Glycine max
  Coding DNA Sequence Number=SeqID_21176
MPHQENHDYEGAKTFLVAKDEATTSPSSSKSEEAKGEESSEEIYPQEEGQPLMVKEECKEETLNQEQNHILRTKEKLERKEKGKERIKINQDEREQIREEERRKILKELRKEKYASYSSLNSCKSLSEELRDYYEVRHRSHLRPHSHRREIERKPQEANINLPYFHGKDNVEANLDWEIRVKQQLKATP

SEQ ID NO: 112862 - protein, 222 aa, Glycine max
  Coding DNA Sequence Number=SeqID_21177
MMITKDDDKGDDKKLKDQSKNNSSESKINQSTTQVNQEEFKTQEESLESRIKIQGSRSQESRFKVQDLKNQDQDSRLKIQESRDGSIKIRYILCGTSRGYIYLGLTENKRGYISYGSVLVEGTSTRFKENKGGPLDPTPTTNHPTTPSSCQQLLQTPPLLGQASSDEAVMFKLKTFVKKMLRELGNYPSGSIVDEFGATILARICVFHSLDLVFLEEGEKNI

SEQ ID NO: 112863 - protein, 149 aa, Glycine max
  Coding DNA Sequence Number=SeqID_21178
  Homolog annotation: Hit_ID=A5AWV0; Match level="QueryCoverage=56%, HitCoverage=5%, E-value=3e-09, Identity=38%"; Hit description =Putative uncharacterized protein
MKNWMQNSKRDVYLGVYLNGAHWQMVVILPKENLIVWFCSLHNRPDNYLKGIINSALKGLDDTPQPKSKVGARWIIVKCNRQKGSTECGYYVMHWMSTIILGSFKNNWEMYFNDVRPLESEILRRFASCGQIIQANQLKIIEGYKDLDI

SEQ ID NO: 112864 - protein, 99 aa, Glycine max
  Coding DNA Sequence Number=SeqID_21179
IKTSRSYGITKTSKAKSLLLQTLKISSGEEADVPEESEEVQALKAEFERTRVVKEKFKIKATKVRKEYDELRDVNMATAEALERETKRARKEEWGWNKF

SEQ ID NO: 112865 - protein, 88 aa, Glycine max
  Coding DNA Sequence Number=SeqID_21180
MSLHVLYLYAFSGFPPGISRLLYLSLQSFKEMNGQDHLELPSGVRTKCGQQKPIKVLRNGCKWGWGHDRPIVAPSLRETSRERRCKAA

SEQ ID NO: 112866 - protein, 229 aa, Glycine max
  Coding DNA Sequence Number=SeqID_21181
  Homolog annotation: Hit_ID=A0ST23; Match level="QueryCoverage=10%, HitCoverage=51%, E-value=8e-07, Identity=100%"; Hit description =Putative reverse transcriptase
  Pfam annotation: Domain name=Ins_element1; Domain location=3-83; Score=-17.6; E_value=0.0066; Accession=PF03811.4; Description =Insertion element protein
  Subcellular localization annotation: CTP_CleavageSite=38; ConfidenceScore=5.37e-01
APVASVSISCPSCSATDGVVRYGKKHRRTSALASVAVHAARRVPFAIQAAQLLGRAIGAGLFAITPAGERGMCCKAIKLGNARVFPVTTLANWSSTAVAAALELVDPPGCRNSILVITPKGHGANTLRAIFHTVMHEYHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 112867 - protein, 154 aa, Glycine max
  Coding DNA Sequence Number=SeqID_21182
MSGFTCDSPQISASPHQLDLAPYASGPYNAQWNAPGLLHDKHTLRSSRILGEMEVDEPWLGLWLPLNYQVDMGASGVCHRKCGRLALWLILGMAFVNNWAVGKEKNGSHSTGFYFILTFFICPSFLIRPSRMTKFSFFRPTSILSLAKTKSAKL

SEQ ID NO: 112868 - protein, 143 aa, Glycine max
  Coding DNA Sequence Number=SeqID_21183
MTKKEIITIIVDMLPVFNYEKMVGYMPSNFAYLVFTGERIEVGLRRGKFDYPALMGEKVGANREDEKEEGTHVVTVVPTWPNFPPTQQCHYSANISPSHYPPPNQPQRSSPNQPQCRPAAHPMPNTALNTNQNTNQGGNFLVK

SEQ ID NO: 112869 - protein, 141 aa, Glycine max
  Coding DNA Sequence Number=SeqID_21184
MHYVLCRILLPRSTNLAQASEEDLILLWALQTGRQIGWAHLVRYRMHKALWAKAALPYPHLVTLFLQHFNTPLDDEPFVKVKRSFAIGVGVVTSFGYRKDMDGQWVHKQDLPPPIPDERRRSPPPQRDTSYSLLTDVLTKV

SEQ ID NO: 112870 - protein, 120 aa, Glycine max
  Coding DNA Sequence Number=SeqID_21185
MTLLLSNILLSDRNANLSLQKYQLVCVVLTWGSHPQRHPVDLKKSNRALGFPALVTGLCRPYRAPVSPSKFMSPWHRECLSPPARSSGPPTNRAFIKKYCAPRQAQGETPHQHWDGRSGQ

SEQ ID NO: 112871 - protein, 105 aa, Glycine max
  Coding DNA Sequence Number=SeqID_21186
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=92%, HitCoverage=10%, E-value=6e-11, Identity=38%"; Hit description =Gag/pol polyprotein, 3'-partial, putative
  Pfam annotation: Domain name=G-patch; Domain location=38-82; Score =25.9; E_value=0.00014; Accession=PF01585.14; Description=G-patch domain
MPYVEAVEESLEMTFQSFEVVSIASVDSLSRQPRLSDAAMMVARVMLGHGYEPRMGLGKNNDGRTSLVSTRGNRGKFGLGYKPMQADIRKNISKRKNKGQGSRLG

SEQ ID NO: 112872 - protein, 110 aa, Glycine max
  Coding DNA Sequence Number=SeqID_21187
MAPKKLSTKRSRRDATAEGSSVAPEFDSHRFQSAEHQQRFEAIRGWSFHRERRVQLRKDEYTYFQEEIARRRWMPLVTPMAKFDPEIVLEFYANAWPIEEGMRDMCSWMR

SEQ ID NO: 112873 - protein, 254 aa, Glycine max
  Coding DNA Sequence Number=SeqID_21188
  Homolog annotation: Hit_ID=UPI000166002E; Match level="QueryCoverage =40%, HitCoverage=87%, E-value=1e-08, Identity=34%"; Hit description =Excl1 protein
  Pfam annotation: Domain name=MerR; Domain location=5-41; Score=33.6; E_value=7.2e-07; Accession=PF00376.14; Description=MerR family regulatory protein
MAVHTVTEAAKLAGVTRRTIYRYIKQGKLSAVVTGSDTTQIETSELLRVFGALSQSEGSQVSTGSQVEEPEYVTRLMAEMSQIRDLVQGQQQLLLEDKLEAERLREQMTGLQNERDAAAQELEKVKAELEAERKKGFWKIVMKVVILLGAFVLSMLSINALSAENPKDPWYEVSSNAAGDAKILAKVDTVKKDEVGVSVLIQYLVKDLPGGAFSVKYYQMSISKKACDDGYGEVLFSPVSKKKQDEFSSEYVEG

SEQ ID NO: 112874 - protein, 182 aa, Glycine max
  Coding DNA Sequence Number=SeqID_21189
MQFKDTVDSMQQAFKRAETQIGKLVDDMTKVIVKREEEYAEIETHQESILQVNTIHHQLITEEEKDEVSIIPEYPCMATTGYVVRKDKGQLELNVEDQKIPFDLFKAMKHPNMGDACFEEEEVEQEIALSASTMVLQFPFEKEPNYVADYLVCAEELDDPKDNSIGHVVLEELDQQKSSKQN

SEQ ID NO: 112875 - protein, 115 aa, Glycine max
  Coding DNA Sequence Number=SeqID_21190
MRMWGLPSELERMVAHEDQEMGPHQEETELVDLGFGSGKREVKIAPITSKTRVFPGKAETEKDEARNVLEDKEEVKKQFDAGFLAVGAVGRNGLPTLYQSLRKMGKCECVWIIVT

SEQ ID NO: 112876 - protein, 49 aa, Glycine max
  Coding DNA Sequence Number=SeqID_21191
MGLKIHPKVHENPKAFFISSSPILLEPVAHDSGTWGKETSSNNSTNFLM

SEQ ID NO: 112877 - protein, 103 aa, Glycine max
  Coding DNA Sequence Number=SeqID_21192
  Homolog annotation: Hit_ID=A5AV98; Match level="QueryCoverage=95%, HitCoverage=10%, E-value=5e-09, Identity=36%"; Hit description =Putative uncharacterized protein
  Pfam annotation: Domain name=zf-CCHC; Domain location=72-89; Score =8.1; E_value=0.092; Accession=PF00098.14; Description=Zinc knuckle
MKDKWDVYELHNILVQEETKLKNQGSHLVHYVGHQGNQGVGKKFVNKHDKGKGSLQINDGPMQIQKKASKSNNFHFYGKSGHFQKDCPKCNSWINKKGELNAL

SEQ ID NO: 112878 - protein, 128 aa, Glycine max
  Coding DNA Sequence Number=SeqID_21193
MGIAPTKTPSELEEVPTGPWGFPALVTGLYQSYGVPVPPRQGHVIIGKYAHRSLISDFIYCLQGSRLQDTSGPRRSPTGSWNCQALITGLCQFYGVPVTSSKGIRPPTNRAFIKKYCAPKRAQGETPQ

SEQ ID NO: 112879 - protein, 87 aa, Glycine max
  Coding DNA Sequence Number=SeqID_21194
METISKRFKEFDVCGKVTLKSKLREISCPDVKLILQSSIVCHYLNNQNQEGPYRCWINFIHAFMIPLKTLLMSNLMVTVDIVQLLPY

SEQ ID NO: 112880 - protein, 132 aa, Glycine max
  Coding DNA Sequence Number=SeqID_21195
MKNAYLYLFCKRIEKPRCYHFAAIKHDWSAPMEIKDESQDSIQDFIGLYEKRIGIIHGTHGGTSKNRRIGEEVLERDQRKRHKLFMKSNSDFEGKISLDKAGSSEDEFGFLYLFSCLLLMYHGAAYMKTISW

SEQ ID NO: 112881 - protein, 150 aa, Glycine max
  Coding DNA Sequence Number=SeqID_21196
  Homolog annotation: Hit_ID=A5APK5; Match level="QueryCoverage=44%, HitCoverage=5%, E-value=4e-27, Identity=91%"; Hit description =Putative uncharacterized protein
  Subcellular localization annotation: CTP_CleavageSite=35; ConfidenceScore=5.14e-01
MPHSPGTTTQLSGARSTTELIARRAGLPPGPAMPKARETPSLSFLFSPPSMSPPCGDMDGGEKTLALPEKEVIQPHLPVRLPCYDFTPVTSPAFGIPLLAVKVTTSGMASSHSVTGGVYKARERIHRRMADRRLLAIPASCRRVAAYNPN

SEQ ID NO: 112882 - protein, 261 aa, Glycine max
  Coding DNA Sequence Number=SeqID_21197
MVHTSTRNIIRASQLALGTPPIHHPYSLERPPPSPAPTTTHPAGNAHFGVGSNAMRNFPPMPIPEFTPIPMTYEDLCVPHSQPNGRNNSWEDLPTSFPKVDRPNVKTNPLANHGGGAVNAVESDRPRRSKPLKDVATPRSELHNMEICLAVEDLLQQMIDQGRLEVDDEGREEQHICMQSADEGSFGRPKPLVVYFTKDAAPQKPRYPSIVKLVPFPYRNSHAVPWRYAPPSERKEEATNISSLSAKVTNIMGLSGVTHSG

SEQ ID NO: 112883 - protein, 96 aa, Glycine max
  Coding DNA Sequence Number=SeqID_21198
  Subcellular localization annotation: CTP_CleavageSite=53; ConfidenceScore=5.26e-01
MVFFEVLQWVLFLSAVPPVQPLTGVVRNGKKHRRTSALAKCSGHAARNHHTRRALMRRYRARPIRHSGCATVGKGDRCGPLRYYASWRKGDVLQGD

SEQ ID NO: 112884 - protein, 47 aa, Glycine max
  Coding DNA Sequence Number=SeqID_21199
MDMDMGPTPGGRPDISSGNTYGNSLTTGRSHIETFVSTSRLDKIMYT

SEQ ID NO: 112885 - protein, 409 aa, Glycine max
  Coding DNA Sequence Number=SeqID_21200
  Gene Ontology: Mol. function=binding; Cellular component=nucleus
  Homolog annotation: Hit_ID=A7PRR3; Match level="QueryCoverage=90%, HitCoverage=39%, E-value=1e-120, Identity=58%"; Hit description =Chromosome chr14 scaffold_27, whole genome shotgun sequence
YLGQHNKRHSHAPSVSASASITALLEKLRRNRNTKAENHVNIVHDQERDIVAEDWKQGCGLKNSPNFYKLTSIIDKATGSPSLTDTEPYVMKLTEDQMAQLLSAFWIQANLPDNLPSNIEAVAHSFILTLIVLHIKNLKDRDSLVIRFFQFPLSLWTMLLDQSNGILSPACQRSVYVLSAGMLAFACKIYQIHDLNDVFASLPMSDVDPFLSISDDYRVYAKIHVDVREYGTAADNQLACSVLSELQNKRRELAMLLSEKFKPDEEFVFGPQSMLDQNQIIFHSQESLSFDGDFPSNSAGEDDTISEASVSDLSRFIPKMPLSPSAPHVISIGQLMESALEVVGQVAGTAISTSPLSYNTMASQCESLGTCARKKLSNWLAFENHYSQAPDDKSFLAIADIRNSAPVKV

SEQ ID NO: 112886 - protein, 47 aa, Glycine max
  Coding DNA Sequence Number=SeqID_21201
MKGSFTVVLFKANDIRKIWDEVFSGEATPIEYAEILDNLQSKFGLGQ

SEQ ID NO: 112887 - protein, 39 aa, Glycine max
  Coding DNA Sequence Number=SeqID_21202
MRTSKCENRYLKALGPPIELKKGFLISMSRLVPFSRLAQ

SEQ ID NO: 112888 - protein, 95 aa, Glycine max
  Coding DNA Sequence Number=SeqID_21203
MVHSWEEEEADRAKASSFRPLFPNPTKPTTPFSSPDTRRQSKSPPLFILWEDIAFLVDFPHCTVPLMLRSEAGIETNQTIGYLSCDLSSTPARYR

SEQ ID NO: 112889 - protein, 124 aa, Glycine max
  Coding DNA Sequence Number=SeqID_21204
MVRRDKIWSFYTLCHPEAAGPMTRGDKIWSFRTPFAIQTQSCPMARRDKIWSFCTLCHPEAAGPMTRGDKIWSFRTPLPFRHSRVRWHAETKFGHSAPFCHPEAAGPMTRGDLHHLPHSQDLSY

SEQ ID NO: 112890 - protein, 272 aa, Glycine max
  Coding DNA Sequence Number=SeqID_21205
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVIFRHRCSQWLLFLSAVPPVQLLTGWCVTAKAPPDISAGKCSGRVPFAIQAAQLLGRAIGAGLFAITPAGERGMCCKAIKLGIRSKTTMSSIFYISETSMSSVIYALQDINVIGHLHFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112891 - protein, 204 aa, Glycine max
  Coding DNA Sequence Number=SeqID_21206
MSALKEQMASMMEAMLGMRQFMEKNVATAAAVSSVAEADPTLLATAHHPPPNTLGRERNTLGHSNNPHLGYNRVVYPYGLPPNYTPPVMHDDAGHVSSPILEGEPPRQPDEVHEDHQEYAQEDVDSYPLIPVEGPAPNTLPQHNLTAQPIFLSTEGPPPTAEERRKLDLIKERLRAVKGFDDYPFTDMTDLCLVPDVIIPPNFK

SEQ ID NO: 112892 - protein, 61 aa, Glycine max
  Coding DNA Sequence Number=SeqID_21207
MKELSLEGSEPSLMHWYRVRRGHGDNLVISAVGSQGLLEKGSGKIVLGSMHEGCVLMICGK

SEQ ID NO: 112893 - protein, 134 aa, Glycine max
  Coding DNA Sequence Number=SeqID_21208
VMLDATMLGVFNQDFPLYIKHEDLSEIAHSGQCLSISVIQLWILHLTETSIRAGNSDVYGFLEPQSIQRSGQPVQNAMSTLEPSGHWQMVVILPKENLVVWFCSLHNRPDNYLKGIISSALKGLDDTPQPKSKA

SEQ ID NO: 112894 - protein, 91 aa, Glycine max
  Coding DNA Sequence Number=SeqID_21209
MSLEKECLSLYSLLLVGHVSNARRTNKVSLDLYKEGFMPNYYWWTNHGEELPQFPPIVLQGSYYESGGQREELNPCEKMIMDHADHQLTNT

SEQ ID NO: 112895 - protein, 121 aa, Glycine max
  Coding DNA Sequence Number=SeqID_21210
MVMGDFINRLSFPACLHFSGENTETFSSLTSYPELRRSEFLFDGGYVGARASLLSTTPLSVTMTQELVACGDTLRLSTPRHSVTPSVIDEQRPMWSSAPFPEMSASSGGDFFKSHKLSRTT

SEQ ID NO: 112896 - protein, 138 aa, Glycine max
  Coding DNA Sequence Number=SeqID_21211
MELIENMVASDHAVLHDRTHIPTKRSLLELSSQDALLAQNKLLAKQLETLIETLSKLPRLLQVAQPSHSAVMQATNKEETSIKIKDKGGDHIQVTMSNHKSTESAIKNLEIQVGHLAKQIAENSSGGFGANTKKNPKE

SEQ ID NO: 112897 - protein, 226 aa, Glycine max
  Coding DNA Sequence Number=SeqID_21212
  Homolog annotation: Hit_ID=Q6WAY4; Match level="QueryCoverage=91%, HitCoverage=36%, E-value=1e-27, Identity=38%"; Hit description =Putative uncharacterized protein
MGTNQNGKRFYQVKVKGLDVTSLKELGRLMGPLQRKAFCKVYGKILDLITAEVFTEAVVSLAQYYDQPLRCFTFGDFQMVPTIEEFEEILGCPLGGRKPYLFSGFLPSLSKIAAMVRDSAKELDRMKQTRNGVVGLPRKYLEGKARDMASQEKWGPFADILALLIYGVVLFPNVDGLVDLAAIDAFLAYHHSKESPVVAILADLFDTFDRRCEKNSARVVCCLPAL

SEQ ID NO: 112898 - protein, 82 aa, Glycine max
  Coding DNA Sequence Number=SeqID_21213
MRVPRKEYAWSRHQRLFEENVEKTGKDAIYELLSERLGSCIYARGRVFPFCRNLPFGGRATRDSRDACSTKGIRAESPPTFI

SEQ ID NO: 112899 - protein, 264 aa, Glycine max
  Coding DNA Sequence Number=SeqID_21214
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112900 - protein, 98 aa, Glycine max
  Coding DNA Sequence Number=SeqID_21215
MEVNVAAIVAISTIAEGEPNLPIWPQPNKSSNLRYGDEDKARNKGKEPLEGLGGPMARARTKKAKEALQKVLTMLFEFRPKLQVEKLRIVNCTMFQEE

SEQ ID NO: 112901 - protein, 139 aa, Glycine max
  Coding DNA Sequence Number=SeqID_21216
MERGHGMYTRQQHFPNILHRCISILLQVIIRDSSETSHSFGGVAETQPHFSWPTMTPSQQHDAPMATPNAPFAPQWNVPGAIPDMGDLLGVDLRQQFSAEAEQAEAGRQRGGRRNPDRQARRWDRPCGTSSRHHGHHND

SEQ ID NO: 112902 - protein, 191 aa, Glycine max
  Coding DNA Sequence Number=SeqID_21217
  Gene Ontology: Mol. function=sugar:hydrogen symporter activity; Cellular component=integral to membrane; Biological process =carbohydrate transport
  Homolog annotation: Hit_ID=Q2UD78; Match level="QueryCoverage=100%, HitCoverage=37%, E-value=1e-104, Identity=100%"; Hit description =Predicted transporter
MATSFELAQFIVARLVLGVGTGGYVATVPVWQAEISQAKKRGAHVVTDGIFIGAGIAISLWIDFGFYFVKGNSVSWRFPLAFQVVLSVIVMLFITVFPESPRWLVKRGRVEEAREILAALADQDPHSEDINMALADIERSLALSGSGSWKDMLTMGEQRLFHRTVLAATGQMFQQMCGINLITFYATTIFE

SEQ ID NO: 112903 - protein, 114 aa, Glycine max
  Coding DNA Sequence Number=SeqID_21218
RKKSKNIAILQQLPYASVVAGLRPAETIDSQAEKAIDGRIGTGTRAILGPTKPCHEQSTQQEQGIFKLRLIPSIALPSSNRLNCIVYSPAKLAADSTSPRVYALFVLASAIERE

SEQ ID NO: 112904 - protein, 114 aa, Glycine max
  Coding DNA Sequence Number=SeqID_21219
MLESFKQQDQMSVLELYIKKDVAGGSMFHYANSLTSCGNYLSNDETQPTTNLSNLHIDEDDDDDDDDDDDDDYLVSNSYVEKSLDEDDSLDGISDTDDEVIDIPQPVRIVHPAE

SEQ ID NO: 112905 - protein, 203 aa, Glycine max
  Coding DNA Sequence Number=SeqID_21220
  Gene Ontology: Mol. function=motor activity; Cellular component=cell projection
  Homolog annotation: Hit_ID=UPI00016621D1; Match level="QueryCoverage =87%, HitCoverage=40%, E-value=5e-20, Identity=35%"; Hit description =UPI00016621D1 related cluster
MTSPLNESISCFLINVDPWVLEPIAFRGLHVLAFKGLHALTFRGLHALAFRGLHVLAFRGLHVLAFRGLHVLTFRGLHALTIRGLHVLAFVGLQALTFRGLHVLTFKGLHALNFRGLHALAFRGLHVLAFRRLHVLTFRGQHVLAFRGLRVLAFRRLHTLTFRGLHALTFKGLHVLTIRGLHALAFRRLHVLAVRELHVLASK

SEQ ID NO: 112906 - protein, 200 aa, Glycine max
  Coding DNA Sequence Number=SeqID_21221
TVENLRVITDGNVTEAPQLGFSSRKQFSSANLREYEGPRRLTPSLFTPPLIYSKIGEELAAQLAKASSARPGEQGCFLQKQQPSGGRIWKAQLSKKLRKLTDCEKHLILISVTLRNFHGSRRCHALVVSAVTLTAVSWKVVVRQFEASDTLRLGSGPLICAISELGYLRRKQPSPPGRAGRQPPPPFPINRRREAVPKGP

SEQ ID NO: 112907 - protein, 47 aa, Glycine max
  Coding DNA Sequence Number=SeqID_21222
MDEVEALGLTLVMKVQEIEVHQKIQAWISEPIECFEEEQHQGMKIEL

SEQ ID NO: 112908 - protein, 54 aa, Glycine max
  Coding DNA Sequence Number=SeqID_21223
MERNTLIRAESSKTNLRIQSESRALDPLFTVSLRRMDMNVRDLKTTSRGTNKRI

SEQ ID NO: 112909 - protein, 240 aa, Glycine max
  Coding DNA Sequence Number=SeqID_21224
  Pfam annotation: Domain name=zf-CCHC; Domain location=82-99; Score =22.6; E_value=0.00058; Accession=PF00098.14; Description=Zinc knuckle
MKEDIGHILDLTLIGEKRKESLKRSNNLKGSLLQNLWSHSYPKKDQGQGILGVTPSKPKGDKGKTIENQAPKASMQEKTSSIKCFKCLGRGHITSQCPTTKTMIMRSQYIYSSQDEATTSPSSSESEEAKREESSEEIYPQEEGQPLMVMEECKEVSVSSKRLVKKESHFEIKTNIKETSPLRQPPHLLRCKKTFVSTATPLGLEVIPQVKELLDEGLVRKSLNPCALLVPKIVMHPTSS

SEQ ID NO: 112910 - protein, 162 aa, Glycine max
  Coding DNA Sequence Number=SeqID_21225
  Gene Ontology: Mol. function=catalytic activity; Biological process =metabolic process
  Homolog annotation: Hit_ID=A6EHE2; Match level="QueryCoverage=98%, HitCoverage=53%, E-value=3e-73, Identity=85%"; Hit description =Methylisocitrate lyase
MVDRLKAAVDARTDENFVIGARTDAFANKGLEKTLERAVAYKEAGADFIFAEAVPDLSYYQKFVDATGIPVLANITEFGMIKMYTADELKDAGVGLILYPLSAFRAANKAALNVYEHIRKDGTQAHVIDTMQTREELYKSIGYHDYEQKLDNLFKQNKNVNE

SEQ ID NO: 112911 - protein, 109 aa, Glycine max
  Coding DNA Sequence Number=SeqID_21226
MKNFHRIAYGKVTEALRLDFSSRKRVFLPKIAEMHTLGVMNILKQPPSPIYREKGRCLPPRGFLKKISKRTPITKFTPFFVLYGKKHYGSHESPFFKNVEELAAQLLPP

SEQ ID NO: 112912 - protein, 89 aa, Glycine max
  Coding DNA Sequence Number=SeqID_21227
  Subcellular localization annotation: CTP_CleavageSite=40; ConfidenceScore=5.07e-01
MHEGMHMTQMQSRNAGVRGIVSFLDTTSRGSKRGSRQNPYAMHMQKTQYGNVHSMTYSLNISKGYMIVMHGSVKNGTQRVCSCPYLRDL

SEQ ID NO: 112913 - protein, 161 aa, Glycine max
  Coding DNA Sequence Number=SeqID_21228
LVILHPVSSRGGGPMTSRDKFGHSAPLYHPEAAGPMIRGDTLRGGGPDDTRRYLTVIRTLLSSRGGGPDDKQRPKTKFGHSAPLYHPEAAGPMIRGDTLRLFAPFCHPEAAGPMTSRDQVWSFCTLVSSRGGGPDDTRRYLTVIRTLLSSRGGGPDDKQRP

SEQ ID NO: 112914 - protein, 59 aa, Glycine max
  Coding DNA Sequence Number=SeqID_21229
MCACHGEAPGRSIEHCRALKRKVRGFSTFTRSGCKPLVSLLKRPMLLSLGLPTPLVGVP

SEQ ID NO: 112915 - protein, 23 aa, Glycine max
  Coding DNA Sequence Number=SeqID_21230
MLKFHKDPTVNESKIVIFLRQGY

SEQ ID NO: 112916 - protein, 95 aa, Glycine max
  Coding DNA Sequence Number=SeqID_21231
MGEVDEVQERIKADFEAMKEKMATMMEAMMSMKKIMKVNAAAVAATSVVAEVDLTPPFGLNQINHLISDMVGQRGKELGNTGVGSSGLRIIKKGG

SEQ ID NO: 112917 - protein, 152 aa, Glycine max
  Coding DNA Sequence Number=SeqID_21232
MMREERRKDFCCTPALTYGWSLTSFVMKVDPSVPCKVTEKEKANWEQLLASMVGASVNWRAVGRKYHALHRTGFSDPNARIFQRVRKAWSMVQRKDNELRGSSNEIVGGYHKWLKARMQELDWLPKLKVSSEEEAETPKESEEVQALNAKLE

SEQ ID NO: 112918 - protein, 88 aa, Glycine max
  Coding DNA Sequence Number=SeqID_21233
  Gene Ontology: Biological process=transposition, DNA-mediated
  Homolog annotation: Hit_ID=Q1J7G7; Match level="QueryCoverage=34%, HitCoverage=42%, E-value=2e-10, Identity=100%"; Hit description =Transposase
MVKVGTSYVPINVSFSPKVGPGLPGYQQGHQDLFILRSDLPSQWLLFLSAVPPVQLLTGWCVTAKAPPDISAGKCSGHAARNHHTRRA

SEQ ID NO: 112919 - protein, 75 aa, Glycine max
  Coding DNA Sequence Number=SeqID_21234
MTRGLNLKFEQVYRSEKWRERSSQTLRSVGLRGKYTWFECSFKSILIPYGWNILAKQSDLTGLPMILPSESDLTC

SEQ ID NO: 112920 - protein, 169 aa, Glycine max
  Coding DNA Sequence Number=SeqID_21235
MKADIEAMKDQITTMMEAMMSMRKMMKVNAVTIATTSTATDVDPTHPSGINQVNHPVLDMVGHGGEALGSTGGPYFVQIQSKHPFPPYGLPPNYAPPNVAHAPDENVDNSALIPIESQQSQSGHAHASQPMGETHEVPRDHTLADFEPHLGYATEGQTFGGVPCKHLGG

SEQ ID NO: 112921 - protein, 77 aa, Glycine max
  Coding DNA Sequence Number=SeqID_21236
VGSVFSCELNRSCDEDMTKSKGKDPLEGLGGPMTRARARKAKEADENHETSQIQSKGPSGEGRRPKWRRTKPPSGEG

SEQ ID NO: 112922 - protein, 69 aa, Glycine max
  Coding DNA Sequence Number=SeqID_21237
MCSPSEDYTSSPSEGNTPSPSEDFTSSPSEDYTSSPSEDYTSLPSKDYTSLPSEGFTPLPLEGCTPSPS

SEQ ID NO: 112923 - protein, 71 aa, Glycine max
  Coding DNA Sequence Number=SeqID_21238
MGAKHLTRTKQKLHVIKQRSPDEIRFYGVSVAPSKVIRPLLTGLSSTSIVPLGRRRARHHISGQQMHRRHL

SEQ ID NO: 112924 - protein, 145 aa, Glycine max
  Coding DNA Sequence Number=SeqID_21239
MFIRDNHSGISARQRDSKVSMTDLVSAEDDVNLRVSTGLSAAIDEGRRRRHSKKNVYTDNHSGISARQHDSKVSMTDLIAKKNVYTDNHSGISARQRDSKVSMTDLVSAEDDVNLRVSTGLSAAIDEGAEDDVSLCVLSGFSSYI

SEQ ID NO: 112925 - protein, 477 aa, Glycine max
  Coding DNA Sequence Number=SeqID_21240
  Gene Ontology: Mol. function=DNA-directed RNA polymerase activity; Cellular component=alpha DNA polymerase:primase complex; Biological process=DNA replication, synthesis of RNA primer
  Homolog annotation: Hit_ID=A7NXV1; Match level="QueryCoverage=94%, HitCoverage=99%, E-value=0.0, Identity=73%"; Hit description =Chromosome chr5 scaffold_2, whole genome shotgun sequence
  Pfam annotation: Domain name=DNA_primase_lrg; Domain location=174 -439; Score=406.2; E_value=5e-119; Accession=PF04104.5; Description =Eukaryotic-type DNA primase, large subunit
MEIVRPQNRRNSFSSSNDAVSAPTIPLYRSAPPLEVRLEDFESFAIDRLRVLKGISDGMSRGKKSEEMENLDLWKMNMRHQDASQVLNKDIISHFVLRLVYCRTEDLRKWFLSTESALFRYRFRLLNAEAQRAVMEEFDLPYKAVSNVEFESIKEKLGQVARSMGQPSPTADAIFYKVPFEEVPELVAGRKVFINQGYAYVAMNQSTVKGTNPYKQILRVSSNCCRKWTSSVREQEKHRLTPIVEALSSSYLGPDYSQSKEYADISLKDIDQVAKSSFPLCMRHLFDKLKEDHHLKHGGRMQLGLFLKGVGINLDDALAFWRSEFSKKVGLEKFEKQYAYNIRHNYGKEGKRTDYTPYSCQKIISSTPGAGDHHGCPYRNFSEENLRAALSRMGVNSWAMEDVMDKVKNRHYQLACTLTFEALHGMTCDAGINHPNQYFSDSQKILKPKVDPHDTVDNITKVILFFADAGFADLNTL

SEQ ID NO: 112926 - protein, 513 aa, Glycine max
  Coding DNA Sequence Number=SeqID_21241
  Gene Ontology: Mol. function=transferase activity; Cellular component= membrane; Biological process=megagametogenesis
  Homolog annotation: Hit_ID=A7QP83; Match level="QueryCoverage=87%, HitCoverage=94%, E-value=1e-154, Identity=61%"; Hit description =Chromosome chr1 scaffold_136, whole genome shotgun sequence
  Pfam annotation: Domain name=Exostosin; Domain location=99-461; Score= 299.0; E_value=9.3e-87; Accession=PF03016.6; Description=Exostosin family
MIAELRKQLETEAAEEEDNVQASIKLSLLFPKIFQKTKQEEEKTAMYGKVVLSFIFVLLLVFSYSIFIGTLDIRSYFFPRLKLPAAAPAPCAPEPPLRVFMYDLPRRFNVGMIDRRSASETPVTVEDWPAWPVNWGLKKQHSVEYWMMGSLLNAGEGREAVRVSDPELAQAFFVPFFSSLSFNTHGHTMKDPATQIDRQLQMLKIIRNLMNANVHTSLEGYGSASYLMRREKYLQGACFWCQVDLMELLKKSKYWQRSGGRDHVFPMTHPNAFRFLRGQLNESIQVVVDFGRYPRGMSNLNKDVVSPYVHVVDSFTDDEPQDPYESRSTLLFFRGRTYRKDEGIVRVKLAKILAGYDDVHYERSVATEENIKASSKGMRSSKFCLHPAGDTPSSCRLFDAIVSHCVPVIVSDQIELPFEDDIDYSQFSVFFSFKEALQPGYMIDQLRKFPKEKWTEMWRQLKSISHHYEFEYPPKREDAVDMLWRQAKHKLPGVKLSVHRNRRLKIPDWWQRR

SEQ ID NO: 112927 - protein, 126 aa, Glycine max
  Coding DNA Sequence Number=SeqID_21242
SRRRRNRSRGSHFEPQGETLREQKGGENRAVAFQEKPTKRTAEARRDSGAGTAARGLHAPEDARDGGGAWLLRCRRELAGWLALPKASLTLASPEKWPLESGGGGGRRRRRRRATTDDTCSDANLK

SEQ ID NO: 112928 - protein, 44 aa, Glycine max
  Coding DNA Sequence Number=SeqID_21243
MRSKLEGDEEEEEEEEEEEEEEEEEEEEEEEEEEEDMERQFYFG

SEQ ID NO: 112929 - protein, 360 aa, Glycine max
  Coding DNA Sequence Number=SeqID_21244
  Gene Ontology: Cellular component=integral to membrane; Biological process=peroxisome organization and biogenesis
  Homolog annotation: Hit_ID=A7QBQ6; Match level="QueryCoverage=88%, HitCoverage=72%, E-value=1e-138, Identity=73%"; Hit description =Chromosome chr1 scaffold_75, whole genome shotgun sequence
  Pfam annotation: Domain name=Aa_trans; Domain location=26-341; Score =251.2; E_value=2.2e-72; Accession=PF01490.9; Description =Transmembrane amino acid transporter protein
  Pfam annotation: Domain name=Trp_Tyr_perm; Domain location=26-322; Score=-273.8; E_value=0.04; Accession=PF03222.4; Description =Tryptophantyrosine permease family
  Pfam module annotation: Pfam domain module=Aa_trans::Trp_Tyr_perm; Domain location=26-341::26-322
METETENANDADIKAINDWLPVTASRNAKWWYSAFHNITAMVGAGVLTLPYAMSMMGWGPGTVILLLSWMITLFTLWQMVEMHEMVPGVRFDRYHELGQHAFGEKLGLYIVIPQQLLVQVGTCIVYMVTGGTSLKKFHDTVCPSCQNIRTSYWIAIFGFVNFVLSLCPNFNSISAVSFAAAVMSIAYSTIAWVASIGKGKLPDVDYGYKAHSTADGVFNFMLALGEVAFSYAGHNVVLEIQATIPSTPEKPSKKAMWKGVIFAYLGVAFCYLPVAFIGYYIFGNSVQDNILITLEKPTWLIAAANMFVIVHVIGGYQVADVWADDCGGQDGAISLDYGLVFGGEINVEGEEGRGKVDSEY

SEQ ID NO: 112930 - protein, 336 aa, Glycine max
  Coding DNA Sequence Number=SeqID_21245
  Gene Ontology: Mol. function=ATPase activity, coupled to transmembrane movement of substances; Cellular component=integral to membrane; Biological process=transport
  Homolog annotation: Hit_ID=A7QBT3; Match level="QueryCoverage=39%, HitCoverage=9%, E-value=3e-44, Identity=61%"; Hit description =Chromosome chr1 scaffold_75, whole genome shotgun sequence
  Pfam annotation: Domain name=ABC_tran; Domain location=218-336; Score= -61.4; E_value=0.083; Accession=PF00005.18; Description=ABC transporter
MSLDSVSVALTLWLVLFKEDQSEGKQKVSAIPYFMVLEVYPTGTLGTRGHGHSTDEEERKMIWNNCYSRKRCNLPWRGLHNTNIYTTMKKYEHLLQKFFKKAFESGRGLLPHNSQGISQNGRDLKGTNLASLLRINSGLLQFWQLGMVVCPNQFPLQYGLVFCSCAIFVTLPRSTIQDCRPEPEWPKEGKVELHNLHIQNDPAAPMVLKDVTCIFPGQKKIGIVDRTGNGKSTLVQALFQVVDPYERCILIDGVDISKIGLQVLRCKLGITLFLGTVRTNLDPLEHHADQELWEVLSKCHLTELVTQDQIEEEIDSDRQPFHGANIVKGYPRMIVN

SEQ ID NO: 112931 - protein, 818 aa, Glycine max
  Coding DNA Sequence Number=SeqID_21246
  Gene Ontology: Mol. function=cation transmembrane transporter activity; Cellular component=membrane; Biological process=cation transport
  Homolog annotation: Hit_ID=UPI00001622D8; Match level="QueryCoverage =84%, HitCoverage=85%, E-value=1e-103, Identity=57%"; Hit description= cation efflux family protein
  Pfam annotation: Domain name=Cation_efflux; Domain location=406-818; Score=279.8; E_value=5.5e-81; Accession=PF01545.12; Description =Cation efflux family
  Subcellular localization annotation: CTP_CleavageSite=28; ConfidenceScore=5.53e-01
MADNDHSHSHPHHHHHHHRPHRLSVPPRSTTFGGTPGTQPAFWYSSSTTPTPTPSKTRRSLSFPKSKSKSRSSVFLLLFFSLRSLYSLLPFLRSSPSFSLFPFSFLVSLLSFSLTLSFSLFSSSSTSSKDPFLHHKPKHPLLSPSLTPSQQRILVTKSILLALVFLLRFQALRYCGTASMILAELMGSIAARPRNPYRHNLRGFLSLSLGLLLLSFGWDRIECFPFSPACLTRRIWPLILPFASGFLAHYRLVDSGTTLKQLGRKRVRLITLLFTTVILFVPAVVSFFVFEAEEDSVAFGNLAWPLVNTVVFGVLLSESYSGDDNDDDDSFASSREFLVTFVCTLVLELFYFPELSLWGLLLCGLLLYVGVRDLDPFHSSNEGEFSGDMIMKPIRHVLSERKSRKIALFLLINAGYMVVEFAAGFMSNSLGLISDACHMLFDCAALAIGLYASYISRLPANNHYNYGRGRFEVLSGYTNAVFLVLVGALIVVESFERILDPQEISTNSLLVVSIGGLVVNVIGLIFFHEEHHHAHGHVLSGSSCSHSHTHTESHSHHTHHHHDHDHDHDHLHSHGHETTIHGSNQEYISVSSDCRDDSCPGDHGHHHNHNHCSHERKHHGECHDHEDKHSIPSFKHHDAAAHCHDHGEHHDQTGHSCHEDAPLVRKEHDHRHIDHNMEGIFLHVLADTMGSVGVVISTLLIKYKGWLIADPACSIFISILIVSSVIPLLKNSAEVLLQRVPRAHEHELKDALINVSKIRGVYGIQKFHSWNFTNTDVVGTMHLHVSTDTDKTSAKSQVLHLLRNAGIKDVTLQVECVG

SEQ ID NO: 112932 - protein, 36 aa, Glycine max
  Coding DNA Sequence Number=SeqID_21247
MKSIGTPCYGNREEAKGEFTSVSDEIEGRVGRWTTI

SEQ ID NO: 112933 - protein, 165 aa, Glycine max
  Coding DNA Sequence Number=SeqID_21248
  Gene Ontology: Mol. function=inositol oxygenase activity; Cellular component=cytoplasm; Biological process=L-ascorbic acid biosynthetic process
  Homolog annotation: Hit_ID=O82200; Match level="QueryCoverage=79%, HitCoverage=48%, E-value=2e-39, Identity=55%"; Hit description =Inositol oxygenase 2
  Pfam annotation: Domain name=DUF706; Domain location=60-165; Score= -6.6; E_value=7.7e-15; Accession=PF05153.6; Description=Family of unknown function (DUF706)
MFSLIEQPQPSRTQAEENNEHSQKITLGLVLDGDFPLLKPPSSHDGLIVPDINSNGRSFSERHKSVKEFYRQQHIGQTYEFAKKMTEEYGKLNRVEMSIRECCEILDKIVDATEAARKDYPNEDWLHLTALIHDLGKVLLLPSFGGLPQWTVVGESCPLINPIRD

SEQ ID NO: 112934 - protein, 60 aa, Glycine max
  Coding DNA Sequence Number=SeqID_21249
MTDTNEKHTRIDEDELRIDEDQTWIEEKMREFERRKPAEAVVALELVELQVSNFESWHVA

SEQ ID NO: 112935 - protein, 40 aa, Glycine max
  Coding DNA Sequence Number=SeqID_21250
MLVLNNIRNYHVRRIRIEGKSWRERCGNFVMNKGAVRDIM

SEQ ID NO: 112936 - protein, 654 aa, Glycine max
  Coding DNA Sequence Number=SeqID_21251
  Gene Ontology: Mol. function=triacylglycerol lipase activity; Cellular component=chloroplast stroma; Biological process=lipid metabolic process
  Homolog annotation: Hit_ID=A7Q196; Match level="QueryCoverage=75%, HitCoverage=98%, E-value=0.0, Identity=69%"; Hit description =Chromosome chr10 scaffold_43, whole genome shotgun sequence
  Pfam annotation: Domain name=Lipase_3; Domain location=215-364; Score= 183.2; E_value=6.6e-52; Accession=PF01764.16; Description=Lipase (class 3)
MALSTVRHNHFLATHEPGLNRFNMVRAQHHHVLLDHPKTKTPNRATRLAESLSHVLHLHIDPTSHKNLDLLSVHEEKHSTPTMSPRENISQKWREIQGYHNWEDILDPLQPWLRREIVKYGEFAQATYDAFDYDSFSEYCGSCRYNQNKLFEKLGLTRNSYTVTRYIYAMSHIELPRWLERSHVADTWSKDSNWIGFVAVSDDDETRRIGRRDIVVAWRGTVAPCEWYEDFQRKLDPIGHGDAKVEHGFLSIYKSKSETTRYNKSSASDQVMKEVTKLVNFYKGKKGEEVSLTITGHSLGGALALINAYEVATTFLDLPVSVISFGAPRVGNIAFKDELHQMGVKLLRVVVKQDWVPKMPGLLFNEKLKMFDEITGLEWVYTHVGAELALDVHSSPYLKGGMNLSGFHSLETYLHLIDGYLSHETPFRSEARRDIALVNKSCDMLVDELRIPHCWYQLANKGLVCNAHGRWVKPKRDNDDIPSHASEVFNAGLGVVILLMIWCEKKADCGEHIDQIRGLPENEAQDLTFIRLFADGPGNNIERDWLKAIKYLELDAVNFNEAREHLFIISLLQSSSNLEKLVIKIQDVNITVQTSYKPALGLIRFVLARSPALKILTFTVDPGLNQSDASVLLSVPISLNNRFFRTCDTMEKIK

SEQ ID NO: 112937 - protein, 43 aa, Glycine max
  Coding DNA Sequence Number=SeqID_21252
VVVMTTTVMAATTMAVDDNSCDCNSDHGDDNDDEGYDNKGGVD

SEQ ID NO: 112938 - protein, 205 aa, Glycine max
  Coding DNA Sequence Number=SeqID_21253
  Gene Ontology: Mol. function=protein serine/threonine kinase activity; Cellular component=cytosol; Biological process=protein amino acid phosphorylation
  Homolog annotation: Hit_ID=A7Q183; Match level="QueryCoverage=86%, HitCoverage=58%, E-value=9e-59, Identity=64%"; Hit description =Chromosome chr10 scaffold_43, whole genome shotgun sequence
MESALIFLGTGSSGSVPCMRCLIDPSDPPCPVCAYSLSFPPHLNPNYRCNSSLLIDYYCRSDATHKYILIDAGKTFRETALRFNVNVTFYVFSQVPYWLILLQIVLTHEHADAVLGLDDVLAVQPFSPTNDIDPIPVYLTQHSMDSVEKRFPYLVQKKHKEGQEMRRVALLCWNIIADDCNRPFFASGLKLIPLPVNHCKPCHWW

SEQ ID NO: 112939 - protein, 1573 aa, Glycine max
  Coding DNA Sequence Number=SeqID_21254
  Homolog annotation: Hit_ID=A7P845; Match level="QueryCoverage=95%, HitCoverage=99%, E-value=1e-178, Identity=39%"; Hit description =Chromosome chr3 scaffold_8, whole genome shotgun sequence
MANSRIARFFMEVAPPQYVTVMRHRTSKMLDTITEDEREISTNDSVMLPPKTKSTVAVAASSASSAASVTNVKGRHFLKENKTLPAKAKMQNRKRKYIFDAQPRETPKRHRLERHSPWNNLNLILCIQDKHHDLSSKVNQAFNFVQSYNGEDRKTIELPRLLCYLNDWILTLLFPPNGKKNWGDGQTPPQFEGIDAYMDLRCWEIFKFCLQESLKFHVSLSIPRNLLQTVQFVARNVLSLLEDSSISSGELFISDERYKLCDTTLDCVSLVFSSHGGLSNKNLDLWVETARVLLELVLKMYSNKLDGSDVGAYALRFLWSVLQPFSKLRVHLAKKGFHNFVDKLLEPLLHLSGELHLQVNESNPIWASRLMEAVEEVLSHGLFHHMHIPEFLSLHVSENDDASCDDKSNDSKATIKSYTRHLFDVLNKIIAKKNDMAMGSLGLLFHLYVNSARKFKLDEGHQTVENIDGSRQPVPGKHCSSNNISADLQNSLFNFFVLIMEPLLLKINAYIQVEVDANPLLLDFHALLKSIGKLLASFMQDKVYVRTEDTSGGACLNFLKKIFNTLMTSFTSVLHFSNYDTTNRTEISSTLPANEILVAMGYLLQIEYEVIGEDLVNLWLLMLSCSAINCNLVNVPDQCPLPSTIPALGCQTIYLYSQLRQRFCMGSALLVVLLLHVLVTWCNSRYDCLAKERGMIFWVEIAILALCKAIRLVISHEGNTEGSSRFLVFLSNEFHSEAVERLLSSEKFINAIYKAVESIPEGQVCGCIRQITEDISESLRWMKDFCPLVDGKKLQIFNLQGELLGRGLSRLYCLVLGSVIITNSNRNLLGVAVNELMALVRPYLSILVGQQPDTICKFFSSVIGETVDQVVRKGKVLKKFGRSSQWVLVFFFQLFVSCQSLYRQASLRPPDMPKMSAEVEDYTTYSASELMERIDEIDFGYFSWIVQPSSSLLVVMQFISDIYLKLGSDDFSPLIYIFQSMALRRLVYLNKQIKLFKSLASMFCHALEKSVLPLFSNIPCTDVNLQSLPNWPEFLSSLDNSAMLVDKNKEILVDSSAVESSTTHSCDKLPADISRKDKTFPVTDKIFRDCHHLLDLLCRMQDKNARSFSHLLTCIFNLERKEAEMPCEEISNHKISHEENHLLPCSQDSPKLEALKCLTFMAENLREQIQSLLVSVHNTPCNVNVGFGLTYESINRLSSSACCFSRLLWGLLTSSTGQTDAKDSDEKEKVLMWKSEHASELDSCISSLVELTNVFVNKLLIESNQLSKSSHNTQHFEDPAVKLSLSSTNYLSSKSLVSKANALVGTQNESTAAASCFTSSAVDNVSKSVSNHGRMLNPNGENSVARVLARVESTELQGLNKPLLQSLVKEMVVVPQYSALLLLDGACNYLRELAGRKGLKMIKRHCQSFVASVFNIIVHLQSLPIFYDNLASGKVASTPDPGSAILLGVEVLVTVSRKHTLFPMDVWHVGHLLHIPAALFQNFYQLRVTKASGPSETLMISDEHICDQDMVIPREVASEEEVDESLRPGVDALIDACSRDDIQYLHTVFGGPCRNILLSLVGDRKLTEFKGKV

SEQ ID NO: 112940 - protein, 75 aa, Glycine max
  Coding DNA Sequence Number=SeqID_21255
MRGWTSSADGEFEIVLARGNDWWGLGLRGGRRGVVGFGESFGGGEGGERVWMESGCPSEKLGIGKQSHGIGGVVD

SEQ ID NO: 112941 - protein, 363 aa, Glycine max
  Coding DNA Sequence Number=SeqID_21256
  Homolog annotation: Hit_ID=Q2HV76; Match level="QueryCoverage=90%, HitCoverage=93%, E-value=2e-55, Identity=43%"; Hit description=F-box protein interaction domain; Galactose oxidase, central
  Pfam annotation: Domain name=F-box; Domain location=1-45; Score=28.7; E_value=2.1e-05; Accession=PF00646.24; Description=F-box domain
MVLPQDLITEILLRLPVKSLVRFKSVCKSWLFLISDPRFAKSHFELAAALADRILFIASSAPELRSIDFNASLHDDSASVAVTVDLPAPKPYFHFVEIIGSCRGFILLHCLSHLCVWNPTTGVHKVVPLSPIFFNKDAVFFTLLCGFGYDPSTDDYLVVHACYNPKHQANCAEIFSLRANAWKGIEGIHFPYTHFRYTNRYNQFGSFLNGAIHWLAFRINASINVIVAFDLVERSFSEMHLPVEFDYGKLNFCHLGVLGEPPSLYAVVGYNHSIEMWAMKEYKVQSSWTKSIVISVDGFAIRSFFPVCSTKSGDIVGTNVIPGLMKCNDKGELQELRTYCDSPYPSEVAVYTESLFSLPCDSK

SEQ ID NO: 112942 - protein, 175 aa, Glycine max
  Coding DNA Sequence Number=SeqID_21257
  Gene Ontology: Mol. function=(S)-2-hydroxy-acid oxidase activity; Cellular component=peroxisome; Biological process=oxidative photosynthetic carbon pathway
  Homolog annotation: Hit_ID=A2XXR4; Match level="QueryCoverage=99%, HitCoverage=51%, E-value=9e-63, Identity=72%"; Hit description =Putative uncharacterized protein
  Pfam annotation: Domain name=FMN_dh; Domain location=2-175; Score= -22.3; E_value=6.9e-13; Accession=PF01070.9; Description=FMN -dependent dehydrogenase
MAIALTVDTPVLGRREADIKNRFTLPPNMVFKNFERLDLGKLDKTRDSVVTTYVAGLFDRSLNWKDIKWLLTITSSPILLKGVLTVEDTNSIYYANNVARVAIQAGAAEIIVSNQGARQLDYAPATIMALEEIGRPVMFSLAADGEAGVRKVLQMLVDELEVTMALSGCHSLKEI

SEQ ID NO: 112943 - protein, 801 aa, Glycine max
  Coding DNA Sequence Number=SeqID_21258
  Gene Ontology: Mol. function=identical protein binding; Cellular component=extracellular region; Biological process=negative regulation of catalytic activity
  Homolog annotation: Hit_ID=Q6WNU4; Match level="QueryCoverage=100%, HitCoverage=100%, E-value=0.0, Identity=88%"; Hit description =Subtilisin-like protease
  Pfam annotation: Domain name=PA; Domain location=403-506; Score=98.3; E_value=2.4e-26; Accession=PF02225.13; Description=PA domain
  Pfam annotation: Domain name=Peptidase_S8; Domain location=126-646; Score=10.3; E_value=2.6e-07; Accession=PF00082.13; Description =Subtilase family
  Pfam annotation: Domain name=Subtilisin_N; Domain location=29-115; Score=85.3; E_value=1.9e-22; Accession=PF05922.7; Description =Subtilisin N-terminal Region
  Pfam module annotation: Pfam domain module=PA::Peptidase _S8::Subtilisin_N; Domain location=403-506::126-646::29-115
MRPPSPSIHFLLQILLVCLLHRPSFAVKKSYVVYLGAHSHGPELSSVDFNQVTQSHHDFLGSFLGSSNTAKDSIFYSYTRHINGFAATLDEEVAVEIAKHPKVLSVFENRGRKLHTTRSWDFMELEHNGVIQSSSIWKKARFGEGVIIGNLDTGGAKNGAKVGIVQGSDDKVTNKKIEIALVSKVWDQFHQSGEESVITELIILFTATETLSGDVECRKLIGARYFNKGYASVAGPLNSSFDSPRDNEGHGTHTLSTAGGNMVARVSVFGQGQGTAKGGSPMARVAAYKVCWPPVGGEECFDADILAAFDLAIHDGVDVLSVSLGGSSSTFFKDSVAIGSFHAAKRGVVVVCSAGNSGPAEATAENLAPWHVTVAASTMDRQFPTYVVLGNDITFKGESLSATKLAHKFYPIIKATDAKLASARAEDAVLCQNGTLDPNKAKGKIVVCLRGINARVDKGEQAFLAGAVGMVLANDKTTGNEIIADPHVLPASHINFTDGSAVFNYINSTKFPVAYITHPKTQLDTKPAPFMAAFSSKGPNTMVPEILKPDITAPGVSVIAAYTEAQGPTNQVFDKRRIPFNSVSGTSMSCPHVSGIVGLLRALYPTWSTAAIKSAIMTTATTLDNEVEPLLNATDGKATPFSYGAGHVQPNRAMDPGLVYDITIDDYLNFLCALGYNETQISVFTEGPYKCRKKFSLLNLNYPSITVPKLSGSVTVTRTLKNVGSPGTYIAHVQNPYGITVSVKPSILKFKNVGEEKSFKLTFKAMQGKATNNYAFGKLIWSDGKHYVTSPIVVKALLTRN

SEQ ID NO: 112944 - protein, 140 aa, Glycine max
  Coding DNA Sequence Number=SeqID_21259
  Gene Ontology: Mol. function=structural constituent of ribosome; Cellular component=ribonucleoprotein complex; Biological process =translation
  Homolog annotation: Hit_ID=Q5QJE1; Match level="QueryCoverage=51%, HitCoverage=77%, E-value=2e-20, Identity=66%"; Hit description =Ribosomal protein S19
  Pfam annotation: Domain name=Ribosomal_S19; Domain location=50-125; Score=109.8; E_value=8.1e-30; Accession=PF00203.12; Description =Ribosomal protein S19
MVPCNTTRVLSGRMRPTMMLRALTKQFLGIVGDTANTVAKKPPPPPPLVSRKPAFIDAFLYKMKKNPNLLLNKTIWSRRSTILPEFVDSTVKIYNGKTTIRCRITEGKVGHKFGEFALTRKRKTREQANSKNVKQLKKKK

SEQ ID NO: 112945 - protein, 435 aa, Glycine max
  Coding DNA Sequence Number=SeqID_21260
  Homolog annotation: Hit_ID=A7Q9J7; Match level="QueryCoverage=93%, HitCoverage=60%, E-value=1e-160, Identity=70%"; Hit description =Chromosome chr5 scaffold_67, whole genome shotgun sequence
  Pfam annotation: Domain name=MACPF; Domain location=122-319; Score =64.3; E_value=4.2e-16; Accession=PF01823.10; Description=MACPerforin domain
MAAEKGVEMVALECLGKGFDLASDFRLRFAKGIREERLVVLDEQNKRDILIPGTGGVTIKGVSENIRCDKGDRIRFKSDVLEFNQMSELLNQKSAVQGKVPSGYFNALFDLSGDWFRDAADTKYLAFDGYFISLYYLHLTASPLILQEEVKKSVPARWDPASLSRFIQTYGTHIIVGMAVGGQDLICVKQKHSSKIPPGDLRRHLEDLGDFLFSDVRSPSLLQRKTADGKQKVPEVFNRVMQSNTMQFTSISETSSKDGLTIICSKRGGDMFKHSHSNWLQTVPSNPEAILFKFVPISSLLTGIPGSGYLSHAINLYLRFSKPSLLEQPLFNFFTVEVHNTPLIHLLSADKPSPGDLQYFLEFQIPRQWAPMFCELPLRHQRRKTASPSLQFSFMGPKLHIISTQFATLEFSCTPSQDSGVEQGVGCFQTERDWL

SEQ ID NO: 112946 - protein, 196 aa, Glycine max
  Coding DNA Sequence Number=SeqID_21261
  Homolog annotation: Hit_ID=A5C8K0; Match level="QueryCoverage=45%, HitCoverage=4%, E-value=1e-08, Identity=39%"; Hit description =Putative uncharacterized protein
NGETVFKLQTRFTHIVNHLLGLGNMFEDGELNIKILNCLTRTWEPKNIAVKESKDLASMSMEALFEKLLLCEHELIQQSHAKDIEMKRKNIALKASSSKKTLSNCPVYLKKHYAKMKGKKDGKPKKAYIAWEENESSSFDSSSGEEIANVCLMADSTDDSSTVEEIGVNSEFEEVLETFNEMHEDAQKLATLNNKL

SEQ ID NO: 112947 - protein, 105 aa, Glycine max
  Coding DNA Sequence Number=SeqID_21262
MGKAEEVQEKVKADMEAMKEKMATMMEAMMSMKKIMEVNAVTIAATSTVAKVNPTSPFDINQMNHPTSAMVGKIWEARAAPIMRKVKTGRPSHHMACLPTIHHPM

SEQ ID NO: 112948 - protein, 681 aa, Glycine max
  Coding DNA Sequence Number=SeqID_21263
  Gene Ontology: Mol. function=transferase activity; Cellular component= flagellum; Biological process=biosynthetic process
  Homolog annotation: Hit_ID=Q4UUG0; Match level="QueryCoverage=97%, HitCoverage=56%, E-value=1e-166, Identity=46%"; Hit description=O -antigen biosynthesis protein
  Pfam annotation: Domain name=Glycos_transf_2; Domain location=463 -644; Score=111.7; E_value=2.2e-30; Accession=PF00535.17; Description= Glycosyl transferase
MKAFTASSDIVLASSRRQRINEQGDVLPDIMATAYPFRGDVIIEGRDLIAFLSDYIINWIGEPSCVLCRRQDLVDLGDELFFLNGKRMRYLGDVAIYVNLLSKGNFAFLSEPLSQFRISEQQVSQMAASDQEAVATTYQQFPLMIEKLGWYKGDHITNQTVRASALTHPGNYIECNLLAALSSALHLSGGSRANKNLGDWLKSREITKVQSAYIENHLSSISINKVVVYVLAREADNENINVTLDSLEKNATPGLIVHPVLINANLTDFTSIENLKNSDLNEFELINQHLSEATVDWILILKAGSILTSSGLLQMSFALPDAKGCAAVYADELYHQSGEVTGSSFRPDFNLDLLLSHPAEMARHWLYNRNVLLNVGGFDPAYHKASEFELIVRLVEQYGINSIGHLPEPLVISESFLLTDEPEYRDILQKHLHRRGYTNGWVKNTWPGLYSLRYEHANQPLVSIIIPTKDQLPVLITCVTSLLEKTHYKNYEIIVVDNNSESTEAQQWLAGLAEIDPKRIRVLSYPHPFNYSAINNFAAREARGEYLVLLNNDTAIISENWLDELLNHAQRPEVGIVGAKLLYPDGRVQHAGVILGLRGPAEHPFIGEAADAPGYMRRLLVDQNYAAVTAACLMIRAEIYREVGGLNEEDFKVSYNDVDLCLKVRESGYLTVWTPPRCGNA

SEQ ID NO: 112949 - protein, 96 aa, Glycine max
  Coding DNA Sequence Number=SeqID_21264
  Gene Ontology: Mol. function=dTDP-4-dehydrorhamnose reductase activity; Biological process=extracellular polysaccharide biosynthetic process
  Homolog annotation: Hit_ID=O52480; Match level="QueryCoverage=71%, HitCoverage=26%, E-value=3e-11, Identity=46%"; Hit description =Putative dTDP-L-rhamnose synthase
DPLITLASRAEAAGVYHYCGDVAVSWCEFAQAIFVAAQRDVLVKGIGSAQYPMAAARPANSVLNTVRIAALGVEASDWQNKLTADFFPQSESSAIA

SEQ ID NO: 112950 - protein, 207 aa, Glycine max
  Coding DNA Sequence Number=SeqID_21265
  Gene Ontology: Mol. function=motor activity; Cellular component=cell projection
  Homolog annotation: Hit_ID=UPI00016621D1; Match level="QueryCoverage =96%, HitCoverage=40%, E-value=2e-18, Identity=32%"; Hit description =UPI00016621D1 related cluster
GGPLGTNTLTFRGLHVLAFRGLHALIFRGLHPLTFRGLHVLAFRGLHILAFRGLHVLTFRGLHTLTFRGLHALTFRGLLVLAIRGLHALAIRGLHALTFRGLHALACRGLHVLTFRGLHALAFRGLHALAFRGLHVLPFRGLHALTFRRLHALAFRGLHFLAIKGLQVLTFRGIHALALRGLHVLTFKGLHALAFRGLPVLTFRGLH

SEQ ID NO: 112951 - protein, 349 aa, Glycine max
  Coding DNA Sequence Number=SeqID_21266
  Homolog annotation: Hit_ID=Q6WAY6; Match level="QueryCoverage=97%, HitCoverage=68%, E-value=1e-12, Identity=23%"; Hit description =Putative uncharacterized protein
MVKEFEEILGCPLGGRKPYLFSGFYPSLARISKIVQISVQELDHRKQVENGVVGVPRRCLEAKARILAGRGEWAPFIDILALLIFGGVLFPNVDGLVDLAAIDAFLVYHDRKESPIVAILADLYDTFDRRCEKSSTRIVCCTPTLSIWLVSHLFRQEERLLTGSLVGKKEEPGQLDYPMRGAPLEEELVPVITRGFNKTNVEALQKVPKAWEVVQKKDKELRGSNNGPIGGYRKWLKAHVQGLDWLPSLRTAKGEEVEAPEEDEEVQALRAELEQTQTVKERLKSASLKIQNENAKLRDINIATTKALEQETKRAHREEHGRNKFRGALWGSNSELKLRREERDQSQVD

SEQ ID NO: 112952 - protein, 66 aa, Glycine max
  Coding DNA Sequence Number=SeqID_21267
MTGTRTRNKTQTDLFFFDTKSERHKKQEQERDKNKNKNANNRTQDANKNETRCYGGLDDATSGEGR

SEQ ID NO: 112953 - protein, 105 aa, Glycine max
  Coding DNA Sequence Number=SeqID_21268
KGHLSTSCPHPRREKRSGSLNNQSERPRITGECLLLVVLMPHSLMISSKGLDLNQEGKALMDSLESRPGGKDTRFECSFKSMLIPYGWSILAKQSDPDWSPYDFT

SEQ ID NO: 112954 - protein, 54 aa, Glycine max
  Coding DNA Sequence Number=SeqID_21269
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=A9LYA7; Match level="QueryCoverage=98%, HitCoverage=39%, E-value=8e-15, Identity=81%"; Hit description=ATP synthase CF1 epsilon subunit
  Pfam annotation: Domain name=ATP-synt_DE; Domain location=6-53; Score= 48.4; E_value=2.5e-11; Accession=PF00401.11; Description=ATP synthase, DeltaEpsilon chain, long alpha-helix domain
MALMGVTLIPQEAQQTLEIAEANLNKAEGKRQTIEANLALRRARTRVEAINVIS

SEQ ID NO: 112955 - protein, 170 aa, Glycine max
  Coding DNA Sequence Number=SeqID_21270
  Homolog annotation: Hit_ID=Q6WAY6; Match level="QueryCoverage=62%, HitCoverage=19%, E-value=5e-13, Identity=35%"; Hit description =Putative uncharacterized protein
LVDLAAIDAFLAYHYSKESLVVAMLANLFDTFDRRTISWFPRWKEGKEGVLFSCGEYPNIPLIGTRGCINYNPALAIRQLGYPMRGAPVEESLSPLLVRDFGAQSFKIIQRVHKAWESPLRKDKELRGIRNGIIGGYHEWLKVRTRGLDWLSKLKIINEENFETPEADEE

SEQ ID NO: 112956 - protein, 291 aa, Glycine max
  Coding DNA Sequence Number=SeqID_21271
  Subcellular localization annotation: CTP_CleavageSite=94; ConfidenceScore=5.81e-01
MTRPPSRSHACQFAGSASLRLHTPISPRSGSSPAASAATDSGAGCMQRPTRAAVRSTSAGQWRMPRRARAACNAAAVCGGVTGIGCVCLARRATAAAIQAGQGIGNVHASNGKSRSSGQDLQQFANRLRGGCAGQLLIDRRVEARCQPVPAVRTRSHSGSRRSAAGHRPRIGGGSRAFSCRCTRSRWRAPFAAGTSCRPSPLIASRPKRSLLQGQFDQACGHAAHVVQARALRRRAIGLAGRGGGIEQQPDRDRAFAFGFAHEKQGHAAPPRSEQRVQLPWSIWRSSSPGS

SEQ ID NO: 112957 - protein, 192 aa, Glycine max
  Coding DNA Sequence Number=SeqID_21272
  Homolog annotation: Hit_ID=A0ST23; Match level="QueryCoverage=13%, HitCoverage=51%, E-value=5e-07, Identity=100%"; Hit description =Putative reverse transcriptase
GPGLPGINRDTRIYLFCEVISVTAVPPVQLLTGWCVTAKAPPDISAGKCSGRVPFAIQAAQLLGRAIGAGLFAITPAGERGMCCKAIKLGNARVFPVTTLHITLTPQLLRLRKYQAYRYRRPRGGARYQLLFPLVRVNFELGVIMVIAVSFGKPVVPAALMNRPTRGERRFAYWALAECILAYYVGTDEGCQ

SEQ ID NO: 112958 - protein, 129 aa, Glycine max
  Coding DNA Sequence Number=SeqID_21273
IGYAKEGECATSDIAVVDERAVVYAKASVTNDPIYLCIGLGKALPRYALRIRQPIHQSANSVLIPALKGRFERSLDGILLDSVKDSAYPCIRCRYPSSAYIDPTAMIGLLFSPTKLDSIVPIRNYTAYC

SEQ ID NO: 112959 - protein, 99 aa, Glycine max
  Coding DNA Sequence Number=SeqID_21274
MFIRITIRYFRVSSGPPPLDDTRCRMTKLGLCLSSGPPPLDDKRVRITIRMTKFGLCLSSGPQPLDDKRVRITIRHLRVSWVQNDQTWSLLVIGPAASG

SEQ ID NO: 112960 - protein, 333 aa, Glycine max
  Coding DNA Sequence Number=SeqID_21275
  Homolog annotation: Hit_ID=Q6WAY6; Match level="QueryCoverage=76%, HitCoverage=47%, E-value=2e-15, Identity=24%"; Hit description =Putative uncharacterized protein
MDWDQLLAGIGGRTISWFPRWKEGKEGVLFSCGRYPNIPLVGTRGCINYNPTLAIRQLGYPMRGAPTEESMSPFLVRDLGAENSKTIQRIHKAWETPLRKDQELRGVRNGIIGGYHEWLKVRIRGLDWLANEKFKLAATHVRKECVGLWEENAITARALEQETKRARKEEYGRNKFRGALWGSNSELKLRREERDQSRAHGMVLEEELIACSRSKRSLSQRLCETETNMLAIIAKYEEELGLATAHEHRIADEYAQVYAEKEARGRVIDSLHQEATMWMDRFALTLNGSQELPRLLAKAKAMADTYSAPEEIHGLLGYCQHMIDLMAHIIRNR

SEQ ID NO: 112961 - protein, 225 aa, Glycine max
  Coding DNA Sequence Number=SeqID_21276
MVIDQSLFFDLTKLPSEGVPFEGALIDEWKFYFSVHDVRRLVCTNQVDMTGRLLAGLLAFESRILHYLIVCILLPRSSNLAQVSEEDLMVMWAFHKGLQIDWAHLVRYRMHKALRLNAPLPYPHLVTLFLQHFNIPLDSEPYVPIKRSFLIGASVIASFGYIKEHDGSWVKKGARNIGEEGHEGEDSSLLSKILERFDGLQTFVGERFDTLELQVDMRFNEMESE

SEQ ID NO: 112962 - protein, 88 aa, Glycine max
  Coding DNA Sequence Number=SeqID_21277
MNSQYICFYLMPFFVHGSIFWCPRRRGTTPIHPELGGYSGEQISSGDDGVGPVAQRIRARGYEPRCRGVRIPPRPQPAKKGKDFSLWG

SEQ ID NO: 112963 - protein, 99 aa, Glycine max
  Coding DNA Sequence Number=SeqID_21278
MAPRKLPAKRARKDAVGEGSNAAPHVDVEFDGHRFRSEEHQHRFESIKGWLFLKERRVQLRDEEYAEFQEKISWRKWTQLATPMAKYDPKIVMEFYANA

SEQ ID NO: 112964 - protein, 34 aa, Glycine max
  Coding DNA Sequence Number=SeqID_21279
MTDMQSGHQSEPFDVEMGDRLEDMIRDLVMQSYL

SEQ ID NO: 112965 - protein, 36 aa, Glycine max
  Coding DNA Sequence Number=SeqID_21280
MATKMKRCPFEALGSMAPIKSMPHIENGQGAAKMFK

SEQ ID NO: 112966 - protein, 164 aa, Glycine max
  Coding DNA Sequence Number=SeqID_21281
  Homolog annotation: Hit_ID=Q6UUU1; Match level="QueryCoverage=36%, HitCoverage=40%, E-value=1e-18, Identity=78%"; Hit description =Putative uncharacterized protein
MANIEAHQLYCRANEVSLVHLKDGLTQIAFQDDVKRFIDAQLNIIRSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112967 - protein, 69 aa, Glycine max
  Coding DNA Sequence Number=SeqID_21282
MGDQEKTLEQMKADMSALKEQIASMMEAMLGMRQLMKKNVATSTAISSAAEADPTLLATAHHPPSNTVG

SEQ ID NO: 112968 - protein, 185 aa, Glycine max
  Coding DNA Sequence Number=SeqID_21283
  Gene Ontology: Mol. function=precorrin-4 C11-methyltransferase activity; Cellular component=ribonucleoprotein complex; Biological process=cobalamin biosynthetic process
  Homolog annotation: Hit_ID=P0A2H0; Match level="QueryCoverage=100%, HitCoverage=71%, E-value=6e-93, Identity=93%"; Hit description =Cobalt-precorrin-4 C(11)-methyltransferase
  Pfam annotation: Domain name=TP_methylase; Domain location=1-144; Score=96.8; E_value=6.8e-26; Accession=PF00590.11; Description =Tetrapyrrole (CorrinPorphyrin) Methylases
MAAGVKAGKTVVRLQTGDVSLYGSVREQGEELTKRGIAWQVVPGVSAFLGAAAELGVEYTVPEVSQSLIITRLEGRTPVPAREQLESFASHQTSMAIYLSVQRIHRVAERLIEGGYPDTTPVAVIYKATWPESHTVRGTLADIADKVREAGIRKTALILVGKFLGEEYHYSKLYAADFSHEYRQA

SEQ ID NO: 112969 - protein, 91 aa, Glycine max
  Coding DNA Sequence Number=SeqID_21284
MKEAHMITRSSSKPGDKTSNWKIVEENPHNQIDEGAVGCQSKTEKETSSSILGDLRNPCAEKSNFQSSFSDLAIPWYINNLGSTQQKSEDH

SEQ ID NO: 112970 - protein, 76 aa, Glycine max
  Coding DNA Sequence Number=SeqID_21285
MAAEWRRNRERRRHFKEKMSLEEAHHHRRPWIRAWRKKEMNEGRGREEHEILCSKIALKFEPTNPRSIPRFSTKCA

SEQ ID NO: 112971 - protein, 121 aa, Glycine max
  Coding DNA Sequence Number=SeqID_21286
MIMRRQDIYSSQDEATTSPSSSESEEAKGEESSEEIYPQEEGKPLMTLVSIATPLRLEFIPQVKELLDEGLVHKSLNPCALLVPKIDVEEKSPEFQEPRDLRSNPFQGGGNDAILPHKGIG

SEQ ID NO: 112972 - protein, 81 aa, Glycine max
  Coding DNA Sequence Number=SeqID_21287
MTFSKFRTRGIAQAERHPPIGKSVEGAGECGLFLILRSNSNLHITRKTIKEIVVRFTCQAFKHLVNEWQWKMVLDKWPQIS

SEQ ID NO: 112973 - protein, 37 aa, Glycine max
  Coding DNA Sequence Number=SeqID_21288
MKMLLIQHDMNDSGMEKEEREETPLQGEDESRRSSPP

SEQ ID NO: 112974 - protein, 102 aa, Glycine max
  Coding DNA Sequence Number=SeqID_21289
MLWKLERIDGDPVLRETRIWATWEYASSVGGGQQGMVGLCAHCGCGKTCCAPSPDRHLVPHVMEWYLEICRGGQETLGTSGGVLLPKTKLDQSRPNPGIVGQ

SEQ ID NO: 112975 - protein, 178 aa, Glycine max
  Coding DNA Sequence Number=SeqID_21290
  Gene Ontology: Mol. function=nucleotide binding; Biological process =defense response
  Homolog annotation: Hit_ID=Q6L477; Match level="QueryCoverage=83%, HitCoverage=28%, E-value=3e-10, Identity=28%"; Hit description =Putative uncharacterized protein OSJNBa0009L15.8
KIIGVNVEDDDSYMDTYHQSLCPHKKRLRTYLGIIARDKVDVTYDTWKEVPVAQKDLIWEDIQTEFEIPEAFDSRTKKKVLQIVGERWRKFKSDLTRKWALAADKDGVEDTAIQKQNTAPHMLSRGGYEYLEHMLVAKKTKKRLEEAAQSGSTEGVIDPPSPIKRYVKWKMAHTKKTG

SEQ ID NO: 112976 - protein, 86 aa, Glycine max
  Coding DNA Sequence Number=SeqID_21291
  Homolog annotation: Hit_ID=Q5XM22; Match level="QueryCoverage=82%, HitCoverage=40%, E-value=2e-19, Identity=63%"; Hit description =Resistance-like protein HAAS-2
MLVELLEVYGEAARDETAQCHGPYIHLSWLRDIYQSRCQARHWNPAARAYVLHLLGCTLFANKSATHVHVVFLDALRDLSQSGSYA

SEQ ID NO: 112977 - protein, 316 aa, Glycine max
  Coding DNA Sequence Number=SeqID_21292
  Gene Ontology: Mol. function=nucleoside diphosphate kinase activity; Cellular component=cytoplasm; Biological process=nucleotide metabolic process
  Homolog annotation: Hit_ID=A9CJG7; Match level="QueryCoverage=54%, HitCoverage=85%, E-value=5e-83, Identity=79%"; Hit description =Lignin degradation protein
  Pfam annotation: Domain name=GST_C; Domain location=75-163; Score =9.4; E_value=0.011; Accession=PF00043.16; Description=Glutathione S -transferase, C-terminal domain
  Pfam annotation: Domain name=NDK; Domain location=189-316; Score =220.1; E_value=5.1e-63; Accession=PF00334.10; Description=Nucleoside diphosphate kinase
  Pfam module annotation: Pfam domain module=GST_C::NDK; Domain location=75-163::189-316
GLDFEERPLPLTVIPTVEDGFSKTVPILRDGDRLGGKAMARFVESWSQTQLHPAIVRIAVLDIHNMLDEPDRRYFRESRTRALGRPLEDVVANREDEIAAFPALLAPIRRMLSFQPFIGGTSPLFSDYIVFGALQWARITTGADLFSDNDPVRDWFEGCLDLYDARGRSVTAAPPTFSEGKGNGHMAIERTFSMIKPDATKRNLTGAITKVFEDNGLRVVASKRVWMSKREAEGFYAVHKERPFFGELVEGMTSGPTIVQVLEGENAILKNREIMGATNPAQAAEGTIRKTFALSIGENSVHGSDAPETAAQEIAY

SEQ ID NO: 112978 - protein, 121 aa, Glycine max
  Coding DNA Sequence Number=SeqID_21293
MGEVEEVQEQMEADMEAMKEKMATMMEAMISVEKIVEANAVAVAATRAVAKAKIWEVRAAPMMCKIQNEHAFPPYGLPLNYTPPNVAYTPNKNVNNSTPIPIESQQPRTIMHMSLNRGGGT

SEQ ID NO: 112979 - protein, 55 aa, Glycine max
  Coding DNA Sequence Number=SeqID_21294
MWTTTVEDRRKRRANDGCRRTVENLRVITHGNITDTLQKRLGLDFLHGNNFPQQI

SEQ ID NO: 112980 - protein, 51 aa, Glycine max
  Coding DNA Sequence Number=SeqID_21295
THLLLEVASPLSLPSPFRCHLSSKKQRNPLMKKILGLQAPMELASNTTLDF

SEQ ID NO: 112981 - protein, 100 aa, Glycine max
  Coding DNA Sequence Number=SeqID_21296
RIDADIWKKESEIPTLTDIHLRRIENVGIVVFGSDFRVHVIFLSRLGILHSALRGLELYTVAGYSPKMNAYGRWGNLSLAIHPSPIRLNKIPYLKGLPRD

SEQ ID NO: 112982 - protein, 254 aa, Glycine max
  Coding DNA Sequence Number=SeqID_21297
MPERGEARGNSVSLRIAGARGRVLSGRCGCSVEPRHGIESSKWAIFGKQNWRCGMNRKLGYGAQLRANLDPTKGVGRLRQQDGGHGSRNPLRTPMSRRARRSLAKPRARAPGGAVVGADLGGSSKYSNENFEGRKRGKVSMDGGSPSDSALCAYSRKGIGLKFLNRDVAADGNVRESGDVGGGPGKSYLFCLTACPPWKRLSRRTECLPRPVVLITASGLQGEQPLVDGTIPEPVGCRWTARAASAARAGRRVP

SEQ ID NO: 112983 - protein, 209 aa, Glycine max
  Coding DNA Sequence Number=SeqID_21298
  Subcellular localization annotation: CTP_CleavageSite=81; ConfidenceScore=5.10e-01
MGSNFLMSILDLGKGRPVAPCGQSFCSACCPVAATGGARTPPKLILYNRWLHRFCRPTRRRAIRVFGQRPSDAALANEAIRGMRRSRKERALRLVRRNLYSLDLLAGKTQGDLTIDELQRHIAEKLPPPTGQRRHRCLFALGGDLVQIVAIGDDLGGDAVLVSCQLQQNLQHASAAFTVSTMALPDAERSQPLGMVRSRDSASASFGCC

SEQ ID NO: 112984 - protein, 93 aa, Glycine max
  Coding DNA Sequence Number=SeqID_21299
MDSGRFQVSVLGSNYPRTTLLGTIFTSFNGPEPFLYMIQLFHFCHSMRVFNRCGMQGVWLWVILRALPKCFARGIPPNCLPFSGISEPRLEVG

SEQ ID NO: 112985 - protein, 28 aa, Glycine max
  Coding DNA Sequence Number=SeqID_21300
MMVAHVMLGNGYEPEMGLGKNNGVRTSL

SEQ ID NO: 112986 - protein, 167 aa, Glycine max
  Coding DNA Sequence Number=SeqID_21301
VVPTKTPNGPGEVQQGSGVSSSSYGPLSVLQGARFPPARSRHHVIGIVPARHPVDPKKANKDLELPALITGLCQFYGVPVAPSKKYCAPRQAQGATPQQLRDGRQRAIDALPPPPKNLSSSTKKLVRCLRPMADQQATKYKAKDKKSTRSVTDKSSSVQLKTLKKRY

SEQ ID NO: 112987 - protein, 89 aa, Glycine max
  Coding DNA Sequence Number=SeqID_21302
MEKMNVHIIIRVTPKGKGSLWGSCSSPRRVGFFIMKLFGSPGELEASLGELEASLGELGSRKTKENTLLPPFFLVFLHSWSKQEDIEVL

SEQ ID NO: 112988 - protein, 146 aa, Glycine max
  Coding DNA Sequence Number=SeqID_21303
MALGFPALVIGLCQFYGEPVTPTKHIRPPINRSLIDKYCMPRKVQQPEKVQQPQPPAYAPPPPPQKPPSLESISTHFTSIAKTLILTLGLLPSSLEPLLHCLEIGPFFMRRRVLQMLKKLPKEIEKDEDMANHVDYFMGGNGSSQP

SEQ ID NO: 112989 - protein, 97 aa, Glycine max
  Coding DNA Sequence Number=SeqID_21304
MILDALAGGTMFCKSLEEAIVNIDSITTNDNQSHHDRALIGQPPQQFQQCGSQKTPQAHQVQQVEIANRKKRPIMCKTRRDLNRTSKQITKVTEVAQ

SEQ ID NO: 112990 - protein, 204 aa, Glycine max
  Coding DNA Sequence Number=SeqID_21305
  Homolog annotation: Hit_ID=Q84VH5; Match level="QueryCoverage=84%, HitCoverage=29%, E-value=7e-83, Identity=81%"; Hit description =Envelope-like protein
MVDIAVSEHQIAKEITAKQVQHWPKKGKLSAGKLSVKYAILHRIGTANWVPTNHTSTVATESFAVKLPIAFPTVLCGIMLSQHPNILNNIDSVKKRESALSLHYKLFEGTHVPDIVSTSGKAAASGVVSKDALIAELKDTCKVLEATIKATTEKKMELERLIKRLSDSGIDDGEAAEEEEEAAEEEEDAAEDTESDDDDSDATP

SEQ ID NO: 112991 - protein, 194 aa, Glycine max
  Coding DNA Sequence Number=SeqID_21306
  Subcellular localization annotation: CTP_CleavageSite=61; ConfidenceScore=5.04e-01
MSCLAIITPISLFQSVPPTRHPLDPDKSNKALGFPALITGLCQSFGVPVTPSKVIRPPITQAFIEKYCTPRQAQGDAPQAADAPPPPYQADPARSLGMECYLQHLVRQQAANHRGQVQIHECLYWFSLSQQGQGFAPFACPTPEQFRAEVAWPGDWPEAQAGEEPTGSPGDAEEARMDEEITDLLGFLGGSGAM

SEQ ID NO: 112992 - protein, 178 aa, Glycine max
  Coding DNA Sequence Number=SeqID_21307
MVPTRHPLDPDKSNRALGFPALITGLCQSFGVPVAPSKVIRPPITRAFIEKYCTQRQVQGDAPQAADALPPHQAGPAGSFDTEQYLRHLVRQQATNHRAHVQTHDCLYQMSLSLQSQGFTSFPCLTPDQFKAEVAWPRDWPEARAGEAPAKAPDEADEAREDEEMTDLLDFLGGSGAT

SEQ ID NO: 112993 - protein, 291 aa, Glycine max
  Coding DNA Sequence Number=SeqID_21308
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIYSMVSIDVFIGMPWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 112994 - protein, 70 aa, Glycine max
  Coding DNA Sequence Number=SeqID_21309
  Homolog annotation: Hit_ID=A2V6V5; Match level="QueryCoverage=64%, HitCoverage=6%, E-value=7e-12, Identity=62%"; Hit description=Lectin- receptor like protein kinase 3
MGQQMKKSELPLKLLMQQNSLIDFHIRKTQEEVEDWELEYWPHRIGFHEIDAATTGFSEENVVAVGGTRK

SEQ ID NO: 112995 - protein, 178 aa, Glycine max
  Coding DNA Sequence Number=SeqID_21310
MMSMKKIMEANAVAVATTRAVAKVNPMPPSDLNQMNHPTSDMVGKDLGSMDDPMMCKFKTSTASCHMACLPTIRHPMWRTLPMRMSITPLLYPLRANNPKLIMHINGKVGSSKERLRAIEGGEDYAFANLEELFLVPNIITLPRSRCWTLTSTGTTCPKNHPKMYCRKIRAYAKMRNC

SEQ ID NO: 112996 - protein, 55 aa, Glycine max
  Coding DNA Sequence Number=SeqID_21311
GEIKVEVVRMIRTRLPMAVWAKSCPGMHSSYAIASLSSCARTVGRPPRSGGWPRN

SEQ ID NO: 112997 - protein, 110 aa, Glycine max
  Coding DNA Sequence Number=SeqID_21312
MAYTHIPVEDSTSDSPQISASPYQLDLAPYASEPYNAQWNAPGLLRDKHTLRSSRILGEMEVDEPWLGLWLPLNYQVDMGSSLAYDNGIWDFVVDLGMAFVDNWVVGKEE

SEQ ID NO: 112998 - protein, 174 aa, Glycine max
  Coding DNA Sequence Number=SeqID_21313
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=49%, HitCoverage=72%, E-value=1e-24, Identity=68%"; Hit description=LacZ protein
MEKRLCRGPLTFPVKYLPGIFQEISAPFPFFSCHMKHFTDTLISANIALTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 112999 - protein, 24 aa, Glycine max
  Coding DNA Sequence Number=SeqID_21314
MSSAAFFPKLVLRKKAQSFKNLGI

SEQ ID NO: 113000 - protein, 194 aa, Glycine max
  Coding DNA Sequence Number=SeqID_21315
  Subcellular localization annotation: CTP_CleavageSite=45; ConfidenceScore=5.32e-01
MLPPSCQKRYSRIYEFSALGSSFFAFVDSVSRFYSSPTRNAPRKLASKRSRKDKAVEGTSSAPEYDSHRFRSAEHQQCFEAIKGWSFLRERRVQLRDDEYTDFQEEIVRRRWASLVTPMAKFDPDVVLEFYANAWPTEEGVRDMRSGVRGQWIPFDADALSQFLGYPLVLEEGQECEYGQRRNQADGFDEEAIA

SEQ ID NO: 113001 - protein, 230 aa, Glycine max
  Coding DNA Sequence Number=SeqID_21316
  Gene Ontology: Mol. function=transporter activity; Cellular component= outer membrane-bounded periplasmic space; Biological process=transport
  Homolog annotation: Hit_ID=A7IIH6; Match level="QueryCoverage=100%, HitCoverage=67%, E-value=2e-85, Identity=67%"; Hit description =Extracellular solute-binding protein family 1 precursor
MSKIPNAVNLVQQAKVSPYHLGVWGYVYTIGYRPDLVPKGETFTSWNDLWKPELKGTLALPDWDPSHIIAVAAKLSGSDAAHWQQGQAKLKALIPNIKSFYTDDANSQQLISTGETPVQVMLSMNAYSMIAEGVNIKLAIPKEGAILGVDTVGINKGSKHTDLAYKFINIALKPEIQQQVAKIYRGSPTVTNAHIDPELAKLPGMLTTPAQWNATINTDPQLRAEKTAEW

SEQ ID NO: 113002 - protein, 123 aa, Glycine max
  Coding DNA Sequence Number=SeqID_21317
LSEELRDYYEGRHRSHLRPHSHRREKERKPQEANIKLSYFDGKDNVEANLDWEIRVEQQLKKKSTSKSYGSHSYRKKDQGQGILGVTPSKPKDDKGKTIEKQASLKISTRRKGLLYKSFKCLG

SEQ ID NO: 113003 - protein, 179 aa, Glycine max
  Coding DNA Sequence Number=SeqID_21318
GILLQVIKPTRTTKEEEEKKAYDEHLFESINHPLHHPYTGSLVPLMIILCVLSGLESGYTLHMMDPAGGQPAANPAAEQPSNVPSGASTSGWRSFEEGVLLESSNESSEASVNQQPVIPELEPPLLDDNTRRAELAVRLRANWWGIAYNERILDSFVRSQLAIERHIEAALVADGYSPQ

SEQ ID NO: 113004 - protein, 35 aa, Glycine max
  Coding DNA Sequence Number=SeqID_21319
MANLHPELSRHGSSMTRGQWWSPWRHDPCGSQEFN

SEQ ID NO: 113005 - protein, 169 aa, Glycine max
  Coding DNA Sequence Number=SeqID_21320
  Homolog annotation: Hit_ID=A5BKB9; Match level="QueryCoverage=28%, HitCoverage=4%, E-value=1e-07, Identity=55%"; Hit description =Putative uncharacterized protein
MRLKNQGSHLVHYISHQGNQVAGKKFMKKHDKGKGSLKVNDDSLQIQKKGFLTIQIISPNEKFIFMGNRVKAPVEAVGTYCLKLDIGHHLDLLETLYIFMDLNICLDCIKQNIQRKELQEALSFLKLCTLIFVDLLMLVLSKRKDTSSPLLMIIHVTVMSTYCMRNLRQ

SEQ ID NO: 113006 - protein, 241 aa, Glycine max
  Coding DNA Sequence Number=SeqID_21321
  Homolog annotation: Hit_ID=Q2HW90; Match level="QueryCoverage=73%, HitCoverage=35%, E-value=1e-20, Identity=32%"; Hit description =Putative uncharacterized protein
MEPIASLAQYYDQPLRCFIFGDFQLSPMVEEFEEILGCPLGGRKPYLFSGFYPSLARISKKVQISAQELDRQRQVENGVVGIPRKYLEVKARILADKGEWTPFIDILTLLIFEGVLFPNVDGLVDLAAIDVFLAYHNHKESPVVAMLADLYDTFDRRCEESNARIVCCTPTLYVGLVSHLFLQVGRPVYPLQGHRSCVEKGKANWDQLLASMGGRLLIGSLARRKEESRFYLHAKDVQMFP

SEQ ID NO: 113007 - protein, 141 aa, Glycine max
  Coding DNA Sequence Number=SeqID_21322
MYPLLVPQRMYPPMCQDKDLREREESKEFSDSVILNSLTREKGDTKEFSRLVNCSFGKGRRETQKEFRRLVLGEFFLAEGEENEKMNSTSFQGLENQKTLESFWYKEEEEVQRDSRLVKDCKRLIGKVFKIIEMQNKTLLL

SEQ ID NO: 113008 - protein, 116 aa, Glycine max
  Coding DNA Sequence Number=SeqID_21323
  Gene Ontology: Mol. function=sucrose transmembrane transporter activity; Cellular component=integral to plasma membrane; Biological process=sucrose transport
  Homolog annotation: Hit_ID=A3DSX4; Match level="QueryCoverage=61%, HitCoverage=13%, E-value=6e-15, Identity=54%"; Hit description =Sucrose transport protein SUF1
MAVGNILGHATGSYSGLHNISPFTKTKACDVYCANLKSCFFLSIALLLTLSTLTLSYVKEKTVMTSVDVDDGGGTVPKTMREGFKGFWGASQTLTCGSQRHCLTVNIQLRCPGPTL

SEQ ID NO: 113009 - protein, 116 aa, Glycine max
  Coding DNA Sequence Number=SeqID_21324
  Subcellular localization annotation: CTP_CleavageSite=75; ConfidenceScore=5.38e-01
MDDGYRLLSPTSSATERLTTTCRSSLLALLPGTFVFYLLQPSGRISLFRSPVLLSLRKCTTAFLPTTNLEEEVIVLSYLSGGVGFMWSVIMLEVVKGLKEVCKEGDDEDLLETSLV

SEQ ID NO: 113010 - protein, 64 aa, Glycine max
  Coding DNA Sequence Number=SeqID_21325
MSSSQLVYYYGGSFITGDNRELGAVEALIVVTVQKGTLAHQLGSWEYNQPSPTTIAVASSWQFK

SEQ ID NO: 113011 - protein, 91 aa, Glycine max
  Coding DNA Sequence Number=SeqID_21326
  Gene Ontology: Biological process=transposition, DNA-mediated
  Homolog annotation: Hit_ID=Q1J7G7; Match level="QueryCoverage=36%, HitCoverage=47%, E-value=4e-11, Identity=93%"; Hit description =Transposase
MVKVGTSYVPINVSFSPKVGPGLPGINRDPQDLFILRSDLPSQVLQWLLFLSAVPPVQLLTGWCVTAKTPPDISAGKCSGHPARNHHTRRA

SEQ ID NO: 113012 - protein, 126 aa, Glycine max
  Coding DNA Sequence Number=SeqID_21327
MARRDQVWSFCTHDTRRYLTVIRTPLPFRHSRVRWHAETKFGHSAPMIRGDTLRLSAPLCHSDTVVSDGTQRPSLGLTQSSAPFVPPGITKSFTCGNFMVARDSRQPRGAKLVSYTDFRGPLLDDM

SEQ ID NO: 113013 - protein, 203 aa, Glycine max
  Coding DNA Sequence Number=SeqID_21328
MGSKIYPKVHDNPRAFFNSSSLILLEPLAHGSGRHRSNLRPHSHRRENERKPQEANINLPYFHEKDNVEAYLDWKIRVEQQLKRKSTSKSYGSHSYQKKDQGQCIFGVTPSKPKDDKGKIIEKQPLKASMQEKTSSIKFFKCRGKGHVTSQSPTKKIMIMRVQDIYSSQDEATTSSSSSESEEAKGKNLVKKFTPKRRTTFYG

SEQ ID NO: 113014 - protein, 190 aa, Glycine max
  Coding DNA Sequence Number=SeqID_21329
MPKCQLVYAILTRMSIHVAQLIADAIYIFAGMAPTRHPLDPDKSNRALGFPALITGLCQSFGVPVAPTKVIRPPITRAFIEKYCTQRQGQGDAPQAAGAPPPPHQAGQAGAFDMEQYLRHLMSLSMQSQGFAPFSCPTPDQFRAEVAWPGDWPEAQAGETPPEAPGDGEEAHEDEEMADLLDFLGGSGDT

SEQ ID NO: 113015 - protein, 126 aa, Glycine max
  Coding DNA Sequence Number=SeqID_21330
VSEAKKKKGFRSKEEERFRGFGSKEAEGVSLRFKEVFTKYKAKTRKRTSSYWAIRTGVWTSRSRGSKSSGLSVISEQIFTKSVRFRVMWITVLGSGYVCMQGSQIIYTNPYTLKVPSAERNEYARR

SEQ ID NO: 113016 - protein, 55 aa, Glycine max
  Coding DNA Sequence Number=SeqID_21331
MNPKRIKVIPEWSIPPCVEGRSPKYEEPRDLRSNPFQGGGMRQSYPQGHWVEDSK

SEQ ID NO: 113017 - protein, 113 aa, Glycine max
  Coding DNA Sequence Number=SeqID_21332
  Subcellular localization annotation: CTP_CleavageSite=45; ConfidenceScore=5.00e-01
MTVKTSDNMQLPETVTACLCVRRKYRIRRHSPFRLRNCWEGRSVRASSLLRQLAKGGCAARRLSWVTPGFSQSRRCKTTASAKLACLQVDSRGSLQFTRCLLPARGFSSSSKG

SEQ ID NO: 113018 - protein, 111 aa, Glycine max
  Coding DNA Sequence Number=SeqID_21333
TNLVSTDLAKSLKACIYVIKGRSNRGFSFPYQEVFLTNKEKNKMEDCKNTSGEDVSFTSRISQSLTNSSQALKLALASSSGSLQIFTQQNLSNSLDHKGILDLSLSRNQIH

SEQ ID NO: 113019 - protein, 137 aa, Glycine max
  Coding DNA Sequence Number=SeqID_21334
  Homolog annotation: Hit_ID=A2Q274; Match level="QueryCoverage=72%, HitCoverage=62%, E-value=2e-08, Identity=34%"; Hit description =Ovarian tumour, otubain, putative
MDSWGTLVDCPSEQQFPEHLQKFQVTCFPWSMFDDYVESSHWDMKKVLQNSLGDLCSVWNVMNNMMTLQHTQIKASFETILRYTLNEIAYEFEHVRYFGNNPSSCSCVLRTTLSLPCACEIQRYDGGNIPLDAVHMY

SEQ ID NO: 113020 - protein, 52 aa, Glycine max
  Coding DNA Sequence Number=SeqID_21335
MEDRVTTDRSSSLPALDEQRTSLQGTLISQFVKLCDMPELKRKHRCTIHEVP

SEQ ID NO: 113021 - protein, 158 aa, Glycine max
  Coding DNA Sequence Number=SeqID_21336
MTLLFPEEQKVQKTVSAPACYQAFCLTDSKRMGANNHKQRGADNRKVSPRIIMIKLGLCLPSDTTVSEWQRGADNRKVSPRIMGISAYHGCRMTKLGLCLSSGPPPLDDKRVRITVRCLRGLPALESWHKGGVVDKSEALAPTYPPMRNSDYVVLDNW

SEQ ID NO: 113022 - protein, 300 aa, Glycine max
  Coding DNA Sequence Number=SeqID_21337
MGTRGCINYNLVLAIRQLGYPMRGAPSEEGLTPFIARGFNSPNAGVLQGVNKAWEMVPKKDKELRGSSNRAVGGYRRWLRATKEVEVEALEEGEEVQALRKKLEKAQAVKEKFKSAIVRIRKENAELRGVNIATTKALEQETKRARKEEHGRNKFRGALWGSNSKLKLQREERDQSRIDGMILKDELKTFLKSKRSLSQRLSETETNMLAIISKYKEELDLATAHEHGVADEYARVYAEKEARGRVIDSLHLEATMWMDRFALTLNGSQDLTRLLAKAKAMADAYSAPEESTGSLAIVSI

SEQ ID NO: 113023 - protein, 224 aa, Glycine max
  Coding DNA Sequence Number=SeqID_21338
  Homolog annotation: Hit_ID=UPI00016621D1; Match level="QueryCoverage =99%, HitCoverage=40%, E-value=2e-16, Identity=33%"; Hit description =UPI00016621D1 related cluster
GIHALTVRGLQVLAFRGLHVLTFRGIHAFAFVGLDVLKFRGLHVLAFKGLYALAFRGQHVLTVRGLYVLTFRGIHALTFRGLHVLHFRGLQVLNFRGLHVLTFRGLDDLKFRGLHVLTIRGLRVLAFKGLYALAFRGLHAFALRGGLHALTFRGLHVLAFRGLHDLTFRGLHTLIFRGLYVLTLKGLHVLAFGGLHALAFRGLHVPLFRGLHALAFRGQHVIAF

SEQ ID NO: 113024 - protein, 160 aa, Glycine max
  Coding DNA Sequence Number=SeqID_21339
  Pfam annotation: Domain name=zf-CCHC; Domain location=87-104; Score =22.6; E_value=0.00058; Accession=PF00098.14; Description=Zinc knuckle
MKREKHASYSSHNSCKSLSEELRDYYEGRHRSHLRPHSHRREKERKPQEANINLPYFHGKDNPKDDKGKIIEKQDPKASMQEKTSSIKCFKCLGRGHITSQCPTTKTMIMRGQDIYSSQDEATTSPSTNENEEAIGEESREEIYPQEEGQPLMVKEECKE

SEQ ID NO: 113025 - protein, 177 aa, Glycine max
  Coding DNA Sequence Number=SeqID_21340
SESWLLKTIRVANFCSWDRECAELIGETADDVNRVKIEDGDLDLNASPQALDKLLGHVLAFKVRIQSKLKNAVVLRYSKDLDLINAVLERLPDSEACSKIDPSNVDCNNATHAECFMLYEQSLSVTADHDPVAGLPLTPKKRMSSDEVDDELGSSQISPAQLSSNKLTRHSHKSQFS

SEQ ID NO: 113026 - protein, 94 aa, Glycine max
  Coding DNA Sequence Number=SeqID_21341
MAKFDPDIVLEFYANAWPTEEGVRDMRSWVRGQWIPFDADALSQFLGDPLVLEEGQECKFSQRRNKADGFDEEAIAQLLCIPGQDFARTAAGRR

SEQ ID NO: 113027 - protein, 99 aa, Glycine max
  Coding DNA Sequence Number=SeqID_21342
MLQSIHRGQIILLQSLQVVAPPGSIPSVEQFTEMVAWPGTQPSLHREDEEPLVRRKKADKTQEVAATSEKSLLATSEPSEPVADTTSLQQAANPSTPED

SEQ ID NO: 113028 - protein, 17 aa, Glycine max
  Coding DNA Sequence Number=SeqID_21343
GAKYFKAVNQRLHAIKQ

SEQ ID NO: 113029 - protein, 56 aa, Glycine max
  Coding DNA Sequence Number=SeqID_21344
GVRIDKLAPFLMNLTTHTPRDIGIRSFFDPFGEVVYHHKDEAVTIRSLGFDGPVIP

SEQ ID NO: 113030 - protein, 104 aa, Glycine max
  Coding DNA Sequence Number=SeqID_21345
MRGWPNLRNTWRCDKGRRRNHLFKTHMGRATSSRTHKTFGGQGIGGLESTHLERARNKCSNTSRHWRFSQQISSPTTSYNTLTIHMPRQAIDVKKHLLGGNLTF

SEQ ID NO: 113031 - protein, 191 aa, Glycine max
  Coding DNA Sequence Number=SeqID_21346
IHVAQLIADAIYLFAGMAPTRHPLDPDKSNRALGFPALITGLCQSFGVLVAPSKVIRPPITRAFIEKYCTQRPAQGDAPQAADAPPPHQAGPAESFDSEQYLRHLVRQQAANHRVHVQTHDCLYQPSLSLQSQGFTSFPCPTPDQFRAEVAWPGDWPEAQAGEAPVEAPDEAREDEEMTDLLDFLGGSGAT

SEQ ID NO: 113032 - protein, 83 aa, Glycine max
  Coding DNA Sequence Number=SeqID_21347
  Subcellular localization annotation: CTP_CleavageSite=34; ConfidenceScore=5.29e-01
KNARSIFRLTPQPPPSPLNFVFPSQPLFSRRPPNMSQKNDDLGHIHRWIVVKFKHQVRNPIPRILTIVNFKIMSELRGKPFAL

SEQ ID NO: 113033 - protein, 131 aa, Glycine max
  Coding DNA Sequence Number=SeqID_21348
MSMDYDEEDCEEDIDRRGLCASSATSSAFLHTLSIHGCHMMTWMILGRITQTIWRQQVIYVLCQPNHIPHEATPASTHADLDADEPRHVVEACHAIAEALEQHLNAPGTSTHEEVIQKCLRIAKGVTEDRN

SEQ ID NO: 113034 - protein, 79 aa, Glycine max
  Coding DNA Sequence Number=SeqID_21349
MTGRLLAGSLALKAASCIISLCVFCFHDLPTLPRSFLIGAAVIASFGYRKEHDGSWVKKGAQPADDEGNLPVEDNSSLL

SEQ ID NO: 113035 - protein, 90 aa, Glycine max
  Coding DNA Sequence Number=SeqID_21350
MDYVIRKAPYITERKQDRYEIVSFRTLRKRSPKKAGGVLSKNGRQIATRPTWALQKIPPEGCCFWRKQPCSPGRAGWQASPPIFYKYGEK

SEQ ID NO: 113036 - protein, 297 aa, Glycine max
  Coding DNA Sequence Number=SeqID_21351
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPEDERWQAAQLLGRAIGAGLFAITPAGERGMCCKAIKLGNARVFPEFDSNIFGKVDNKGNSALHLAAKLGDYKPWLIPGEALQMHWEIKWYLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 113037 - protein, 164 aa, Glycine max
  Coding DNA Sequence Number=SeqID_21352
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=75%, E-value=4e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASAHPPAVLLPLRTTPSVAEQEGQLIETEATGAPQKHHHTLNQ

SEQ ID NO: 113038 - protein, 70 aa, Glycine max
  Coding DNA Sequence Number=SeqID_21353
MGTPKGTENELKSLISGTYQLKTEERRRTNNERQRTVENLREITHGNVTKAPRLGFSSPKQFSSLILSDY

SEQ ID NO: 113039 - protein, 112 aa, Glycine max
  Coding DNA Sequence Number=SeqID_21354
  Subcellular localization annotation: CTP_CleavageSite=74; ConfidenceScore=5.33e-01
MKSMKYLLFSCDSVLIGPQTSICISSNRSFTLQAPLVEKGNRCCLPRRHPSHTSLFSFMLGRSLIMFFSCNNFKASSEARLTGALSKGGRCTESPPTFIVENVGKTKGNRSK

SEQ ID NO: 113040 - protein, 239 aa, Glycine max
  Coding DNA Sequence Number=SeqID_21355
  Gene Ontology: Mol. function=transcription factor activity; Cellular component=intracellular; Biological process=regulation of transcription, DNA-dependent
  Homolog annotation: Hit_ID=A1R2D6; Match level="QueryCoverage=97%, HitCoverage=76%, E-value=5e-44, Identity=41%"; Hit description =Putative LacI-family transcriptional regulator
  Pfam annotation: Domain name=Peripla_BP_1; Domain location=4-223; Score=-50.4; E_value=0.011; Accession=PF00532.12; Description =Periplasmic binding proteins and sugar
MLDKRVDGIIVAPCSSLFEDNEHLRQVLAEGRSLMMFDRAVQGMEVETIQANFVAVAKQATELLLAAGHQRIAYLSSMRSAAPYSPSITLGPTPVAQRVSGMIDAYRAAGKELDPALIRLNALSEAIIEQILTELLALAEPPSALIASDNLIAMGILRGLAKRGLRVPEDISFVMYDDFPWTELMSPPLTVVAQPVYEMGREAARRLICHIRQQSAGALPAFDSWMVVRGSVGENPSAR

SEQ ID NO: 113041 - protein, 95 aa, Glycine max
  Coding DNA Sequence Number=SeqID_21356
  Subcellular localization annotation: CTP_CleavageSite=23; ConfidenceScore=5.37e-01
MVTPPRSPPQSDGNSEPQPKKTRQSTRLRRLTLRRLDQPRPIVNVDPATGRASGPEKQKFHSFLGVVAREKIPIVHSNWKNVPETLKDMVWGDIL

SEQ ID NO: 113042 - protein, 196 aa, Glycine max
  Coding DNA Sequence Number=SeqID_21357
  Homolog annotation: Hit_ID=A5AZG1; Match level="QueryCoverage=43%, HitCoverage=27%, E-value=9e-07, Identity=34%"; Hit description =Putative uncharacterized protein
  Pfam annotation: Domain name=zf-CCHC; Domain location=132-149; Score =8.2; E_value=0.087; Accession=PF00098.14; Description=Zinc knuckle
MKREKYASYSSHNSCKSLSEELRDYYEGRHRSHLRPHSHRREKERKPQEANINLTYFHGKNNVEANLVWEIRVEQQLKKKSTSKSYGSHSYPKKDQGRGILGVTLSKPKDDKGKTTEKQVPKVSMQEKTSSIKCFKCLGRGYITSQCPTTKTMIMRGQDIYSSQDKATTSPSFSESEKAKGEESSEEMYPKKKDNN

SEQ ID NO: 113043 - protein, 21 aa, Glycine max
  Coding DNA Sequence Number=SeqID_21358
MELPTALPENNNCLTTTMLEA

SEQ ID NO: 113044 - protein, 170 aa, Glycine max
  Coding DNA Sequence Number=SeqID_21359
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=100%, HitCoverage=34%, E-value=5e-82, Identity=72%"; Hit description=DNA -directed RNA polymerase subunit beta'
  Pfam annotation: Domain name=RNA_pol_Rpb1_2; Domain location=59-137; Score=49.5; E_value=1.1e-11; Accession=PF00623.11; Description=RNA polymerase Rpb1, domain 2
STPGELVMCQEKLVQEAVDTLLDNGIRGQPMRDGHNKVYKSFSDIIEGKEGRFRETLLGKRVDYSGRSVIVVGIAKSKIREKEPIVWEILQEVMQGHPVLLNRAPTLHRLDFDGDQMAVHVPLSLEAQAEARLLMFSHTNLLSPAIGDPISVPTQDMLIGLYILTSGNRR

SEQ ID NO: 113045 - protein, 48 aa, Glycine max
  Coding DNA Sequence Number=SeqID_21360
MVKYHVKSKTEMNRGARGRVRMDTRPVVNKSLSRVWLHTIEKRYVEAA

SEQ ID NO: 113046 - protein, 216 aa, Glycine max
  Coding DNA Sequence Number=SeqID_21361
MAERNSRGALWGSNSELKLRREERDRSRVHGMILKEELAVCARSKRSLAQHLEATEQSMLAIIGQYKEELNQSVAHEQKLVEDFAQVYAEKEARGRGPDDALHQEATMWMDRFALTLNGSQDLPRLLAKAKAMAEEQMKADLSALKDQMASISEVMLKLQKTIEDKATATASNTVREAEPVLQPALNPSRDRNTAMFGRRYSPQAYPYGLPSDFTP

SEQ ID NO: 113047 - protein, 101 aa, Glycine max
  Coding DNA Sequence Number=SeqID_21362
MAKMQGPKDGKIYSNINKEERTQPWSVGSEIYPGIHKNPKAFFSSSSQILLESFIQYPCGVGLHQYVRLWWLQDIYQTRAYLLHLLGYTHFANKSATHFHV

SEQ ID NO: 113048 - protein, 203 aa, Glycine max
  Coding DNA Sequence Number=SeqID_21363
  Homolog annotation: Hit_ID=Q53MV9; Match level="QueryCoverage=46%, HitCoverage=34%, E-value=7e-08, Identity=40%"; Hit description =Putative uncharacterized protein
  Pfam annotation: Domain name=DUF1723; Domain location=145-194; Score =40.1; E_value=7.8e-09; Accession=PF08330.1; Description=Protein of unknown function (DUF1723)
MSQEQSVPFAGKWHHFTVRTDGEKVVPEPHGDAEQTEAWESEVMIPFAVERTVYAFGGPLPDQESLSSAMNKVFPCYPTCEPRIFDSEPYNFNCLSKPHKLFRSAPSIAHRDYLPWLDRVEQAYEDFWKTYGIFDLIQFSRSGPEYRPEMLIAAMHFFESSTNTFQFKCGMMTPTLLDVAALTGLRPSGETYDPTNSSDNIKL

SEQ ID NO: 113049 - protein, 104 aa, Glycine max
  Coding DNA Sequence Number=SeqID_21364
MKQKPPTLIPKTIPKLQNSLRIWKYHGFSLKACSELQNKERETRLKRAIKGINSRTHQQESSQGYCASNQWGKTHQMIIMMDGSNSHKGKIITFKLSFQNYHDM

SEQ ID NO: 113050 - protein, 52 aa, Glycine max
  Coding DNA Sequence Number=SeqID_21365
MCNCVIDYQEAVIDYQSMVVEWRWKKDDWRHYFKEKMIQEEAHHYRKSWIRA

SEQ ID NO: 113051 - protein, 127 aa, Glycine max
  Coding DNA Sequence Number=SeqID_21366
MAHNNILNITNPSMVYAASGQHDLKVASEEMGQQTCGPTLSATKVYVRRKEVLRGNSKAQQFEKSIVDFNLASKIDPLPSLHEDSIELQCALLKEMGLTYGEDDNKAAGGLLCLWNNSIFEVDRREK

SEQ ID NO: 113052 - protein, 104 aa, Glycine max
  Coding DNA Sequence Number=SeqID_21367
DPNARMFQRVRKAWSAVQRKDKELRGSSNGIIGGYHKWLKARTQEITWLPKLKISSEEEVETPEDSEEVQALKGSNSELKLRRAERDQSRVKGMILKDKLKACP

SEQ ID NO: 113053 - protein, 79 aa, Glycine max
  Coding DNA Sequence Number=SeqID_21368
MTDVIHNQWHLIYSMHYKKIFPNKGHPPQLLPGKGRSRAAEPPQGEAMHQVLLVYHFCYRILMVYNDGGFFLFSLTCLE

SEQ ID NO: 113054 - protein, 92 aa, Glycine max
  Coding DNA Sequence Number=SeqID_21369
MPMLDQFHLFIHDSIENIVNVKANGMGEDSWLLVHNHLLKELDKWSDEYINLLGSIDKFEKLKRSLLVDGLSIVTMDKWMDMRHEISHCIKV

SEQ ID NO: 113055 - protein, 138 aa, Glycine max
  Coding DNA Sequence Number=SeqID_21370
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=3e-25, Identity=66%"; Hit description=LacZ protein
  Subcellular localization annotation: CTP_CleavageSite=32; ConfidenceScore=5.18e-01
MTMITPSSKLTLTKGNKSCPGDPLVLERPPPRWSSNSPYSESYNNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 113056 - protein, 48 aa, Glycine max
  Coding DNA Sequence Number=SeqID_21371
CSTLEGACAGAAAGATGTLGICGSTYVSSYVIGGCLAGSAGCAGVMNG

SEQ ID NO: 113057 - protein, 94 aa, Glycine max
  Coding DNA Sequence Number=SeqID_21372
MKGNQQRVPVESPTVATYPSAGGRRVTRGMRVPRKEYARSRHQCLFEENVGKTGKDAIYELFSERFGSCIYARGRVFPFAPTCSSICDEEIRPT

SEQ ID NO: 113058 - protein, 84 aa, Glycine max
  Coding DNA Sequence Number=SeqID_21373
MTIQNMQFQQETRASIQSLTNQMGQMATQLNQAQSQNSDKLPSQTVQNLKNCLHQWAAPTPEPIKRHSTPEKEDEIVALKRNLP

SEQ ID NO: 113059 - protein, 48 aa, Glycine max
  Coding DNA Sequence Number=SeqID_21374
MSSTQWSGHFVAFTGKSFFPTQLGPNLWYYMQESKGNEGAKELWHEPW

SEQ ID NO: 113060 - protein, 217 aa, Glycine max
  Coding DNA Sequence Number=SeqID_21375
  Gene Ontology: Biological process=transposition, DNA-mediated
  Homolog annotation: Hit_ID=Q1J7G7; Match level="QueryCoverage=17%, HitCoverage=67%, E-value=2e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIWTRLSLDSKGVDNREVSLHAIGLDCLWIEKLLFPLVRVNFELGVIMVIAVSFGKPVVPAALMNRPTRGERRFAYWALAECILAYYVGTDEGVSEVLHVAGEKRLH

SEQ ID NO: 113061 - protein, 193 aa, Glycine max
  Coding DNA Sequence Number=SeqID_21376
LSEELRDYYEGRHRSHLRPHSHRREKERKPQEANINLSYFHGKDNVEANLDWEIRVEQQLKNKSTSKSYGSHSYPKKDQGQGLLGVTPSKPKDDKGKTIEKQAPKANIYRSQDEATTSPSSSDSEKAKGEESSEEIYPQEEGQPLVVKEKCKEALASIATPLGLEFIPQVKKLLDEGLVHKSLNPCALLVPKI

SEQ ID NO: 113062 - protein, 67 aa, Glycine max
  Coding DNA Sequence Number=SeqID_21377
MNIEESIHVTFDESNAILSRKNMLDDIAESLEQMHIHGQDSKGKDYFAPKESLNEEGIDYEETYSSS

SEQ ID NO: 113063 - protein, 230 aa, Glycine max
  Coding DNA Sequence Number=SeqID_21378
  Gene Ontology: Biological process=transposition, DNA-mediated
  Homolog annotation: Hit_ID=Q6UUU1; Match level="QueryCoverage=26%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLTNVHDLTVAICDMSFVGKPVVPAALMNRPTRGERRFAYWALAECILAYYVGTDEGVSEVLHVAGEKRLHRCVSRICDTGYIPLPRSLTRYARSFDCGERKWLTNGAEISWRCQEDT

SEQ ID NO: 113064 - protein, 157 aa, Glycine max
  Coding DNA Sequence Number=SeqID_21379
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=1e-25, Identity=56%"; Hit description =Putative uncharacterized protein
  Subcellular localization annotation: CTP_CleavageSite=51; ConfidenceScore=5.34e-01
MTMITPSSKLTLTKGNKSWFPLISKQLLPRKDLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 113065 - protein, 217 aa, Glycine max
  Coding DNA Sequence Number=SeqID_21380
  Homolog annotation: Hit_ID=Q6UUU1; Match level="QueryCoverage=23%, HitCoverage=34%, E-value=4e-13, Identity=74%"; Hit description =Putative uncharacterized protein
GHQDLFFCEVISVTGIYSAQSASAVPPVQLLTGWCVTAKAPPDISAGKCSGHAARRVPFAIQAAQLLGRAIGAGLFAITPAGERGMCCKAIKLGNARVFPVTTLEVGHRKALSDILTAIKLIDTVDLEGGPVGKPVVPAALMNRPTRGERRFAYWALAECILAYYVGTDEGVSEVLHVTREKRLHRCVSRICDTGYSPLPRSLTRYARSFDCASGNG

SEQ ID NO: 113066 - protein, 87 aa, Glycine max
  Coding DNA Sequence Number=SeqID_21381
KIGEELASQFAQASQVASSKSNRLLEEHPGRPKWAWIHDVGYNVQDILPENTGVVAQCTRQDKRIEAAGSTMSDTMSRTSCPKILDT

SEQ ID NO: 113067 - protein, 188 aa, Glycine max
  Coding DNA Sequence Number=SeqID_21382
  Homolog annotation: Hit_ID=A5C922; Match level="QueryCoverage=46%, HitCoverage=33%, E-value=2e-07, Identity=33%"; Hit description =Putative uncharacterized protein
MAQPPPRERTLREMAAPDFTYESLCIQYPDEDVPYVLKTGLIHLLPKFHALREWQRTGLYYLAPRSITSWDDLKRVFLEKIFPAPRTTAIRKDISSNMERSMIDAASGGALGDMTPTEARNLIEKMASNSQQFSARNDAIVIRGVHEVATNPSASSETKKLEGKLDALVNLVTQLALNQKFVPVARVC

SEQ ID NO: 113068 - protein, 225 aa, Glycine max
  Coding DNA Sequence Number=SeqID_21383
  Homolog annotation: Hit_ID=Q6WAY6; Match level="QueryCoverage=55%, HitCoverage=21%, E-value=1e-14, Identity=36%"; Hit description =Putative uncharacterized protein
SHLFRQEVRHASPLESYRSCTEKGGANWDQLLASKEGASVNWFPQWKEGRTEVLISCGGFPNVPLMGTRGCISYNLVLAIRQLGYPMRGAPLEEEIVPVISGGFNKTNVETLQKVRKAWEVLQNKDKELRGSNNGPIGGYRKWLKAHMQGLDWLPSLRTAKREEDEAPEEDEEVQALRMELKQAQTVKERFKSAALKIRKEECRTERYKYSYHQGFGNKRPRGAR

SEQ ID NO: 113069 - protein, 107 aa, Glycine max
  Coding DNA Sequence Number=SeqID_21384
VKRALCAKPKGHSDEAELSAPCYAKPRPSSILKIMHQRRERHLPHLPRSDMTDPGSLLLIHISPALIFEDIMPSTPAMEPEKPILQDTPAAPVLDLNEDQPQDEQDV

SEQ ID NO: 113070 - protein, 87 aa, Glycine max
  Coding DNA Sequence Number=SeqID_21385
  Homolog annotation: Hit_ID=A4EB57; Match level="QueryCoverage=73%, HitCoverage=56%, E-value=7e-17, Identity=52%"; Hit description =Putative uncharacterized protein
MQSEEPTRADMRDPLKERGAFGNADTGGAWLSSARATAGDKPEEGEDDVKSSCPLCPGRHTCYNGRDKGSRSREGELTPKTRPQFGL

SEQ ID NO: 113071 - protein, 246 aa, Glycine max
  Coding DNA Sequence Number=SeqID_21386
  Gene Ontology: Mol. function=nucleic acid binding; Cellular component= ribosome
  Homolog annotation: Hit_ID=A2Q6B4; Match level="QueryCoverage=87%, HitCoverage=86%, E-value=5e-21, Identity=28%"; Hit description =Ribosomal protein L33; Nucleic acid-binding, OB-fold
  Pfam annotation: Domain name=DUF223; Domain location=49-145; Score= -13.3; E_value=0.052; Accession=PF02721.5; Description=Domain of unknown function DUF223
MARIDDKIKSIDGSKETLKLAVRITKLWFVGTPGRSEQAEMIIVDSDPLVRYFYDSQGDQIHVVCKQDQLKTWKMDLKEGCTYVMHNFRVSKNDGQYRVCDHPYKLTFIEVTVVRQCELDGLPFKNYRFADFSDVVASQLQSGLLVDIIGVVDEVVFRHISSRSKRVVFKLMNLSNQLLSCTLWDDHCLQFLEYLDQHETERPIIVLLTNARIKEGQGSYPSSVSNSLKASKLTINQPVAPIEEFN

SEQ ID NO: 113072 - protein, 130 aa, Glycine max
  Coding DNA Sequence Number=SeqID_21387
VRAKKALLGGPEPSVRYHSGRARILTFVPGLRAEGQSQVPKEVNRFRTQGAPAFSGKARRLQDEIGYLVETDGAEVENRAVARRIKVTLGIIRQNASPRAHSTGRFGTSMSALRHLGAVVMFQGLALFAH

SEQ ID NO: 113073 - protein, 183 aa, Glycine max
  Coding DNA Sequence Number=SeqID_21388
  Gene Ontology: Mol. function=nucleic acid binding; Cellular component= nucleus; Biological process=regulation of transcription
  Homolog annotation: Hit_ID=A2Q246; Match level="QueryCoverage=98%, HitCoverage=72%, E-value=2e-83, Identity=86%"; Hit description=CENP -B protein
NSTCDAGIIRAFKMHYRRRFYRKILEGYEVGQSDPGKINVLDAINLAIPAWTIDVRKETIENCFQHCKIRSTSDVARNLDESTFDEETQDFETMINQWGYRNKMDIDNLMNYPGENEACLEVQSLEDIVGTIIENNAEDDNEDDTMSLEPVTRNEALMASNTLHNFMIQYKNTTPELLDAIRK

SEQ ID NO: 113074 - protein, 165 aa, Glycine max
  Coding DNA Sequence Number=SeqID_21389
METCPAVEELLQRLMDCGQLEVSIGGREEPHICMQSEEKKVPLTPKAIVICFTRKGTGSTPIYPRAAPKLTPFAYQSNKAVPWKYTPPASSERIATEVDSLSAKVTNITGLSGVTRSGRVFASPHPEELPSKGKAPMVQEPTDIATPSKEVDPPVVRGRTPYQSV

SEQ ID NO: 113075 - protein, 256 aa, Glycine max
  Coding DNA Sequence Number=SeqID_21390
  Pfam annotation: Domain name=Transposase_23; Domain location=19-88; Score=-10.8; E_value=0.018; Accession=PF03017.5; Description =TNP1ENSPM transposase
PRVSTKESYVDPSGNDPETGDSDKCRLYIEANPPRPVALGRVYEGSTVHNIPLLSSQVKVGVEEVRDAQALVPVSTDEVTLVGQALNTFLAWLTHLVKPLSEQAAVSLAKPPQRLDPEVDDQLYLMTLTIPDLEAFPDFPLYIKHEDLSEITHGGQCLSISVLQLWILSGQSQFDTESYIKSWMQSSKRDVYLGAYLNGHWQMVVILPKENLVVWFCSLHNRPDNYLKGITNSTLKGLDDTPQPKSKAAARWIVVK

SEQ ID NO: 113076 - protein, 98 aa, Glycine max
  Coding DNA Sequence Number=SeqID_21391
EFYANLYDLKDKSPKQELAAKLCIPGRGFELNADEQPLKILRKNMTTLAQTWSVLSFSNSIPTSHTSDVTLDRDKLIYGIIMKMDMNVGYTYNSGGGG

SEQ ID NO: 113077 - protein, 130 aa, Glycine max
  Coding DNA Sequence Number=SeqID_21392
LEFIFFLNCLTVVPVSVCTRRSSVGELVPLDLEIEATFRRNNAERKRKLLHDRTVASILEEAHFSESSSSNSSTSRESQTAEFEVEVMAEEQPRRVTLEDYSSTFVPQYFLSVAQPEVQAQNLTYPPSLI

SEQ ID NO: 113078 - protein, 132 aa, Glycine max
  Coding DNA Sequence Number=SeqID_21393
  Gene Ontology: Mol. function=oxidoreductase activity; Biological process=metabolic process
  Homolog annotation: Hit_ID=B0J3R6; Match level="QueryCoverage=78%, HitCoverage=35%, E-value=2e-32, Identity=63%"; Hit description =Alcohol dehydrogenase GroES domain protein
  Subcellular localization annotation: CTP_CleavageSite=31; ConfidenceScore=5.49e-01
MVIISGRALGCAMNISNAAGLRQGRRSPSSLAARRGARVIAISRRPFSLEVAHRMGATELVEMDDHWRIIECVRQLTDGRFCDRVIEAVGKQWPLDLAGELTAERGRLIPLSRLSPGRAPPDQYAIVELARA

SEQ ID NO: 113079 - protein, 107 aa, Glycine max
  Coding DNA Sequence Number=SeqID_21394
MCNTCCNFDVPSTCTTKDVPSNVLRQRSQAVKPLILCEWGYKRILRRKKGDTKEFRRLVLYSFGNGRRETQKEFKRLVLGKFFLAKGEGNEKINSTSFQGLENQKTS

SEQ ID NO: 113080 - protein, 131 aa, Glycine max
  Coding DNA Sequence Number=SeqID_21395
  Gene Ontology: Mol. function=Rab GTPase activator activity; Cellular component=intracellular; Biological process=regulation of Rab GTPase activity
  Homolog annotation: Hit_ID=A7QEY2; Match level="QueryCoverage=58%, HitCoverage=15%, E-value=2e-25, Identity=72%"; Hit description =Chromosome chr16 scaffold_86, whole genome shotgun sequence
MTFNDDIQRRLLLNKVKTQLLEEAIQGVVLNHHGHAGKENMSLHLSNGKACLPRMGGVDPSIRAEVWPFLLGVYDLDSTKEERDAITTQNRKEYEKLRRQCRQLLKHSNGSFKLNEIGEINYEGDSASFIM

SEQ ID NO: 113081 - protein, 124 aa, Glycine max
  Coding DNA Sequence Number=SeqID_21396
  Homolog annotation: Hit_ID=A4W895; Match level="QueryCoverage=66%, HitCoverage=66%, E-value=3e-20, Identity=55%"; Hit description =Putative uncharacterized protein precursor
MTKLATLFLTATLTLASGSVLAAETGTSDNNGDANAAASAGQVAPDAKQNIAPNNVDNNQINTGNTNTGGTMLHPNGSGSGTMNHDNMSSPEVHKNSMCKDGKCPDPNDKVGNDANTKTDGTTQ

SEQ ID NO: 113082 - protein, 93 aa, Glycine max
  Coding DNA Sequence Number=SeqID_21397
MAPPLTSSPLSSAASPWGVQIAIRPTWAFQDVPIEGGAFWWKQPSLPGRAGWQPPPKSKPRRFRNASETFPWVISRRFSTVLHRSSSVFGLQP

SEQ ID NO: 113083 - protein, 68 aa, Glycine max
  Coding DNA Sequence Number=SeqID_21398
MEKEKHASYSSHDFCKTLSEELSDYYRGRHRSHPRRHSHRREKERKPEEANINLPYFHGKDNVEAYLD

SEQ ID NO: 113084 - protein, 101 aa, Glycine max
  Coding DNA Sequence Number=SeqID_21399
MHIVVVKQGQDHLGLPSEIETKRERQKPIKVGYLRTDASGDGVTTDRSLPLLSAKQAENVAARQPRILCILQLSFTICLFKKVSSPGRAGLAWASHPCTKL

SEQ ID NO: 113085 - protein, 76 aa, Glycine max
  Coding DNA Sequence Number=SeqID_21400
  Homolog annotation: Hit_ID=A0ST23; Match level="QueryCoverage=35%, HitCoverage=55%, E-value=2e-08, Identity=100%"; Hit description =Putative reverse transcriptase
MAQALTCVIKLIDTVDLEGGPVGKPVVPAALMNRPTRGERRFAYWALAECILAYYVGTDEGVSEVLSCGRRKKAAP

SEQ ID NO: 113086 - protein, 313 aa, Glycine max
  Coding DNA Sequence Number=SeqID_21401
  Homolog annotation: Hit_ID=Q6WAY4; Match level="QueryCoverage=91%, HitCoverage=59%, E-value=2e-31, Identity=28%"; Hit description =Putative uncharacterized protein
MQSFLKVYGKILDLTIAEISTEAVVSLTQYYDQPLRCFTFGDFQLVPTVEEFEEILGCPFGGRKSYLFSGFLPSLSKIAVVVRDSARELDRVKQTRNGIVGLPRKYLEGKARDMANQEEWVPFMDVLALLIFRVVLFPNMDGLVDLAVIDAFLAYHHSKESPVRRVDWDQHLAGIGGRTINWFPRWKEGKEEVLFSCGDYPNIPLIGMRGCINYNPALAIRQLGYPMRGAPAEKSLSHFLVRDFGVQSFKVIQRVHKAWEGPLRKDKELKGIRNGIIGGYHEWLKVCTRRLDWLFKLKIINEENFEAPEEDGE

SEQ ID NO: 113087 - protein, 87 aa, Glycine max
  Coding DNA Sequence Number=SeqID_21402
VEEEPQLLVVFVVTTAAAVVLEEEHMACLDQQHSGKEGQADVVVEDLPISDFDDSFNLDCICCLKGNNYSAAEGIAAKKDRELYGDL

SEQ ID NO: 113088 - protein, 44 aa, Glycine max
  Coding DNA Sequence Number=SeqID_21403
MLIDLMRSIFLRLNRQLWQNAVFHSFAKPSCWLSENLLSATFSG

SEQ ID NO: 113089 - protein, 319 aa, Glycine max
  Coding DNA Sequence Number=SeqID_21404
  Homolog annotation: Hit_ID=Q2HW90; Match level="QueryCoverage=44%, HitCoverage=26%, E-value=1e-15, Identity=38%"; Hit description =Putative uncharacterized protein
MASQEKWGPFADILALLIFGVVLFPNVDGLVDLAAIDAFLAYHHSKESPVVAILADLFDTFDQRCEKNSAQIVCCLPALCVWLISHLFQQDMRHSCPLQSYRSCAEKGRVDWDQHLAGIGGSAINWFPRWKEGKEGVIFSCGDYPNVPLIGTRGCAQGLKVIQRIHKAWRSPLRKDKELRGIRNGVVGGYHGWLRIHTRGLGWLSKLKVVDEEKFEAPEEDEEVRALKLELGKARLAKEKFKSAATHIRKECTELQEENAATARPLEQETKRARKEEHGREKFRGALWGSNNELKLRREERDRSWVHGMILKEELVACA

SEQ ID NO: 113090 - protein, 179 aa, Glycine max
  Coding DNA Sequence Number=SeqID_21405
MGSSQKPSLKKGFYQVKIKSLEVTSLRKLGQLMGQLQQQAFAKPMDFQLVPTVKEFEEILGCPLGGRKPYLFSGFYPSTTRVAKVVKISAQDLERVKQNRNGVVRVPRKCVLFPNMEGLVDLAAIDAFLTFHHGMESPVVAILAMHDTFDQRCEKSGARIVCCTPALYVWLVSHLFLQE

SEQ ID NO: 113091 - protein, 112 aa, Glycine max
  Coding DNA Sequence Number=SeqID_21406
MKQAKYSLKAQVEKDEGPSGEGQSPRVEKDEGPKFLSGFLVEPIIRLIKVILVASTQTYLPSLEVASTQTYLPSPEVASTQTYLPSPEVASTLTYLPSPEVASSKNSIACIK

SEQ ID NO: 113092 - protein, 103 aa, Glycine max
  Coding DNA Sequence Number=SeqID_21407
MGETHEISHHNLANFEPHLGYATEGQAVGGVPLLNTLEGPQFRPQPQPLHFAVGRAPPAMAEKGKLDQIEERLRAIEGGGDYAFADMEDLCLVLDVVIPPKFK

SEQ ID NO: 113093 - protein, 117 aa, Glycine max
  Coding DNA Sequence Number=SeqID_21408
MSGRIQRQKPIKVLRGGRKYRLGSRSIDRRPMPSSGQAESAAGRQPRLARLGEHPCTWKHKNEGGGVSLLPHSKNANTHRICRFLPLGHHFCAFSSILSVFGHSIQGMASGLGCGLK

SEQ ID NO: 113094 - protein, 104 aa, Glycine max
  Coding DNA Sequence Number=SeqID_21409
MEREMITMIANTLPVLYYQKMVGYMPSSFVDLVFVGERIKVGLRRGKFDYPALMNRKPRANGENKKEEETHVVVAVPTWPNFPLAQQYQYLANIIHSHYPLFEL

SEQ ID NO: 113095 - protein, 162 aa, Glycine max
  Coding DNA Sequence Number=SeqID_21410
MEQETNQTEDKDGANEDMGLPSPRIRKDVAHDGLKKCRGNLSTKKPELVDFGIPVKKGNMPGLSSDIVQPDYLKSRVFPRSPKKKFPDAWFLAVARYPECEVAKHLYRSLRKIAGKYECCVDYRDLNRAVPRTIFFATTSIGLLVGYMTILDESMGLCPGAS

SEQ ID NO: 113096 - protein, 172 aa, Glycine max
  Coding DNA Sequence Number=SeqID_21411
MSMASSFLLLGGSYLHGTAWPFRYGNRIGLTIEGYRGVWGAASLVKYTTKGLGLPKLLSSTDYIHICCSSLPSSPTSSRPRSIICCNRLRPAWPTRLDDINCSPSMIGERSGPGFSHGMRKLRQGYTTLGNEVGRSSREISQSFDWRPWEGPLMLPGPSTAGHTLKGLTFLS

SEQ ID NO: 113097 - protein, 86 aa, Glycine max
  Coding DNA Sequence Number=SeqID_21412
MVIRRLVSPEGNEFDSIRMMCRYCHTLISSGDHLLLGCDPLLTTSRKSKPRRFYNVSVADFAKIFNRSSSFVVPSSSFFGLQPGIL

SEQ ID NO: 113098 - protein, 185 aa, Glycine max
  Coding DNA Sequence Number=SeqID_21413
MGSSQKPSLKKRFYQVKIKSLEVTSLGELGQLMGQLQRVGRNPGLPTGRKEAISFLWVLSLHDKSCQGGENLSTRVGPCKAKQKWGGRNTEKIFGAIDVFLAYHNHKESPVVAMLADLYDTFDRRCEESNARIVCCTPALYVGLVSHLFLQEGRPVYPLQGYRSCVEKGKANWDQLLASMGGGVC

SEQ ID NO: 113099 - protein, 131 aa, Glycine max
  Coding DNA Sequence Number=SeqID_21414
MDICEDTDILVILGRPFMLTASCIVDMGRRKLELGFEDQKIDFDLFDEDKPAPKQNVCLQVMEGGQEVLTELKNNLENIFLKNSPFAKRKPRAKRIFGHALRRESQALSAQPLHLRLIWSAKLAKAELSQL

SEQ ID NO: 113100 - protein, 163 aa, Glycine max
  Coding DNA Sequence Number=SeqID_21415
  Homolog annotation: Hit_ID=Q5CDC4; Match level="QueryCoverage=28%, HitCoverage=37%, E-value=5e-08, Identity=68%"; Hit description =LacOPZ-alpha peptide from pUC9
MGNKQSSYGVVAGEKFLQDLEAATIPEEEPQSFEASSSFPIAEHSHLYPSEDYIMAEEPRRVTLEDYSSSNVPQFFTSIAQPEVQVQTITYPPSLIQLIQNNLFHGLLNEDPYAHLATYIEICNTIRLAGTELEFVIMVIAVSCVKLLSAHNSTQHTSRKHKV

SEQ ID NO: 113101 - protein, 33 aa, Glycine max
  Coding DNA Sequence Number=SeqID_21416
MMVGRVLSTVGDPVLTQEMFGGSYGNDGKWRRN

SEQ ID NO: 113102 - protein, 237 aa, Glycine max
  Coding DNA Sequence Number=SeqID_21417
MPGSPAILFDIPCAGADILQEPTPFRRIGNNIEIGEFWIVMDENPADVEDDVLDGTAQRFFLFPLKASGMAAVIAFFMTVAVAGCSLADIFRTIDGEPQFEMRENMRNRTGSCPSRGERSRIDGRIAINASRPSAARNFGHPGEQSLIPSLAQKNRTIFGNGNECRACANWLFRFGRLYRKLFRVAGFERHAIVIERTDGTSWTPRRAYGCAQIHHRLRKISRPVDGSQLPHERADF

SEQ ID NO: 113103 - protein, 106 aa, Glycine max
  Coding DNA Sequence Number=SeqID_21418
MSLDSSSSVNGRHRSHLRPHSHMRENERKPQEANINLPYFHGKDNVEAYLDWEIRIEQKLKRKSTLKSYGSHSYPKKDQGLGILGAAPSKPKDDKGKTIEKQPPKA

SEQ ID NO: 113104 - protein, 111 aa, Glycine max
  Coding DNA Sequence Number=SeqID_21419
MQKFVVVMYYDSDVVSNLEGILIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 113105 - protein, 134 aa, Glycine max
  Coding DNA Sequence Number=SeqID_21420
MRGTVHEPQVNIGDDQNTLVSRGLYVLTFKGLHVLTIRGLHALTSRGLHVLALRGLHVLTTRGLHALTSRGLYVLALRGLHALTLGTSYPHRQRTTRPRLERTTRPHHQRAARPHLQRTTCPRLERATRPHLGY

SEQ ID NO: 113106 - protein, 205 aa, Glycine max
  Coding DNA Sequence Number=SeqID_21421
  Homolog annotation: Hit_ID=Q6Z8F0; Match level="QueryCoverage=25%, HitCoverage=47%, E-value=1e-16, Identity=80%"; Hit description =Putative uncharacterized protein P0459B01.18
MASGATCVQRLDGSRDSAIHTKYRISLRSSSMQEPRYPLPRVIVCKCCVGDDPGGTTMLPCAYGPTPGARRCRGTPRARAAIHNRDDDVSTSISTARAWAPPQSRTVHDFSQRRGHCSNFGLTSPQYFRNDLPEAAFNRTTRSDGRWWTKGRDDGALTLSGAPFQGTWARSATEDASPDYNSDAEGDRFSWWAFPGSLAVTKGIL

SEQ ID NO: 113107 - protein, 39 aa, Glycine max
  Coding DNA Sequence Number=SeqID_21422
ATKVWMTPLPGKEDKVRVDTTFRLRKISLGRRHFAGEGR

SEQ ID NO: 113108 - protein, 77 aa, Glycine max
  Coding DNA Sequence Number=SeqID_21423
MDIIGGDYCCQRLMNGIVSMKGGFKKRHHKLGLLMWRPKLPRRCRESVAAQAHVIPAMPKQQHRMYYTPDQFTQESS

SEQ ID NO: 113109 - protein, 135 aa, Glycine max
  Coding DNA Sequence Number=SeqID_21424
GHQDLFILRSDLPSQWLLFLSAVPPVQLLTGVGRVPFAIQAAQLLGRAIGAGLFAITPAGERGMCCKAIKLGNARVFPVTTFRETCRASCINESANARGEAVCVLALAECILAYYVGTDEGVSEVLHVAGEKRLH

SEQ ID NO: 113110 - protein, 68 aa, Glycine max
  Coding DNA Sequence Number=SeqID_21425
MRIHFLRWSIPEESCRHREADSTAKVAQGRLWRSAEGLQVLVQNSLEIMSGKKEMTPNRVVNWPFRTL

SEQ ID NO: 113111 - protein, 50 aa, Glycine max
  Coding DNA Sequence Number=SeqID_21426
MEEIHGAEDEERGIKALDPLHQWSPLLLEDQWQRNGEARKMIEDATSRRR

SEQ ID NO: 113112 - protein, 88 aa, Glycine max
  Coding DNA Sequence Number=SeqID_21427
MGVQIATRPIWALQKIPPEGGEEMKKEGIPALWHFSLFGICLENCFRRKSKPSASERFRNVSVRNLAKVSTVLRRSSFVLHRSSIFNG

SEQ ID NO: 113113 - protein, 80 aa, Glycine max
  Coding DNA Sequence Number=SeqID_21428
MSVALSGRSLSQQIGLARRQAKCEHGRARVQKTQKKTLFDAILPRKGPTTRAMSKRLQEDWARAVEDGPRVLMNLRGFIM

SEQ ID NO: 113114 - protein, 145 aa, Glycine max
  Coding DNA Sequence Number=SeqID_21429
MESMKDQMTSMMEAMLSMRWMMEDNAAAVVATSAATEADPTHPSSINQTSRPIPNMVGRGGECTCPMRTPTTPFPFPLKASNPNWGIQLLLSLWGKPVKSPRIILWASLNHTLHMPLRDQHLVVCLNPMPWELLNTAHCNLCISW

SEQ ID NO: 113115 - protein, 180 aa, Glycine max
  Coding DNA Sequence Number=SeqID_21430
  Homolog annotation: Hit_ID=Q6WAY4; Match level="QueryCoverage=45%, HitCoverage=15%, E-value=7e-08, Identity=39%"; Hit description =Putative uncharacterized protein
MGTNQNGKRFYQVKIKSLDVTSLKELGRLMGPLQRQAFCKVYRKILDLTIAEVFTEAIVSLAQYYDQPLRCFTFGDFQIVSTVEEFEEILGCPLGGRKPYLLSGFLPSLSKIAAVIRDSARKLDRYEANTKWHSGPTAEIHRRQGKGYGESRRVVLVCGYTSFANLWGCPLSKRGWFGWT

SEQ ID NO: 113116 - protein, 172 aa, Glycine max
  Coding DNA Sequence Number=SeqID_21431
  Homolog annotation: Hit_ID=Q6WAY4; Match level="QueryCoverage=50%, HitCoverage=15%, E-value=2e-08, Identity=37%"; Hit description =Putative uncharacterized protein
MGTRGCINYNPILAIRQLGYPMRRAPLEEGLTPIIARGFKSTDAGLLQKIRKAWETVQKKDKELRGNSNGPIDGYYRWLKAYAQGLDWLPNLRTTKGVEVETPEEDEEVQALKTELEKAQTDKEKFKSATIRIQKENAELRDVNITTTKALEQETKRARREEHGRNKFQGAL

SEQ ID NO: 113117 - protein, 154 aa, Glycine max
  Coding DNA Sequence Number=SeqID_21432
  Homolog annotation: Hit_ID=A6T6U9; Match level="QueryCoverage=92%, HitCoverage=89%, E-value=8e-63, Identity=83%"; Hit description =Putative sensory transduction regulator
MDSLVVPGLDTLRHWLDELGISFFECDSCQALHLPHMQNFDGIFDAKIDLLDNVVLFSALAEVKPSALLPLSADLSAINASSLTVKAFLDIQDDNLPKLVVCQALPVGAGVTLEQFAWFFRQSEEQVSMVILEAGANQLLYKAEEQEEEAAAEE

SEQ ID NO: 113118 - protein, 69 aa, Glycine max
  Coding DNA Sequence Number=SeqID_21433
  Subcellular localization annotation: CTP_CleavageSite=38; ConfidenceScore=5.28e-01
MGLDHSCCPLLSAFFLLAQLLLGGSEKSKQPKRARRTRAGSGNNTSNNQNSGLGGGSSIPEIDDVEKGD

SEQ ID NO: 113119 - protein, 140 aa, Glycine max
  Coding DNA Sequence Number=SeqID_21434
ALGFPALVTGLCSPTGCPFPPARSRHHDIGIAPARHPVDPKKSNRALELSNGKGIRPPTNRAFIKKYCVPRQAQGETPQQHWDGRHHASGSKDVKEALLGGNLELATEKLPAKRSRKGTIEEDSSAAPQADAGFDKHRFQ

SEQ ID NO: 113120 - protein, 80 aa, Glycine max
  Coding DNA Sequence Number=SeqID_21435
  Homolog annotation: Hit_ID=A5AS08; Match level="QueryCoverage=77%, HitCoverage=3%, E-value=9e-09, Identity=53%"; Hit description =Putative uncharacterized protein
MSRRVGWVERKAFRKSGVEELKKDLPIEKAKVDLKILPEHLKYVFLEDNKAKPIVISNSQTDEEESWLVKVLKKHRAVIG

SEQ ID NO: 113121 - protein, 139 aa, Glycine max
  Coding DNA Sequence Number=SeqID_21436
  Gene Ontology: Biological process=transposition, DNA-mediated
  Homolog annotation: Hit_ID=Q1J7G7; Match level="QueryCoverage=27%, HitCoverage=67%, E-value=7e-11, Identity=72%"; Hit description =Transposase
LAQGFRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTFPGASAIAGGYSRGHTRGHSTDFTGHYTTCGGL

SEQ ID NO: 113122 - protein, 77 aa, Glycine max
  Coding DNA Sequence Number=SeqID_21437
  Gene Ontology: Mol. function=nucleic acid binding
  Homolog annotation: Hit_ID=A5AYU6; Match level="QueryCoverage=98%, HitCoverage=13%, E-value=3e-13, Identity=49%"; Hit description =Putative uncharacterized protein
MESSKDSENEEIKLCLMAKSYESDEEVSLRKEWYIDSRCSKHMTRDASKFTHISPKKNGHVTYGDNNKGRILGVGKI

SEQ ID NO: 113123 - protein, 61 aa, Glycine max
  Coding DNA Sequence Number=SeqID_21438
MRRVYEGSTVVHSTPLLSGQVKVTVEEVTDADAPVPVPTNELCLRQNHLQSPIRRSMIRFI

SEQ ID NO: 113124 - protein, 252 aa, Glycine max
  Coding DNA Sequence Number=SeqID_21439
  Gene Ontology: Mol. function=transferase activity, transferring phosphorus-containing groups; Cellular component=intracellular; Biological process=two-component signal transduction system (phosphorelay)
  Homolog annotation: Hit_ID=A8GG46; Match level="QueryCoverage=100%, HitCoverage=36%, E-value=4e-85, Identity=70%"; Hit description=CheA signal transduction histidine kinase
  Pfam annotation: Domain name=CheY-binding; Domain location=1-37; Score=27.1; E_value=3.7e-05; Accession=PF09078.2; Description=CheY binding
  Pfam annotation: Domain name=H-kinase_dim; Domain location=92-155; Score=96.3; E_value=9.9e-26; Accession=PF02895.5; Description=Signal transducing histidine kinase, homodimeric domain
  Pfam module annotation: Pfam domain module=CheY-binding::H-kinase _dim; Domain location=1-37::92-155
PHQTEHSLDVTLLTSASEDDISAVLCFVLEPEQISFSTPTQSEPAVAEASLPAAVAAPEPAPVPVANAAPPAAKPAAAPAEAPKARAKASESSSIRVTVEKVDQLINLVGELVITQSMLAQRSGALDPVAHGDLLNSMGQLERNARDLQESVMSIRMMPMEYVFSRFPRLVRDLASKLGKEVELTLLGSSTELDKSLIERIIDPLTHLVRNSLDHGIETPEKRLAASKTAVGNLTLSAEHQGGNICIEVIDD

SEQ ID NO: 113125 - protein, 83 aa, Glycine max
  Coding DNA Sequence Number=SeqID_21440
MAPQKLSTKRSRRDAIGEGAEHQQRFEAIRGWSFHRERRVQLREDEYTGFPFDADALSQFLGDSLVLEEGLQCDFSQRRNNAD

SEQ ID NO: 113126 - protein, 51 aa, Glycine max
  Coding DNA Sequence Number=SeqID_21441
KRLQCERYFSQLKHDIKIPNGENARNWAANIVLKFHDDPTVNESEIVIYLR

SEQ ID NO: 113127 - protein, 139 aa, Glycine max
  Coding DNA Sequence Number=SeqID_21442
  Gene Ontology: Cellular component=membrane; Biological process =lipopolysaccharide biosynthetic process
  Homolog annotation: Hit_ID=Q1GZP5; Match level="QueryCoverage=100%, HitCoverage=29%, E-value=1e-28, Identity=44%"; Hit description =Lipopolysaccharide biosynthesis
MPSTFKSTATLILNYKGVDPVTGITLPAQLMPGYMATQVNILNSHRIATAVVDRLDLTKNPLIVEKYKDEKDNGYSIRDWTAKLISKGLEVAPSRDSSMIDISYLSSSPDFSAFVTNAFAAVYVDESLKLDVEPSKKAA

SEQ ID NO: 113128 - protein, 138 aa, Glycine max
  Coding DNA Sequence Number=SeqID_21443
  Subcellular localization annotation: CTP_CleavageSite=50; ConfidenceScore=5.33e-01
TTVASFTLARTRIKSLGELISRVFTRFRKCGWIAVIRSFGYATVSRSLTRRSMLPQSRARGRYHGHQPIMPVTVGTAAIRPLQGENILYRKKSPGRSFSPLDLVLEWFEEINEDKMGEVGREIAQSKQCVGAITGYAG

SEQ ID NO: 113129 - protein, 27 aa, Glycine max
  Coding DNA Sequence Number=SeqID_21444
MDTRLRVIRDPMNGVQQGSQPTLEGFT

SEQ ID NO: 113130 - protein, 292 aa, Glycine max
  Coding DNA Sequence Number=SeqID_21445
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSITIPNSYYYDATIKEYPSPASSNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 113131 - protein, 153 aa, Glycine max
  Coding DNA Sequence Number=SeqID_21446
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MKLKFFFSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFLPLRTTPSVAEQEGQLIETEATGAPQKHHHTLNQ

SEQ ID NO: 113132 - protein, 119 aa, Glycine max
  Coding DNA Sequence Number=SeqID_21447
MVGYTPSSFADLVFAGERIKVSLERGKSDHPALMNVKTRANEEDENEGETHVATVIPTWPNFPPAQQCHYSANNNPSPYLPPSYPQSHNPCQGSSKSIFPRIRLERNMCISWRSPGAFH

SEQ ID NO: 113133 - protein, 59 aa, Glycine max
  Coding DNA Sequence Number=SeqID_21448
MDKSLKVGEDEWRERERRSTKFCASNEVLTLKSMVQPTNPRSSPRFSTKCLRCHEACKA

SEQ ID NO: 113134 - protein, 185 aa, Glycine max
  Coding DNA Sequence Number=SeqID_21449
MDNEEGVQEQMKADLSALKDQMASITEAMLKIQKTIEDNATAAASNTTREAEPVLQPAINLGRDRNATGFNRRYNPQAYPYGLPLDFTPHTAPDDLSQAPTFEGQLPPHADYPLQEDDEGDAHLGPLLPLKEPAPHEFPQPNIVRHVPSPSAPVKELVPFAKDKGNIDLLEERLRAVEGLDIVCT

SEQ ID NO: 113135 - protein, 141 aa, Glycine max
  Coding DNA Sequence Number=SeqID_21450
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
  Subcellular localization annotation: CTP_CleavageSite=35; ConfidenceScore=5.09e-01
MKHFTDTLISANIKPRPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 113136 - protein, 82 aa, Glycine max
  Coding DNA Sequence Number=SeqID_21451
MVAITLAKVHQPPFLREYDSNAACACHGEAPGRSIEHCMTLRRKDFQVQAIGQFAQTTFAPEFGLPRPFNQRLLVLHVGGVP

SEQ ID NO: 113137 - protein, 54 aa, Glycine max
  Coding DNA Sequence Number=SeqID_21452
MGELKYFLGLNDQANSRRYEILNQSKYCKELIKRFGMESARHMGFNPTPNSRKT

SEQ ID NO: 113138 - protein, 356 aa, Glycine max
  Coding DNA Sequence Number=SeqID_21453
  Homolog annotation: Hit_ID=Q6WAY6; Match level="QueryCoverage=97%, HitCoverage=64%, E-value=2e-20, Identity=25%"; Hit description =Putative uncharacterized protein
MANQGDWVPFMDVLALLIFGVVLFPNVDGLIDLAAIDAFLAYHHSKESPVVAVLADLFDTFDRRCEKSSARIICCLPALCVWLVSHLFQQDTRHPCPLLSHRSCTEKRRMDWDQLLAGIGGRTISWFPRWKEGREGVLFSCGRYPNIPLVGTRGCINYNPTLAIRQLGYPMRGAPTEESMSPFLVRDLGAQNSKTIQRIHKHGNPVKERSELRGIRMASLWRSSSWPLHTFGRSVPGYGKRMQLPQEPLNKRPKRARKEEYGRNKFRGALWGSNSELKLRREERDQSRAHSMVLKEELVACSRSKRSLSQRLCETETNMLAIIAKYQEELGLAAAHEHRIADEYAQVYAEKEARGR

SEQ ID NO: 113139 - protein, 62 aa, Glycine max
  Coding DNA Sequence Number=SeqID_21454
MQGLPQLPQILSVVSLDNIGVHGEAQGPPHGTCASAPSCRTRSSSFVDTGAHGSWPSSAYLQ

SEQ ID NO: 113140 - protein, 92 aa, Glycine max
  Coding DNA Sequence Number=SeqID_21455
MMGDASKFIHISPKKSGHVTYGDHNKESLEEMHIHGEDHKGKGDGNNEDFHIDEIKANADLPREWRASRYHPLDNIIGDISKGVTTRHSLKI

SEQ ID NO: 113141 - protein, 82 aa, Glycine max
  Coding DNA Sequence Number=SeqID_21456
MKNVEERLELCEILHGKRYGNVSEAPRLRFSSRNNFSKEIRKRENKGATNPFPSVKGSEVVFTHGEGIGPLNDLLILKGEKR

SEQ ID NO: 113142 - protein, 104 aa, Glycine max
  Coding DNA Sequence Number=SeqID_21457
TYALGNPFRSVQIAHRKHNDNYCSLMSSSSNDFQDYFDDAKESRVKQVSKNQESKSFKNQVSKNQDSRTIKFQDSRFKNNQVSRFKIQEQSRSKFKNQEKTQSR

SEQ ID NO: 113143 - protein, 143 aa, Glycine max
  Coding DNA Sequence Number=SeqID_21458
MLCTSPCCAFVRLHHVVTHALYVGLIFCHGKLEDPYHLLNCTHGGTATPNVQVRRDDFSGSRVLLAIEIAIPWVMGLNQAHAFTKKVHQVKLKYGSNHLAKLGQKMDRVTSLLRLLPNTFRTVDVLVTSSFTLTKMSWTMLKI

SEQ ID NO: 113144 - protein, 100 aa, Glycine max
  Coding DNA Sequence Number=SeqID_21459
MKGVEAKLHGESKVMTKSSKINQRTTQENPRSIKNNSRVQDKNQEEFKTQEESLETRIKIQGSRSQESRSRFKTQDSRMKRRFNEDQDSRMKRRLNQNKY

SEQ ID NO: 113145 - protein, 76 aa, Glycine max
  Coding DNA Sequence Number=SeqID_21460
MVSDTETSHTLQTSSRRSQRSDRGKVSCEAADQISRSSNGCYKYKCHSKSWAFKRTQLLQAPKYSLHIASPISNIF

SEQ ID NO: 113146 - protein, 52 aa, Glycine max
  Coding DNA Sequence Number=SeqID_21461
MSAIEFSIQSLNEICMMSAKYSLKAQVEKDEGPSGEGQSPRVEKDEGPSGEG

SEQ ID NO: 113147 - protein, 108 aa, Glycine max
  Coding DNA Sequence Number=SeqID_21462
  Homolog annotation: Hit_ID=A5BLB0; Match level="QueryCoverage=100%, HitCoverage=8%, E-value=6e-13, Identity=35%"; Hit description =Putative uncharacterized protein
MAPNKVFPLFMPFGQNNALKYENMDESILWHLRCTGYHFQKHLRELKLHFNWCMLISGDHQVPPALVEEDIFLLFVDDYTRMMWVYFIQQKSDAFSYFKEFKAQMEKQ

SEQ ID NO: 113148 - protein, 105 aa, Glycine max
  Coding DNA Sequence Number=SeqID_21463
MTSRDQIWSFCTLVSSRGGGPDDTRRYLTVIRTLVSSRGGGPDDTRKYPSGYPYKHSFAISPRPTWALQKIPPEGGCFWRKQPCSPGRAELAWASWAATTSPILL

SEQ ID NO: 113149 - protein, 41 aa, Glycine max
  Coding DNA Sequence Number=SeqID_21464
MEVDEPWLGLWLPLNYQVDFVVDSGMAFVDNWVVGKEKEWQ

SEQ ID NO: 113150 - protein, 195 aa, Glycine max
  Coding DNA Sequence Number=SeqID_21465
  Homolog annotation: Hit_ID=A5BKB8; Match level="QueryCoverage=68%, HitCoverage=39%, E-value=2e-38, Identity=65%"; Hit description =Putative uncharacterized protein
MGGGAWPFLVGGAICLVNSVNERDLSLLNSYVEIIAIVGLQRGIPSKRESSARVDYVPALCTHRPSLLPIEWSGEVFGLRRREPAEGSLSMPHNQIDPRTCLFIYRREGGDDHGAPNSNLLSATPGGPETVSRGSRHDTTFTYNDSRATGYLGSCIDEERSEMAILWCELQNPVNHRVFERKLRPEALGRGTPGW

SEQ ID NO: 113151 - protein, 16 aa, Glycine max
  Coding DNA Sequence Number=SeqID_21466
MGVVFVIGSAVDRLWG

SEQ ID NO: 113152 - protein, 145 aa, Glycine max
  Coding DNA Sequence Number=SeqID_21467
MRRQNLVIPHPFAIQTQSCPMVRRDKIWSFCTLCHPEAAGPMTCGDKIWSFRTPCHSDTVVSDGAQRQNLVILHPLSSTGGGPDDMRRQNLVIPHPFAIQTQSYPMRQNFGHSAPFVIQSRRADDMRDKIWSFRTPLPFRHGRVR

SEQ ID NO: 113153 - protein, 326 aa, Glycine max
  Coding DNA Sequence Number=SeqID_21468
  Homolog annotation: Hit_ID=A5ASR8; Match level="QueryCoverage=79%, HitCoverage=58%, E-value=4e-08, Identity=21%"; Hit description =Putative uncharacterized protein
  Subcellular localization annotation: CTP_CleavageSite=41; ConfidenceScore=5.59e-01
MAEPSKKRKGSSSTATAAAHRRHGPSGAPTAPIPPSLSSPRSSTLFSSDDQRLRYLSQFSSRIILDPKYLDVEFFNDETFDCYQVFQNSGLVDFMSFKLSYYPELVKVHGTSMVIDQSLFFSLTHLPSQGAPFEGTIVDDWKFDYSSHDARRMVCNDQAEMTGRLLAGSLTFDNRIMHYIIVRILLPRSSNLAQASEEDLILMWAFLTGRQIDWAHLVRYRMHKALRANAPLPYPHLITLFLRHFQIPLNDEPFVQVKRSFAIGAGAVTSFGYRKDRNGQWLKKDALPPQDERTPSPPPQREDSALMNEVLSELRGLRSYVGDRFD

SEQ ID NO: 113154 - protein, 127 aa, Glycine max
  Coding DNA Sequence Number=SeqID_21469
MTRGNPSDLQPFDPEIDRTFHRLVRHHFIPFDHSEHSITGESVHSVIGDFEHPDLEHYNFEHSDSEHSDFAHSQNMAQPPPRERTLREMAAPDFTYESLCIQYPDEDVPYVLKTGLIHLLPKFHGLA

SEQ ID NO: 113155 - protein, 57 aa, Glycine max
  Coding DNA Sequence Number=SeqID_21470
  Subcellular localization annotation: CTP_CleavageSite=28; ConfidenceScore=5.10e-01
MGAQAPSRGTKRNGRTSIEQKVPRTKIRRKNLSEFNSNNKTSKRVVLDPQEKTTLET

SEQ ID NO: 113156 - protein, 188 aa, Glycine max
  Coding DNA Sequence Number=SeqID_21471
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=45%, HitCoverage=72%, E-value=6e-24, Identity=66%"; Hit description=LacZ protein
  Subcellular localization annotation: CTP_CleavageSite=35; ConfidenceScore=5.50e-01
PVYTPLAPNTQTASPRALARFINAAGTTGFPTGKRAVSATQLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSGTATLASADVRAVLLPLRTTPSVAEQEGQLIETEATGAPSKTPSYTKS

SEQ ID NO: 113157 - protein, 114 aa, Glycine max
  Coding DNA Sequence Number=SeqID_21472
MVKEKSKEVSVSSKRLAKKESHFEIKTNINETSPLRKPPHLLLCKKTLVSTATPLGLEVIPQVLIGTCRNLPFGRRVARDSRVRLPRKEYARSRHQCLFEENIGKTGKDVVYEL

SEQ ID NO: 113158 - protein, 173 aa, Glycine max
  Coding DNA Sequence Number=SeqID_21473
  Gene Ontology: Mol. function=aspartic-type endopeptidase activity; Biological process=RNA-dependent DNA replication
  Homolog annotation: Hit_ID=Q6WAY3; Match level="QueryCoverage=74%, HitCoverage=7%, E-value=3e-13, Identity=29%"; Hit description =Gag/pol polyprotein
MGAYSRDEKLLMYFFQDSLAGAVVIWYTNLEASHIRTWKDFITAFITQVALPMVEREMIMMIVDTLPIFYYEKLVGYMPASFADLVFAGERIEVGLKRGKFDYVSPADTNNRRTETVGAMRKEGDAHAITLTPAWPKPQQAPHALPAQCPSSQGRLRQLKGALFRHRLQPNLA

SEQ ID NO: 113159 - protein, 216 aa, Glycine max
  Coding DNA Sequence Number=SeqID_21474
  Homolog annotation: Hit_ID=Q6WAY6; Match level="QueryCoverage=99%, HitCoverage=34%, E-value=2e-24, Identity=33%"; Hit description =Putative uncharacterized protein
MASQEKWGPFADILALLIFGVVLFPNVDGLVDLAAIDAFLAYHRNKESPVVAILANLFDTFDRRCEKNSAQIVCCLPALCVWLVSHLFQQDTRYPCPLQSYRSCAEKGRVDWDQHLAGIGGNTINWFPHWKEGKEGVLFSCGDYPNVPLIGTRGCINYNPALAIRQLGYPMRGTPTEESLSPFLVRDLGAQSLKVIQRVHKAWRSPLRKDKELRGI

SEQ ID NO: 113160 - protein, 42 aa, Glycine max
  Coding DNA Sequence Number=SeqID_21475
MDKSLKVGEDEWREKERRSTKFYASNEPTNPRSGPRFSTKCA

SEQ ID NO: 113161 - protein, 98 aa, Glycine max
  Coding DNA Sequence Number=SeqID_21476
MSKYVLCQHSWKICLNSGGNIAASSKICLHGGGIVLRRRDGVLCGGSVVLCLCDGVFRGGGAVLRCHDGALLSGFCVSVAEVQNSKSQDRIEVNENDK

SEQ ID NO: 113162 - protein, 159 aa, Glycine max
  Coding DNA Sequence Number=SeqID_21477
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
MLCKSPCCAFAHLHHAVTHALYVGLVFCCGKSEDPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 113163 - protein, 33 aa, Glycine max
  Coding DNA Sequence Number=SeqID_21478
MSLRRLGSSSLESYSLHPATIILLPRTKFVIIT

SEQ ID NO: 113164 - protein, 168 aa, Glycine max
  Coding DNA Sequence Number=SeqID_21479
MRPWRVARPPLTPITLVPFSDTYIPNWGPPPAFSHGMLETVKKKLERRSPTSGVGSGSPKSTKFCKEPKSVGSGTCDTGSSGEATVGCASPWGASSLGSETFGFDEDASSSNFVRLDWESKGSSSRGRFPNEASSPPFLWQKEVTAIVKMAVRVASPIILAVSNKKSK

SEQ ID NO: 113165 - protein, 80 aa, Glycine max
  Coding DNA Sequence Number=SeqID_21480
MFNPPGILESLKISEKNCFREENPSQGASVTLPRLFRGRFREGFPPFFVRSSVFNRSNALKWSFPLLLVKRGLLKPKVNT

SEQ ID NO: 113166 - protein, 99 aa, Glycine max
  Coding DNA Sequence Number=SeqID_21481
MAQECFPNEYMMWNCPSSVDKWHESSFSNARNGPEESSPQRDLARIKRLKEPVLLPSMTVIALGALNTSSASRPSRDGHFSRSDASSSGTTSILISRRR

SEQ ID NO: 113167 - protein, 82 aa, Glycine max
  Coding DNA Sequence Number=SeqID_21482
WAEGKEAPSVKVACLAQEVGTVENKVANGLTKPMMLSWSFRMISHTGTETRPGLPRGQQWGILDMGESPIQQYRVSEEGNAA

SEQ ID NO: 113168 - protein, 78 aa, Glycine max
  Coding DNA Sequence Number=SeqID_21483
  Subcellular localization annotation: CTP_CleavageSite=30; ConfidenceScore=5.29e-01
MFSPPENPSRGASVGDFVKIFKLSSTFFIRSSSFFGLQPDKNNLTKHFVHKELRRSDFLIAIKEYVGARETPLSTAKR

SEQ ID NO: 113169 - protein, 185 aa, Glycine max
  Coding DNA Sequence Number=SeqID_21484
  Gene Ontology: Mol. function=tRNA (guanosine-2'-O-)-methyltransferase activity; Biological process=RNA processing
  Homolog annotation: Hit_ID=A7MQB1; Match level="QueryCoverage=44%, HitCoverage=35%, E-value=1e-33, Identity=82%"; Hit description =Putative uncharacterized protein
  Pfam annotation: Domain name=ACT; Domain location=37-103; Score=19.5; E_value=0.012; Accession=PF01842.16; Description=ACT domain
  Pfam annotation: Domain name=SpoU_methylase; Domain location=112-185; Score=-49.2; E_value=0.04; Accession=PF00588.10; Description=SpoU rRNA Methylase family
  Pfam module annotation: Pfam domain module=ACT::SpoU_methylase; Domain location=37-103::112-185
AGGASTNPAVTFAATRKDPEKFMPVEWDKVTDQEFVAEIKVDMFNHQGALANLTAAINTAGSNIQSLNTEERDGRVYSAFIRLTANDRVHLANIMRKIRVMPDEMLAMRQHDLTVCMEQVHKPHNVSAVIRTADAVGIHEVHAVWPSVRMRTMVSASAGSNSWVKVKTHRHIADAVRHLKDRGMQ

SEQ ID NO: 113170 - protein, 132 aa, Glycine max
  Coding DNA Sequence Number=SeqID_21485
MSEIEEVQEQMKADMEAMKGQMAAMMEAMLSMKKIMENNVVAVATTSAATEVREEKRYEVRAAPILCKFKTRIPSHYMAYLLTIHHPMMHTLPMRMSTTLHPYPLRANNPNLIMHKSLNLWGRHMKHPKTTI

SEQ ID NO: 113171 - protein, 78 aa, Glycine max
  Coding DNA Sequence Number=SeqID_21486
MTQKEEEATMKGDKCPKATDEGPKGATGSYSAQWNAPELSHDKHMSHLSCILIEMEVVLGLGCAASGYYGRFKGGLCG

SEQ ID NO: 113172 - protein, 337 aa, Glycine max
  Coding DNA Sequence Number=SeqID_21487
  Gene Ontology: Mol. function=sequence-specific DNA binding; Cellular component=nucleus; Biological process=regulation of transcription, DNA-dependent
  Homolog annotation: Hit_ID=A9PG66; Match level="QueryCoverage=98%, HitCoverage=99%, E-value=2e-70, Identity=44%"; Hit description =Putative uncharacterized protein
  Pfam annotation: Domain name=HALZ; Domain location=230-274; Score =90.1; E_value=6.8e-24; Accession=PF02183.9; Description=Homeobox associated leucine zipper
  Pfam annotation: Domain name=HD-ZIP_N; Domain location=21-127; Score=- 20.4; E_value=0.019; Accession=PF04618.3; Description=HD-ZIP protein N terminus
  Pfam annotation: Domain name=Homeobox; Domain location=165-219; Score= 51.5; E_value=2.8e-12; Accession=PF00046.20; Description=Homeobox domain
  Pfam module annotation: Pfam domain module=HALZ::HD-ZIP_N::Homeobox; Domain location=230-274::21-127::165-219
MELALSLGDTSKSFTFLDKAVTLPPNKDPPGFCLAPSFAEKRSDSERGTASGSSDPPVQLDLLPFSPVLRPQQHPPSHLRIPWLTQACGGAARVLDVNLFPAATAEDGDDGTSLSSSPNSAVSPFQMDFCTRNGNAAEFGSRNKREQQEAEGRASDDDENGSTRKKLRLSKEQSAFLEESFKEHTTLNPKQKLALAKQLNLRPRQVEVWFQNRRARKAINMVMDLWTKLKQTEVDCEYLKRCCETLTEENRRLQKELQELRALKSSQPFYMQLPATTLTMCPSCERVATNSTTTNQTSIVNNNASSQIPVELSLSKPRILPFPNGQVQAQAHQIASS

SEQ ID NO: 113173 - protein, 302 aa, Glycine max
  Coding DNA Sequence Number=SeqID_21488
MGARVTVVETSKNNDGVLTTDVDILSNNVGGEPATDVERKPNKYGCSAYLTLKWTTTTTGLRALTLYSDITKTGPIMIDVVVVDIQRHLEQRRCGARRRYMFSTDDLMAVITILLKQESGFMITMQIAAKMYMSMSYSYGKKFASPITPLILNDVGHVDHVADEVHEQPQEPITNHVNVDTEGFPGGPYDITVLMSYGYHVAHKVWAGEVEKFGRPAPEIEGIVTITRLSSLIACLLDTGEVTITLDDVASLLHLPITGVFHTFDALDEDHVVDLLVELLEISTQEAKDEIEQCKEAYVRLA

SEQ ID NO: 113174 - protein, 68 aa, Glycine max
  Coding DNA Sequence Number=SeqID_21489
MSERKGRGEEENEKPTMKRQATCEIRMQLMQSYPPRALDRRHQEYWTKDAREGPRVLMSLRVDFGPMG

SEQ ID NO: 113175 - protein, 49 aa, Glycine max
  Coding DNA Sequence Number=SeqID_21490
MAIKERQRKDMRQDAVVARQDATKTKDKWQDLRFHLQFPPLRERIQVNY

SEQ ID NO: 113176 - protein, 144 aa, Glycine max
  Coding DNA Sequence Number=SeqID_21491
MGTNFLRFFTLSIISKAQFSSKFWPSVCPYLHILCLIPLCISHYSPHLLGTQPPVLVVDHDPFFHPHDFISSNEFYDAINVQKLSQKEGQNGVLMKTSYPKFAQANIQLIWAKDIISVLSKKLAWASYGSLGPVNAFTIKPQFA

SEQ ID NO: 113177 - protein, 110 aa, Glycine max
  Coding DNA Sequence Number=SeqID_21492
  Pfam annotation: Domain name=zf-CCHC; Domain location=26-43; Score =13.4; E_value=0.014; Accession=PF00098.14; Description=Zinc knuckle
MGWAKKGDIKIIDVPRDYYQYGSLHHICFNCGRYGHRDNACLEKKATNVEVIKERHVEVVEAMKVQKMMNEVVSTPEISMGKMTINENIVTQESRALVSIKSNVCQNENP

SEQ ID NO: 113178 - protein, 62 aa, Glycine max
  Coding DNA Sequence Number=SeqID_21493
MVVLEEEDHRCEGRVTSSRTGFQELSGGREDDGDKGNTQMFWKKMSREFKNEISETFRWKRG

SEQ ID NO: 113179 - protein, 324 aa, Glycine max
  Coding DNA Sequence Number=SeqID_21494
MVAVRFVELGPWMVVVVVAMSERTKGVDLGFCRSVPGTDLGFQRYEYQGRLFDLFFCLLRSSYAASLYVFRVSLLLGGCVTLIPRPFGERLVLVWLVPLVRLVQVGLGVCFSLVALLSGLSDFISESGHFFHLDVDLGLLTLSANLSGHNARSIEYNANSSQGHVVRPTGGVLCTEFFDKGVEAVYGPGKASRCLSRSIVPSYYSRLSGFHPKDMSTSIMQSTKGCRRMVCPIGWCMWGRLKSFATWPVSRVGHGQPLALSTPPHGGLVSEANRVITMDERERKFTRGRGLCGVPNFTHQLGKVPLTGGGTYKTKDFNTKALHH

SEQ ID NO: 113180 - protein, 205 aa, Glycine max
  Coding DNA Sequence Number=SeqID_21495
  Gene Ontology: Mol. function=chaperone activator activity; Cellular component=cytoplasm; Biological process=response to stress
  Homolog annotation: Hit_ID=Q3EB77; Match level="QueryCoverage=91%, HitCoverage=61%, E-value=4e-69, Identity=64%"; Hit description =Uncharacterized protein At3g12050.2
  Pfam annotation: Domain name=AHSA1; Domain location=78-136; Score =25.6; E_value=0.00018; Accession=PF08327.2; Description=Activator of Hsp90 ATPase homolog 1-l
MSKKGRVVVLEKVRVWVESMAKGGPVKDELEAKKVAVPHNKNNTSSSNGDNNDLKKEEVNKSEGKKGFKLISLTEKFNCRARDLFEILMDENRWRGFTQSNARISKEVGGEFSIFDGSVTGKNLELEEGMLIVQRWRFGSWPDGIESMVRIMFEEPEDGVTVVKLTHSDVPEEDRYGNATVVENTERGWRDLIFQRIRTAFGFGI

SEQ ID NO: 113181 - protein, 44 aa, Glycine max
  Coding DNA Sequence Number=SeqID_21496
MVRVETKGLERPIWQNNSKGDPKVQFLAVNDWCQLQRSLGIIQG

SEQ ID NO: 113182 - protein, 159 aa, Glycine max
  Coding DNA Sequence Number=SeqID_21497
MARGSRTTARRGTCREGGGVVGDHQRRRGIVEECEGVGGGGGVPEVDVGEMAGPRGGGGGHGEEEVADEGRVDEAGNYEREAYKGEVFSRRELRGTKLISREHEFNSYGMNYENANHEHSKTVINDRLSIYVVESKFPQLNYKFATASHSKTVADNRLK

SEQ ID NO: 113183 - protein, 60 aa, Glycine max
  Coding DNA Sequence Number=SeqID_21498
  Subcellular localization annotation: CTP_CleavageSite=51; ConfidenceScore=5.06e-01
MTSSSSGTACVVAMQTKWRPRGENGRAKRKRVEAREEAMTWRQRGLARGCSASGEGVLVL
